(12) United States Patent
Zimmermann et al.

(10) Patent No.: US 10,597,709 B2
(45) Date of Patent: *Mar. 24, 2020

(54) METHODS FOR SIMULTANEOUS AMPLIFICATION OF TARGET LOCI

(71) Applicant: Natera, Inc., San Carlos, CA (US)

(72) Inventors: Bernhard Zimmermann, Manteca, CA (US); Matthew Hill, Belmont, CA (US); Philippe Lacroute, Sunnyvale, CA (US); Michael Dodd, San Francisco, CA (US); Alexander Wong, Mountain View, CA (US)

(73) Assignee: Natera, Inc., San Carlos, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 16/412,301

(22) Filed: May 14, 2019

(65) Prior Publication Data

US 2019/0316177 A1    Oct. 17, 2019

Related U.S. Application Data

(63) Continuation of application No. 15/336,630, filed on Oct. 27, 2016, now Pat. No. 10,351,906, which is a continuation of application No. 14/538,982, filed on Nov. 24, 2014, now Pat. No. 9,677,118.

(60) Provisional application No. 61/982,245, filed on Apr. 21, 2014, provisional application No. 61/987,407, filed on May 1, 2014, provisional application No. 61/994,791, filed on May 16, 2014, provisional application No. 62/066,514, filed on Oct. 21, 2014.

(51) Int. Cl.
| | | |
|---|---|---|
| *C12Q 1/68* | (2018.01) | |
| *C12Q 1/686* | (2018.01) | |
| *C12Q 1/6874* | (2018.01) | |
| *C12Q 1/6883* | (2018.01) | |
| *C12Q 1/6811* | (2018.01) | |
| *C12Q 1/6848* | (2018.01) | |

(52) U.S. Cl.
CPC .............. *C12Q 1/686* (2013.01); *C12Q 1/68* (2013.01); *C12Q 1/6811* (2013.01); *C12Q 1/6848* (2013.01); *C12Q 1/6874* (2013.01); *C12Q 1/6883* (2013.01); *C12Q 2600/156* (2013.01)

(58) Field of Classification Search
None
See application file for complete search history.

(56) References Cited

U.S. PATENT DOCUMENTS

| | | |
|---|---|---|
| 5,635,366 A | 6/1997 | Cooke et al. |
| 5,716,776 A | 2/1998 | Bogart |
| 5,753,467 A | 5/1998 | Jensen et al. |
| 5,824,467 A | 10/1998 | Mascarenhas |
| 5,860,917 A | 1/1999 | Comanor et al. |
| 5,972,602 A | 11/1999 | Hyland et al. |
| 5,994,148 A | 11/1999 | Stewart et al. |
| 6,001,611 A | 12/1999 | Will |
| 6,025,128 A | 2/2000 | Veltri et al. |
| 6,066,454 A | 5/2000 | Lipshutz et al. |
| 6,100,029 A | 8/2000 | Lapidus et al. |
| 6,108,635 A | 8/2000 | Herren et al. |
| 6,124,120 A | 9/2000 | Lizardi |
| 6,143,496 A | 11/2000 | Brown et al. |
| 6,156,504 A | 12/2000 | Gocke et al. |
| 6,180,349 B1 | 1/2001 | Ginzinger |
| 6,214,558 B1 | 4/2001 | Shuber et al. |
| 6,258,540 B1 | 7/2001 | Lo et al. |
| 6,300,077 B1 | 10/2001 | Shuber et al. |
| 6,479,235 B1 | 11/2002 | Schumm et al. |
| 6,440,706 B1 | 12/2002 | Vogelstein et al. |
| 6,489,135 B1 | 12/2002 | Parrott et al. |
| 6,720,140 B1 | 4/2004 | Hartley et al. |
| 6,794,140 B1 | 9/2004 | Goldsborough |
| 6,807,491 B2 | 10/2004 | Pavlovic et al. |
| 6,852,487 B1 | 10/2005 | Barany et al. |
| 6,958,211 B2 | 10/2005 | Vingerhoets et al. |
| 6,964,847 B1 | 11/2005 | Englert |
| 7,035,739 B2 | 4/2006 | Schadt et al. |
| 7,058,517 B1 | 6/2006 | Denton et al. |
| 7,058,616 B1 | 6/2006 | Larder et al. |
| 7,218,764 B2 | 5/2007 | Vaisberg et al. |
| 7,297,485 B2 | 11/2007 | Bornarth et al. |
| 7,332,277 B2 | 2/2008 | Dhallan |
| 7,414,118 B1 | 8/2008 | Mullah et al. |
| 7,442,506 B2 | 12/2008 | Dhallan |
| 7,459,273 B2 | 12/2008 | Jones et al. |
| 7,645,576 B2 | 1/2010 | Lo et al. |

(Continued)

FOREIGN PATENT DOCUMENTS

| | | |
|---|---|---|
| CN | 1650032 A | 8/2005 |
| CN | 1674028 A | 9/2005 |

(Continued)

OTHER PUBLICATIONS

Nguyen-Dumont et al. (Biotechniques, 2013, 55:69-74) (Year: 2013).*
Lui et al. (Clin Chem, 2002, vol. 48, No. 3, p. 421-427) (Year: 2002).*
"Blast of AAAAAAAAATTTAAAAAAAAATTT(http://blast.ncbi.nlm.nih.gov/Blast.cgi, downloaded May 4, 2015)".
"CompetitivePCR Guide,", TaKaRa Biomedicals, Lit. # L0126 Rev. Aug. 1999, 9 pgs.
"Db SNP rs2056688 (http://www.ncbi.nlm.nih.gov/projects/SNP/snp_ref.cgi?rs=2056688, downloaded May 4, 2015".
"Declaration by Dr. Zimmerman of Oct. 30, 2014 filed in U.S. Appl. No. 14/044,434".

(Continued)

*Primary Examiner* — Stephanie K Mummert

(57) ABSTRACT

The invention provides methods for simultaneously amplifying multiple nucleic acid regions of interest in one reaction volume as well as methods for selecting a library of primers for use in such amplification methods. The invention also provides library of primers with desirable characteristics, such as minimal formation of amplified primer dimers or other non-target amplicons.

20 Claims, 290 Drawing Sheets

Specification includes a Sequence Listing.

(56) References Cited

U.S. PATENT DOCUMENTS

| | | |
|---|---|---|
| 7,700,325 B2 | 5/2010 | Cantor et al. |
| 7,718,367 B2 | 5/2010 | Lo et al. |
| 7,718,370 B2 | 6/2010 | Dhallan |
| 7,727,720 B2 | 6/2010 | Dhallan |
| 7,805,282 B2 | 11/2010 | Casey |
| 7,838,647 B2 | 11/2010 | Hahn et al. |
| 7,888,017 B2 | 8/2011 | Quake |
| 8,008,018 B2 | 9/2011 | Quake et al. |
| 8,024,128 B2 | 9/2011 | Rabinowitz |
| 8,133,719 B2 | 3/2012 | Drmanac et al. |
| 8,137,912 B2 | 5/2012 | Kapur et al. |
| 8,173,370 B2 | 5/2012 | Oeth et al. |
| 8,168,389 B2 | 6/2012 | Shoemaker et al. |
| 8,195,415 B2 | 10/2012 | Fan et al. |
| 8,296,076 B2 | 11/2012 | Fan et al. |
| 8,304,187 B2 | 11/2012 | Fernando |
| 8,318,430 B2 | 11/2012 | Chuu et al. |
| 8,450,063 B2 | 5/2013 | Dube et al. |
| 8,467,976 B2 | 8/2013 | Lo et al. |
| 8,515,679 B2 | 9/2013 | Rabinowitz et al. |
| 8,532,930 B2 | 9/2013 | Rabinowitz et al. |
| 8,682,592 B2 | 3/2014 | Rabinowitz et al. |
| 8,825,412 B2 | 9/2014 | Rabinowitz et al. |
| 9,085,798 B2 | 7/2015 | Chee |
| 9,323,888 B2 | 4/2016 | Rava et al. |
| 9,476,095 B2 | 10/2016 | Vogelstein et al. |
| 9,487,829 B2 | 11/2016 | Vogelstein et al. |
| 9,598,731 B2 | 3/2017 | Talasaz |
| 9,677,118 B2 | 6/2017 | Zimmermann et al. |
| 10,081,839 B2 | 9/2018 | Rabinowitz et al. |
| 10,083,273 B2 | 9/2018 | Rabinowitz et al. |
| 10,308,981 B2 | 6/2019 | Sparks et al. |
| 10,316,362 B2 | 6/2019 | Babiarz et al. |
| 2001/0051341 A1 | 12/2001 | Lo et al. |
| 2001/0053519 A1 | 12/2001 | Fodor et al. |
| 2002/0006622 A1 | 1/2002 | Bradley et al. |
| 2002/0107640 A1 | 8/2002 | Ideker et al. |
| 2003/0009295 A1 | 1/2003 | Markowitz et al. |
| 2003/0065535 A1 | 4/2003 | Karlov et al. |
| 2003/0077586 A1 | 4/2003 | Pavlovic et al. |
| 2003/0101000 A1 | 5/2003 | Bader et al. |
| 2003/0119004 A1 | 6/2003 | Wenz et al. |
| 2003/0228613 A1 | 12/2003 | Bornarth et al. |
| 2004/0033596 A1 | 2/2004 | Threadgill et al. |
| 2004/0137470 A1 | 7/2004 | Dhallan et al. |
| 2004/0146866 A1 | 7/2004 | Fu |
| 2004/0157243 A1 | 8/2004 | Huang et al. |
| 2004/0197797 A1 | 10/2004 | Inoko et al. |
| 2004/0209299 A1 | 10/2004 | Pinter et al. |
| 2004/0229231 A1 | 11/2004 | Frudakis et al. |
| 2004/0236518 A1 | 11/2004 | Pavlovic et al. |
| 2004/0259100 A1 | 12/2004 | Gunderson et al. |
| 2005/0009069 A1 | 1/2005 | Liu et al. |
| 2005/0049793 A1 | 3/2005 | Paterlini-brechot |
| 2005/0053950 A1 | 3/2005 | Ubani et al. |
| 2005/0079535 A1 | 4/2005 | Kirchgesser et al. |
| 2005/0123914 A1 | 6/2005 | Katz et al. |
| 2005/0130173 A1 | 6/2005 | Leamon et al. |
| 2005/0142577 A1 | 6/2005 | Jones et al. |
| 2005/0144664 A1 | 6/2005 | Smith et al. |
| 2005/0164241 A1 | 7/2005 | Hahn et al. |
| 2005/0216207 A1 | 9/2005 | Kermani |
| 2005/0221341 A1 | 10/2005 | Shimkets et al. |
| 2005/0227263 A1 | 10/2005 | Green et al. |
| 2005/0250111 A1 | 11/2005 | Xie et al. |
| 2005/0255508 A1 | 11/2005 | Casey et al. |
| 2005/0272073 A1 | 12/2005 | Vaisberg et al. |
| 2006/0019278 A1 | 1/2006 | Lo et al. |
| 2006/0040300 A1 | 2/2006 | Dapprich et al. |
| 2006/0052945 A1 | 3/2006 | Rabinowitz et al. |
| 2006/0057618 A1 | 3/2006 | Piper et al. |
| 2006/0068394 A1 | 3/2006 | Langmore et al. |
| 2006/0088574 A1 | 4/2006 | Manning et al. |
| 2006/0099614 A1 | 5/2006 | Gill et al. |
| 2006/0121452 A1 | 6/2006 | Dhallan |
| 2006/0134662 A1 | 6/2006 | Pratt et al. |
| 2006/0141499 A1 | 6/2006 | Sher et al. |
| 2006/0229823 A1 | 8/2006 | Liu |
| 2006/0210997 A1 | 9/2006 | Myerson et al. |
| 2006/0216738 A1 | 9/2006 | Wada et al. |
| 2006/0248031 A1 | 11/2006 | Kates et al. |
| 2006/0281105 A1 | 12/2006 | Li et al. |
| 2007/0020640 A1 | 1/2007 | McCloskey et al. |
| 2007/0027636 A1 | 2/2007 | Rabinowitz |
| 2007/0042384 A1 | 2/2007 | Li et al. |
| 2007/0059707 A1 | 3/2007 | Cantor et al. |
| 2007/0122805 A1 | 5/2007 | Cantor et al. |
| 2007/0128624 A1 | 6/2007 | Gormley et al. |
| 2007/0178478 A1 | 8/2007 | Dhallan |
| 2007/0178501 A1 | 8/2007 | Rabinowitz et al. |
| 2007/0184467 A1 | 8/2007 | Rabinowitz et al. |
| 2007/0202525 A1 | 8/2007 | Quake et al. |
| 2007/0202536 A1 | 8/2007 | Yamanishi et al. |
| 2007/0207466 A1 | 9/2007 | Cantor et al. |
| 2007/0212689 A1 | 9/2007 | Bianchi et al. |
| 2007/0243549 A1 | 10/2007 | Bischoff |
| 2007/0259351 A1 | 11/2007 | Chinitz |
| 2008/0020390 A1 | 1/2008 | Mitchell |
| 2008/0026390 A1 | 1/2008 | Stoughton et al. |
| 2008/0038733 A1 | 2/2008 | Bischoff et al. |
| 2008/0070792 A1 | 3/2008 | Stoughton |
| 2008/0071076 A1 | 3/2008 | Hahn et al. |
| 2008/0085836 A1 | 4/2008 | Kearns et al. |
| 2008/0090239 A1 | 4/2008 | Shoemaker et al. |
| 2008/0096766 A1 | 4/2008 | Lee |
| 2008/0102455 A1 | 5/2008 | Poetter |
| 2008/0138809 A1 | 6/2008 | Kapur et al. |
| 2008/0182244 A1 | 7/2008 | Tafas et al. |
| 2008/0193927 A1 | 8/2008 | Mann et al. |
| 2008/0220422 A1 | 9/2008 | Shoemaker et al. |
| 2008/0234142 A1 | 9/2008 | Lietz |
| 2008/0243398 A1 | 10/2008 | Rabinowitz et al. |
| 2008/0305473 A1 | 12/2008 | Chowdary et al. |
| 2009/0023190 A1 | 1/2009 | Lao et al. |
| 2009/0029377 A1 | 1/2009 | Lo et al. |
| 2009/0087847 A1 | 4/2009 | Lo et al. |
| 2009/0098534 A1 | 4/2009 | Weier et al. |
| 2009/0099041 A1 | 4/2009 | Church et al. |
| 2009/0143570 A1 | 6/2009 | Jiang et al. |
| 2009/0176662 A1 | 7/2009 | Rigatti et al. |
| 2009/0221620 A1 | 9/2009 | Luke et al. |
| 2009/0317817 A1 | 12/2009 | Oeth et al. |
| 2010/0035232 A1 | 2/2010 | Ecker et al. |
| 2010/0112575 A1 | 5/2010 | Fan et al. |
| 2010/0112590 A1 | 5/2010 | Lo et al. |
| 2010/0120038 A1 | 5/2010 | Mir et al. |
| 2010/0124751 A1 | 5/2010 | Quake et al. |
| 2010/0129874 A1 | 5/2010 | Mitra et al. |
| 2010/0138165 A1 | 6/2010 | Fan et al. |
| 2010/0171954 A1 | 7/2010 | Quake et al. |
| 2010/0184069 A1 | 7/2010 | Fernando et al. |
| 2010/0184152 A1 | 7/2010 | Sandler |
| 2010/0196892 A1 | 8/2010 | Quake et al. |
| 2010/0203538 A1 | 8/2010 | Dube et al. |
| 2010/0216153 A1 | 8/2010 | Lapidus et al. |
| 2010/0248231 A1 | 9/2010 | Wei et al. |
| 2010/0255492 A1 | 10/2010 | Quake et al. |
| 2010/0256013 A1 | 10/2010 | Quake et al. |
| 2010/0273678 A1 | 10/2010 | Alexandre et al. |
| 2010/0285537 A1 | 11/2010 | Zimmermann |
| 2010/0291572 A1 | 11/2010 | Stoughton et al. |
| 2010/0291635 A1 | 11/2010 | Peleg |
| 2010/0323352 A1 | 12/2010 | Lo et al. |
| 2011/0033862 A1 | 2/2011 | Rabinowitz et al. |
| 2011/0039724 A1 | 2/2011 | Lo et al. |
| 2011/0071031 A1 | 3/2011 | Khripin et al. |
| 2011/0086769 A1 | 4/2011 | Oliphant et al. |
| 2011/0092763 A1 | 4/2011 | Rabinowitz et al. |
| 2011/0105353 A1 | 5/2011 | Lo et al. |
| 2011/0151442 A1 | 6/2011 | Fan et al. |
| 2011/0159499 A1 | 6/2011 | Hindson et al. |
| 2011/0160078 A1 | 6/2011 | Fodor et al. |
| 2011/0178719 A1 | 7/2011 | Rabinowitz et al. |
| 2011/0201507 A1 | 8/2011 | Rava et al. |

(56) References Cited

U.S. PATENT DOCUMENTS

| | | |
|---|---|---|
| 2011/0224087 A1 | 9/2011 | Quake et al. |
| 2011/0246083 A1 | 10/2011 | Fan et al. |
| 2011/0251149 A1 | 10/2011 | Perrine et al. |
| 2011/0288780 A1 | 11/2011 | Rabinowitz et al. |
| 2011/0300608 A1 | 12/2011 | Ryan et al. |
| 2011/0301854 A1 | 12/2011 | Curry et al. |
| 2011/0318734 A1 | 12/2011 | Lo et al. |
| 2012/0003635 A1 | 1/2012 | Lo et al. |
| 2012/0010085 A1 | 1/2012 | Rava et al. |
| 2012/0034603 A1 | 2/2012 | Oliphant et al. |
| 2012/0034685 A1 | 2/2012 | Sparks et al. |
| 2012/0108460 A1 | 5/2012 | Quake et al. |
| 2012/0122701 A1 | 5/2012 | Ryan et al. |
| 2012/0165203 A1 | 6/2012 | Quake et al. |
| 2012/0185176 A1 | 7/2012 | Rabinowitz et al. |
| 2012/0190020 A1 | 7/2012 | Oliphant et al. |
| 2012/0190021 A1 | 7/2012 | Oliphant et al. |
| 2012/0191358 A1 | 7/2012 | Oliphant et al. |
| 2012/0196754 A1 | 8/2012 | Quake et al. |
| 2012/0214678 A1 | 8/2012 | Rava et al. |
| 2012/0264121 A1 | 10/2012 | Rava et al. |
| 2012/0270212 A1 | 10/2012 | Rabinowitz et al. |
| 2012/0295810 A1 | 11/2012 | Quake et al. |
| 2012/0295819 A1 | 11/2012 | Leamon et al. |
| 2013/0017549 A1 | 1/2013 | Hong |
| 2013/0024127 A1 | 1/2013 | Stuelpnagel |
| 2013/0034546 A1 | 2/2013 | Rava et al. |
| 2013/0060483 A1 | 3/2013 | Struble et al. |
| 2013/0069869 A1 | 3/2013 | Akao et al. |
| 2013/0090250 A1 | 4/2013 | Sparks et al. |
| 2013/0116130 A1 | 5/2013 | Fu et al. |
| 2013/0123120 A1 | 5/2013 | Zimmermann et al. |
| 2013/0130923 A1 | 5/2013 | Ehrich et al. |
| 2013/0178373 A1 | 7/2013 | Rabinowitz et al. |
| 2013/0190653 A1 | 7/2013 | Alvarez Ramos |
| 2013/0196862 A1 | 8/2013 | Rabinowitz et al. |
| 2013/0210644 A1 | 8/2013 | Stoughton et al. |
| 2013/0225422 A1 | 8/2013 | Rabinowitz et al. |
| 2013/0252824 A1 | 9/2013 | Rabinowitz |
| 2013/0253369 A1 | 9/2013 | Rabinowitz et al. |
| 2013/0261004 A1 | 10/2013 | Ryan et al. |
| 2013/0274116 A1 | 10/2013 | Rabinowitz et al. |
| 2013/0303461 A1 | 11/2013 | Iafrate et al. |
| 2013/0323731 A1 | 12/2013 | Lo et al. |
| 2013/0325360 A1 | 12/2013 | Deciu et al. |
| 2014/0032128 A1 | 1/2014 | Rabinowitz et al. |
| 2014/0038830 A1 | 2/2014 | Srinivasan et al. |
| 2014/0051585 A1 | 2/2014 | Prosen et al. |
| 2014/0065621 A1 | 3/2014 | Mhatre et al. |
| 2014/0087385 A1 | 3/2014 | Rabinowitz et al. |
| 2014/0094373 A1 | 4/2014 | Zimmermann et al. |
| 2014/0100126 A1 | 4/2014 | Rabinowitz |
| 2014/0100134 A1 | 4/2014 | Rabinowitz et al. |
| 2014/0141981 A1 | 5/2014 | Zimmermann et al. |
| 2014/0154682 A1 | 6/2014 | Rabinowitz et al. |
| 2014/0155274 A1 | 6/2014 | Xie et al. |
| 2014/0162269 A1 | 6/2014 | Rabinowitz |
| 2014/0193816 A1 | 7/2014 | Rabinowitz et al. |
| 2014/0206552 A1 | 7/2014 | Rabinowitz et al. |
| 2014/0227705 A1 | 8/2014 | Vogelstein et al. |
| 2014/0256558 A1 | 9/2014 | Varley et al. |
| 2014/0256569 A1 | 9/2014 | Rabinowitz et al. |
| 2014/0272956 A1 | 9/2014 | Huang et al. |
| 2014/0287934 A1 | 9/2014 | Szelinger et al. |
| 2014/0329245 A1* | 11/2014 | Spier ............ C12Q 1/686 435/6.12 |
| 2014/0336060 A1 | 11/2014 | Rabinowitz |
| 2015/0051087 A1 | 2/2015 | Rabinowitz et al. |
| 2015/0064695 A1 | 3/2015 | Katz et al. |
| 2015/0147815 A1 | 5/2015 | Babiarz et al. |
| 2015/0197786 A1 | 7/2015 | Osborne et al. |
| 2015/0232938 A1 | 8/2015 | Mhatre |
| 2015/0265995 A1 | 9/2015 | Head et al. |
| 2016/0145682 A1 | 5/2016 | Woodward et al. |
| 2016/0201124 A1 | 7/2016 | Donahue et al. |
| 2016/0257993 A1 | 9/2016 | Fu et al. |
| 2016/0289740 A1 | 10/2016 | Fu et al. |
| 2016/0289753 A1 | 10/2016 | Osborne et al. |
| 2016/0312276 A1 | 10/2016 | Fu et al. |
| 2016/0319345 A1 | 11/2016 | Gnerre et al. |
| 2016/0369333 A1 | 12/2016 | Babiarz et al. |
| 2017/0121716 A1 | 5/2017 | Rodi et al. |
| 2017/0342477 A1 | 11/2017 | Jensen et al. |
| 2018/0148777 A1 | 5/2018 | Kirkizlar et al. |
| 2018/0155775 A1 | 6/2018 | Zimmermann et al. |
| 2018/0155776 A1 | 6/2018 | Zimmermann et al. |
| 2018/0155779 A1 | 6/2018 | Zimmermann et al. |
| 2018/0155785 A1 | 6/2018 | Rabinowitz et al. |
| 2018/0155786 A1 | 6/2018 | Rabinowitz et al. |
| 2018/0155792 A1 | 6/2018 | Rabinowitz et al. |
| 2018/0171409 A1 | 6/2018 | Rabinowitz et al. |
| 2018/0171420 A1 | 6/2018 | Babiarz et al. |
| 2018/0173845 A1 | 6/2018 | Sigurjonsson et al. |
| 2018/0173846 A1 | 6/2018 | Sigurjonsson et al. |
| 2018/0201995 A1 | 7/2018 | Rabinowitz et al. |
| 2018/0237841 A1 | 8/2018 | Stray et al. |
| 2018/0298439 A1 | 10/2018 | Ryan et al. |
| 2018/0300448 A1 | 10/2018 | Rabinowitz et al. |
| 2019/0010543 A1 | 1/2019 | Babiarz et al. |
| 2019/0106737 A1 | 4/2019 | Underhill |
| 2019/0106751 A1 | 4/2019 | Zimmermann et al. |
| 2019/0185913 A1 | 6/2019 | Zimmermann et al. |
| 2019/0185936 A1 | 6/2019 | Babiarz et al. |
| 2019/0194743 A1 | 6/2019 | Ryan et al. |
| 2019/0194758 A1 | 6/2019 | Babiarz et al. |
| 2019/0194759 A1 | 6/2019 | Babiarz et al. |
| 2019/0203290 A1 | 7/2019 | Rabinowitz et al. |
| 2019/0203294 A1 | 7/2019 | Babiarz et al. |
| 2019/0211391 A1 | 7/2019 | Rabinowitz et al. |
| 2019/0211392 A1 | 7/2019 | Rabinowitz et al. |
| 2019/0211393 A1 | 7/2019 | Rabinowitz et al. |
| 2019/0211399 A1 | 7/2019 | Rabinowitz et al. |
| 2019/0211402 A1 | 7/2019 | Babiarz et al. |
| 2019/0211406 A1 | 7/2019 | Babiarz et al. |
| 2019/0249241 A1 | 8/2019 | Rabinowitz et al. |
| 2019/0256906 A1 | 8/2019 | Rabinowitz et al. |
| 2019/0256907 A1 | 8/2019 | Ryan et al. |
| 2019/0256909 A1 | 8/2019 | Rabinowitz et al. |
| 2019/0256916 A1 | 8/2019 | Babiarz et al. |
| 2019/0256917 A1 | 8/2019 | Babiarz et al. |
| 2019/0264277 A1 | 8/2019 | Rabinowitz et al. |
| 2019/0264280 A1 | 8/2019 | Rabinowitz et al. |
| 2019/0264288 A1 | 8/2019 | Rabinowitz et al. |
| 2019/0271043 A1 | 9/2019 | Babiarz et al. |
| 2019/0276888 A1 | 9/2019 | Rabinowitz et al. |
| 2019/0284623 A1 | 9/2019 | Rabinowitz et al. |
| 2019/0300950 A1 | 10/2019 | Rabinowitz et al. |

FOREIGN PATENT DOCUMENTS

| | | |
|---|---|---|
| CN | 101675169 A | 3/2010 |
| EP | 0270017 A2 | 6/1988 |
| EP | 1524321 A1 | 4/2005 |
| EP | 1524321 B1 | 7/2009 |
| EP | 2163622 A1 | 3/2010 |
| EP | 2128169 A1 | 12/2010 |
| EP | 2902500 A1 | 8/2015 |
| EP | 3285193 A1 | 2/2018 |
| GB | 2488358 | 8/2012 |
| JP | 2965699 | 8/1999 |
| JP | 2002-530121 A | 9/2002 |
| JP | 2004502466 A | 1/2004 |
| JP | 2004533243 A | 11/2004 |
| JP | 2005514956 A | 5/2005 |
| JP | 2005160470 A | 6/2005 |
| JP | 2006-254912 A | 9/2006 |
| JP | 2011/516069 A | 5/2011 |
| RU | 2290078 C1 | 12/2006 |
| WO | 179851 A1 | 10/2001 |
| WO | 200190419 A2 | 11/2001 |
| WO | 2002004672 A2 | 1/2002 |
| WO | 2002055985 A2 | 7/2002 |
| WO | 2002076377 | 10/2002 |
| WO | 2003031646 A1 | 4/2003 |

(56) References Cited

FOREIGN PATENT DOCUMENTS

| | | |
|---|---|---|
| WO | 3050532 A1 | 6/2003 |
| WO | 2003062441 A1 | 7/2003 |
| WO | 0190419 A9 | 11/2003 |
| WO | 3102595 A1 | 12/2003 |
| WO | 3106623 A2 | 12/2003 |
| WO | 2004087863 A2 | 10/2004 |
| WO | 2005021793 A1 | 3/2005 |
| WO | 2005035725 A2 | 4/2005 |
| WO | 2005100401 A2 | 10/2005 |
| WO | 2005123779 A2 | 12/2005 |
| WO | 2007057647 A1 | 5/2007 |
| WO | 2007062164 A3 | 5/2007 |
| WO | 2007070482 A2 | 6/2007 |
| WO | 2007/117256 A1 | 10/2007 |
| WO | 2007132167 A2 | 11/2007 |
| WO | 2007/147076 A2 | 12/2007 |
| WO | 2007147074 A2 | 12/2007 |
| WO | 2008024473 A2 | 2/2008 |
| WO | 2008048931 A1 | 4/2008 |
| WO | 2008051928 A2 | 5/2008 |
| WO | 2008059578 A1 | 5/2008 |
| WO | 2008081451 A2 | 7/2008 |
| WO | 2008115497 A2 | 9/2008 |
| WO | 2008135837 A2 | 11/2008 |
| WO | 2008157264 A2 | 12/2008 |
| WO | 2009009769 A2 | 1/2009 |
| WO | 2009013492 A1 | 1/2009 |
| WO | 2009013496 A1 | 1/2009 |
| WO | 2009019215 A1 | 2/2009 |
| WO | 2009019455 A2 | 2/2009 |
| WO | 2009/032779 A2 | 3/2009 |
| WO | 2009/036525 A2 | 3/2009 |
| WO | 2009030100 A1 | 3/2009 |
| WO | 2009032781 A2 | 3/2009 |
| WO | 2009033178 A1 | 3/2009 |
| WO | 2009091934 A1 | 7/2009 |
| WO | 2009092035 A2 | 7/2009 |
| WO | 2009105531 A1 | 8/2009 |
| WO | 2009146335 A1 | 12/2009 |
| WO | 2010017214 A1 | 2/2010 |
| WO | 2010/033652 A1 | 3/2010 |
| WO | 2010075459 | 7/2010 |
| WO | 2011041485 A1 | 4/2011 |
| WO | 2011/057061 A1 | 5/2011 |
| WO | 2011057094 | 5/2011 |
| WO | 2011/090556 A1 | 7/2011 |
| WO | 2011087760 | 7/2011 |
| WO | 2011146632 A1 | 11/2011 |
| WO | 2012/019200 A2 | 2/2012 |
| WO | 2012/028746 A1 | 3/2012 |
| WO | 201283250 | 6/2012 |
| WO | 2012088456 A2 | 6/2012 |
| WO | 20120071621 | 6/2012 |
| WO | 2012108920 A1 | 8/2012 |
| WO | 2012/142531 A2 | 10/2012 |
| WO | 2007/149791 A2 | 12/2012 |
| WO | 2013030577 | 3/2013 |
| WO | 2013/045432 A1 | 4/2013 |
| WO | 2013/049892 A1 | 4/2013 |
| WO | 2013052557 A2 | 4/2013 |
| WO | 2013/078470 A2 | 5/2013 |
| WO | 2013/086464 A1 | 6/2013 |
| WO | 20130130848 | 9/2013 |
| WO | 2013/159035 A2 | 10/2013 |
| WO | 2013/181651 A1 | 12/2013 |
| WO | 2014/004726 A1 | 1/2014 |
| WO | 2014/014497 A1 | 1/2014 |
| WO | 20140018080 | 1/2014 |
| WO | 2014/035986 A1 | 3/2014 |
| WO | 2014/122288 A1 | 8/2014 |
| WO | 2014/149134 A2 | 9/2014 |
| WO | 2014/151117 A1 | 9/2014 |
| WO | 2015/100427 A1 | 7/2015 |
| WO | 2015/164432 A1 | 10/2015 |
| WO | 2016/009059 A1 | 1/2016 |
| WO | 2016/065295 A1 | 4/2016 |
| WO | 2016/138080 A1 | 9/2016 |
| WO | 2016/193490 A1 | 12/2016 |
| WO | 2017/058784 A1 | 4/2017 |
| WO | 2017/181146 A1 | 10/2017 |
| WO | 2017/181202 A2 | 10/2017 |
| WO | 2018/083467 A1 | 5/2018 |
| WO | 2018/106798 A1 | 6/2018 |
| WO | 2018/156418 A1 | 8/2018 |
| WO | 2019/140298 A1 | 7/2019 |
| WO | 2019/161244 A1 | 8/2019 |

OTHER PUBLICATIONS

"European Application No. 014198110, European Search Report dated Apr. 28, 2015, 3 pages."
"Finishing the Euchromatic Sequence of the Human Genome", Nature vol. 431,(Oct. 21, 2004),931-945.
"FixedMedium, dictionary definition, Academic Press Dictionary of Science andTechnology", Retrieved from the Internet: <URL:www.credoreference.com/entry/apdst/fixed_medium>, 1996, 1 pg.
"GeneticsHome Reference", http://ghr.nlm.nih.gov/handbook/genomicresearch/snp, Feb. 28, 2014, 1-2.
"Ion Ampli Seq Comprehensive Cancer Panel, product brochure, Life TechnologiesCorporation. Retrieved from the Internet", <URL:https://tools.lifetechnologies.com/content/sfs/brochures/Ion_CompCancerPanel_Flyer.pdf>, 2012, 2 pgs.
"IonAmpliSeq Designer Provides Full Flexibility to Sequence Genes of Your Choice,product brochure, Life Technologies Corporation", Retrieved from the Internet<URL: http://tools.lifetechnologies.com/content/sfs/brochures/IonAmpliSeq_CustomPanels_AppNote_C01.
"Merriam-Webster.com (http://www.merriam-webster.com/dictionary/universal, downloaded Jul. 23, 2014)".
"Multiplexing with RainDrop Digital PCR", RainDance Technologies, Application Note, 2013, 1-2.
"NucleicAcids, Linkers and Primers: Random Primers", New England BioLabs 1998/99Catalog, 1998, 121 and 284.
"PRIMER3, information sheet, Sourceforge.net. [retrieved on Nov. 12, 2012]. Retrieved from the Internet: <URL: http://primer3.sourceforge.net/>", 2009, 1 pg.
"www.fatsecret.com" (printed from internet Nov. 1, 2014).
PRNewswire (Research Suggests Daily Consumption of Orange Juice Can Reduce Blood Pressure and May Provide Beneficial Effects to Blood Vessel Function: New Study Identified Health Benefits in Orange Juice, Dec. 8, 2010).
The Bump (Panorama Test, attached, Jul. 1, 2013).
What to Expect (Weird Harmony results, attached, May 1, 2015).
Wikipedia (attached, available at https://en.wikipedia.org/wiki/Stimulant, accessed Mar. 14, 2016).
"Guideline related to genetic examination", Societies Related to Genetic Medicine, Japanese Society for Genetic Counseling, Japanese Society for Gene Diagnosis and Therapy, Japan Society of Obstetrics and Gynecology, 2003, 2-15.
"How Many Carbs in a Potato?, [Online]", Retrieved from the Internet: <http://www.newhealthguide.org/How-Many-Carbs-In-A-Potato.html>, Nov. 1, 2014, 3 pages.
"Random variable", In the Penguin Dictionary of Mathematics. Retrieved from http://www.credoreference.com/entry/penguinmath/random_variable, 2008, 1 page.
Abbosh, C. et al., "Phylogenetic ctDNA analysis depicts early-stage lung cancer evolution", Nature, vol. 545, May 25, 2017, 446-451.
Abidi, S. et al., "Leveraging XML-based electronic medical records to extract experiential clinical knowledge: An automated approach to generate cases for medical case-based reasoning systems", International Journal of Medical Informatics, 68(1-3), 2002, 187-203.
Agarwal, Ashwin. et al., "Commercial Landscape of Noninvasive Prenatal Testing in the United States", Prenatal Diagnosis,33, 2013, 521-531.
Alaeddini, R. et al., "Forensic implications of genetic analyses from degraded DNA—A review", Forensic Science International: Genetics, vol. 4, 2010, 148-157.

(56) References Cited

OTHER PUBLICATIONS

Alberts, B. et al., "Chapter 20: Germ Cells and Fertilization", Molecular Biology of the Cell, Fourth Edition, 2002, 1127-1156.
Alberts, B. et al., "Chapter 4: DNA and Chromosomes", Molecular Biology of the Cell, Fourth Edition, 2002, 191-234.
Alkan, Can et al., "Personalized Copy Number and Segmental Duplication Maps Using Next-Generation Sequencing", Nature Genetics, 41, 10, 2009, 1061-1068.
Allaire, F R. , "Mate selection by selection index theory", Theoretical Applied Genetics, 57(6), 1980, 267-272.
Allawi, Hatim T. et al., "Thermodynamics of internal C•T Mismatches in DNA", Nucleic Acids Research, 26 (11), 1998, 2694-2701.
Anker, P. et al., "Detection of circulating tumour DNA in the blood (plasma/serum) of cancer patients", Cancer and Metastasis Reviews, vol. 18, 1999, 65-73.
Antonarakis, S. E. et al., "Chromosome 21 and Down Syndrome: From Genomics to Pathophysiology", Nature Reviews Genetics, vol. 5, Oct. 2004, 725-738.
Aoki, Yasuhiro , "Statistical and Probabilistic Bases of Forensic DNA Testing", The Journal of the Iwate Medical Association, 2002, vol. 54, p. 81-94.
Ashoor, G. et al., "Fetal fraction in maternal plasma cell-free DNA at 11-13 weeks' gestation: relation to maternal and fetal characteristics", Ultrasound in Obstetrics and Gynecology, vol. 41, 2013, 26-32.
Ashoor, Ghalia et al., "Chromosome-Selective Sequencing of Maternal Plasma Cell-Free DNA for First-Trimester Detection of Trisomy 21 and Trisomy 18", American Journal of Obstetrics & Gynecology, 206, 2012, 322.e1-322.e5.
Ashoor, Ghalia et al., "Fetal Fraction in Maternal Plasma Cell-Free DNA at 11-13 Weeks' Gestation: Effect of Maternal and Fetal Factors", Fetal Diagnosis Therapy, 2012, 1-7.
Bada, Michael A. et al., "Computational Modeling of Structural Experimental Data", Methods in Enzymology,317, 2000, 470-491.
Ballif, B. C. et al., "Detection of Low-Level Mosaicism by Array CGH in Routine Diagnostic Specimens", American Journal of Medical Genetics Part A, vol. 140A, 2006, 2757-2767.
Beaumont, Mark A et al., "The Bayesian Revolution in Genetics", Nature Reviews Genetics, 5, 2004, 251-261.
Beer, Alan E. et al., "The Biological Basis of Passage of Fetal Cellular Material into the Maternal Circulation", Annals New York Academy of Sciences, 731, 1994, 21-35.
Beerenwinkel, et al., "Methods for Optimizing Antiviral Combination Therapies", Bioinformatics, 19(1), 2003, i16-i25.
Beerenwinkel, N. et al., "Geno2pheno: estimating phenotypic drug resistance from HIV-1 genotypes", Nucleic Acids Research, 31(13), 2003, 3850-3855.
Benn, P. et al., "Non-Invasive Prenatal Testing for Aneuploidy: Current Status and Future Prospects", Ultrasound Obstet Gynecol, 42, 2013, 15-33.
Benn, P et al., "Non-Invasive prenatal Diagnosis for Down Syndrome: the Paradigm Will Shift, but Slowly", Ultrasound Obstet. Gynecol., 39, 2012, 127-130.
Bentley, David R et al., "Accurate Whole Human Genome Sequencing Using Reversible Terminator Chemistry", Nature, 456, 6, 2008, 53-59.
Bermudez, M. et al., "Single-cell sequencing and mini-sequencing for preimplantation genetic diagnosis", Prenatal Diagnosis, 23, 2003, 669-677.
Beroud, C. et al., "Prenatal diagnosis of spinal muscular atrophy by genetic analysis of circulating fetal cells", The Lancet, vol. 361, Mar. 22, 2003, 1013-1014.
Bevinetto, Gina , Bevinetto (5 Foods All Pregnant Women Need, American Baby, available at http://www.parents.com/pregnancy/mybody/nutrition/5greatpregnancyfoods/, Apr. 15, 2008).
Bianchi, D W. et al., "Fetal gender and aneuploidy detection using fetal cells maternal blood: analysis of NIFTY I data", Prenat Diagn 2002; 22, 2002, 609-615.

Bianchi, D. W. , "Circulating Fetal DNA: Its Origin and Diagnostic Potential—A Review", Placenta, vol. 25, Supplemental A, May 2004, S93-S101.
Bianchi, D. W. et al., "Genome-Wide Fetal Aneuploidy Detection by Maternal Plasma DNA Sequencing", Obstetrics & Gynecology, vol. 119, No. 5, May 2012, 890-901.
Bianchi, D. W. , "Review: Fetal Cells in the Maternal Circulation: Feasibility for Prenatal Diagnosis", British Journal of Haematology, vol. 105, 1999, 574-583.
Birch, Lyndsey et al., "Accurate and Robust Quantification of Circulating Fetal and Total DNA in Maternal Plasma from 5 to 41 Weeks of Gestation", Clinical Chemistry, 51(2), 2005, 312-320.
Birkenkamp-Demtroder, K. et al., "Abstract 3653: Sequencing of plasma cfDNA from patients with locally advanced bladder cancer for surveillance and therapeutic efficacy monitoring", Cancer Research, vol. 78, No. 13 Supplement, Jul. 2019, 1 page.
Bisignano, et al., "PGD and Aneuploidy Screening for 24 Chromosomes: Advantages and Disadvantages of Competing Platforms", Reproductive BioMedicine Online, 23, 2011, 677-685.
Bodenreider, O. , "The Unified Medical Language System (UMLS): Integrating Biomedical Terminology", Nucleic Acids Research, 32, (Database issue), 2004, D267-D270.
Breithaupt, Holger , "The Future of Medicine", EMBO Reports, 21(61), 2001, 465-467.
Brownie, Jannine et al., "The Elimination of Primer-Dimer Accumulation in PCR", Nucleic Acids Research, 25(16), 1997, 3235-3241.
Burnham, P. et al., "Myriad Applications of Circulating Cell-Free DNA in Precision Organ Transplant Monitoring", Annals of the American Thoracic Society, vol. 14, Supplement 3, Sep. 2017, S237-S241.
Butler, J. et al., "The Development of Reduced Size STR Amplicons as Tools for Analysis of Degraded DNA*", Journal of Forensic Sciences, vol. 48, No. 5, 2003, 1054-1064.
Butt, A. N. et al., "Overview of Circulating Nucleic Acids in Plasma/Serum: Update on Potential Prognostic and Diagnostic Value in Diseases Excluding Fetal Medicine and Oncology", Ann. N.Y. Acad. Sci., vol. 1137, 2008, 236-242.
Cairns, Paul et al., "Homozygous Deletions of 9p21 in Primary Human Bladder Tumors Detected by Comparative Multiplex Polymerase Chain Reaction", Cancer Research, 54, 1994, 1422-1424.
Caliendo, Angela , "Multiplex PCR and Emerging Technologies for the Detection of Respiratory Pathogens", Clinical Infectious Diseases, 52(4), 2011, S326-S330.
Cansar, , "Hs-578-T—Copy Number Variation—Cell Line Synopsis", ICR Cancer Research UK, Retrieved on Mar. 26, 2018 from https://cansar.icr.ac.uk/cansar/cell-lines/Hs-578-T/copy_number_variation/chromosome_8/, Mar. 26, 2018, 50 pgs.
Carnevale, Alessandra et al., "Attitudes of Mexican Geneticists Towards Prenatal Diagnosis and Selective Abortion", American Journal of Medical Genetics, 75, 1998, 426-431.
Carvalho, B. et al., "Exploration, normalization, and genotype calls of high-density oligonucleotide SNP array data", Biostatistics, vol. 8, No. 2, 2007, 485-499.
Casbon, J. A. et al., "A method for counting PCR template molecules with application to next-generation sequencing", Nucleic Acids Research, vol. 39, No. 12, Apr. 13, 2011, 1-8.
Chakraborty, R. et al., "Paternity Exclusion by DNA Markers: Effects of Paternal Mutations", Journal of Forensic Sciences, vol. 41, No. 4, Jul. 1996, 671-677.
Chan, K.C. et al., "Size Distributions of Maternal and Fetal DNA in Maternal Plasma", Clinical Chemistry, vol. 50, No. 1, 2004, 88-92.
Chang, H.W. et al., "Assessment of Plasma DNA Levels, Allelic Imbalance, and CA 125 as Diagnostic Tests for Cancer", Journal of the National Cancer Institute, vol. 94, No. 22, Nov. 20, 2002, 1697-1703.
Chen, E. et al., "Noninvasive Prenatal Diagnosis of Fetal Trisomy 18 and Trisomy 13 by Maternal Plasma DNA Sequencing", PLoS One, 6 (7), e21791, 2011, 7 pgs.
Chen, X. Q. et al., "Microsatallite alterations in plasma DNA of small cell lung cancer patients", Nature Medicine, vol. 2, No. 9, Sep. 1996, 1033-1035.

(56) References Cited

OTHER PUBLICATIONS

Chetty, Shilpa et al., "Uptake of Noninvasive Prenatal Testing (NIPT) in Women Following Positive Aneuploidy Screening", Prenatal Diagnosis,33, 2013, 542-546.
Cheung, S. W. et al., "Rapid Publication: Microarray-Based CGH Detects Chromosomal Mosaicism Not Revealed by Conventional Cytogenetics", American Journal of Medical Genetics Part A, vol. 143A, 2007, 1679-1686.
Chiu, R. et al., "Non-Invasive Prenatal Assessment of Trisomy 21 by Multiplexed Maternal Plasma DNA Sequencing: Large Scale Validity Study", BMJ, 342, c7401, 2011, 9 pgs.
Chiu, Rossa W. et al., "Effects of Blood-Processing Protocols on Fetal and Total DNA Quantification in Maternal Plasma", Clinical Chemistry, 47(9), 2001, 1607-1613.
Chiu, Rossa W.K. et al., "Maternal Plasma DNA Analysis with Massively Parallel Sequencing by Litigation for Noninvasive Prenatal Diagnosis of Trisomy 21", Clinical Chemistry, 56, 3, 2010, 459-463.
Chiu, Rossa W.K. et al., "Non-Invasive Prenatal Diagnosis by Single Molecule Counting Technologies", Trends in Genetics, 25 (7), 2009, 324-331.
Chiu, Rossa W.K. et al., "Noninvasive Prenatal Diagnosis of Fetal Chromosomal Aneuploidy by Massively Parallel Genomic Sequencing of DNA in Maternal Plasma (with Supporting Information)", PNAS, vol. 105, No. 51, 2008, 20458-20463.
Choi, M. et al., "Genetic diagnosis by whole exome capture and massively parallel DNA sequencing", PNAS, vol. 106, No. 45, Nov. 10, 2009, 19096-19101.
Chu, T. et al., "Statistical Considerations for Digital Approaches to Non-Invasive Fetal Genotyping", Bioinformatics (Advance Access publication), 26 (22), 2010, 2863-2866.
Chu, Tianjiao et al., "Statistical Model for Whole Genome Sequencing and its Application to Minimally Invasive Diagnosis of Fetal Genetic Disease", Bioinformatics, 25(10), 2009, 1244-1250.
Chu, Tianjiao. et al., "A Novel Approach Toward the Challenge of Accurately Quantifying Fetal DNA in Maternal Plasma", Prenatal Diagnosis,30, 2010, 1226-1229.
Cole, Neal W. et al., "Hyperglycemia-Induced Membrane Lipid Peroxidation and Elevated Homocysteine Levels Are Poorly Attenuated by Exogenous Folate in Embryonic Chick Brains", Comparative Biochemistry and Physiology, Part B, 150, 2008, 338-343.
Colella, S. et al., "QuantiSNP: an Objectives Bayes Hidden-Markov Model to Detect and Accurately Map Copy Number Variation Using SNP Genotyping Data", Nucleic Acids Research, 35 (6), 2007, 2013-2025.
Conlin, L. K. et al., "Mechanisms of mosaicism, chimerism and uniparental disomy identified by single nucleotide polymorphism array analysis", Human Molecular Genetics, vol. 19, No. 7, Jan. 6, 2010, 1263-1275.
Coombes, R. C., "Abstract P4-01-02: Early detection of residual breast cancer through a robust, scalable and personalized analysis of circulating tumour DNA (ctDNA) antedates overt metastatic recurrence", Cancer Research, vol. 79, No. 4 Supplement, Feb. 15, 2019.
Cossu, Gianfranco et al., "Rh D/d Genotyping by Quantitative Polymerase Chain Reaction and Capillary Zone Electrophoresis", Electrophoresis, 17, 1996, 1911-1915.
Coyle, J. F. et al., "Standards for detailed clinical models as the basis for medical data exchange and decision support", International Journal of Medical Informatics, 69(2-3), 2003, 157-174.
Craig, D. W. et al., "Identification of genetic variants using barcoded multiplexed sequencing", Nature Methods, vol. 5, Oct. 2008, 887-893.
Cross, Jillian et al., "Resolution of trisomic mosaicism in prenatal diagnosis: estimated performance of a 50K SNP microarray", Prenat Diagn 2007; 27, 2007, 1197-1204.
D'Aquila, Richard et al., "Maximizing sensitivity and specificity of PCR by pre-amplification heating", Nucleic Acids Research, 19(13), 1991, p. 3749.

Daruwala, Raoul-Sam et al., "A Versatile Statistical Analysis Algorithm to Detect Genome Copy Number Variation", PNAS, 101(46), 2004, 16292-16297.
De Bruin, E. et al., "Spatial and temporal diversity in genomic instability processes defines lung cancer evolution", Science, vol. 346, No. 6206, Oct. 10, 2014, 251-256.
De Vries, et al., "Diagnostic genome profiling in mental retardation", Am J Hum Genet, 77, published online Aug. 30, 2005, 2005, 606-616.
Deangelis, M. et al., "Solid-phase Reversible Immobilization for the Isolation of PCR Products", Nucleic Acids Research, 23 (22), 1995, 4742-4743.
Deng, S. et al., "TNER: A Novel Background Error Suppression Method for Mutation Detection in Circulating Tumor DNA", bioRxiv, http://dx.doi.org/10.1101/214379, Nov. 5, 2017, 12 pgs.
Deutsch, S. et al., "Detection of aneuploidies by paralogous sequence quantification", J Med Genet, vol. 41, 2004, 908-915.
Devaney, S. et al., "Noninvasive Fetal Sex Determination Using Cell-Free Fetal DNA: A Systematic Review and Meta-analysis", JAMA, 306 (6), 2011, 627-636.
Dhallan, et al., "Methods to Increase the Percentage of Free Fetal DNA Recovered from the Maternal Circulation", JAMA, 291(9), 2004, 1114-1119.
Dhallan, Ravinder et al., "A non-invasive test for prenatal diagnosis based on fetal DNA present in maternal blood: a preliminary study", The Lancet, 369, 2007, 474-481.
Dieffenbach, C W. et al., "General concepts for PCR primer design", Genome Research. PCR methods and Applications vol. 3, 1993, S30-S37.
Dietmaier, W. et al., "Multiple Mutation Analyses in Single Tumor Cells with Improved Whole Genome Amplification", American Journal of Pathology, vol. 154, No. 1, Jan 1999, 83-95.
Ding, C et al., "Direct molecular haplotyping of long-range genomic DNA with M1-PCR", PNAS 100(13), 2003, 7449-7453.
Dodge, Y., "Bayes' Theorem", The Concise Encyclopedia of Statistics, 2008, 30-31.
Dohm, J. et al., "Substantial Biases in Ultra-Short Read Data Sets From High-Throughput DNA Sequencing", Nucleic Acids Research, 36 (16), e105, 2008, 10 pgs.
Dolganov, Gregory et al., "A Novel Method of Gene Transcript Profiling in Airway Biopsy Homogenates Reveals Increased Expression of a Na-K+-Cl-Cotransporter (NKCC1) in Asthmatic Subjects", Genome Res.,11, 2001, 1473-1483.
Donaghue, C. et al., "Detection of mosaicism for primary trisomies in prenatal samples by QF-PCR and karyotype analysis", Prenatal Diagnosis, vol. 25, 2005, 65-72.
Donohoe, Gerard G et al., "Rapid Single-Tube Screening of the C282Y Hemochromatosis Mutation by Real-Time Multiplex Allele-specific PCR without Fluorescent Probes", Clinical Chemistry, 46, 10, 2000, 1540-1547.
Donoso, P. et al., "Current Value of Preimplantation Genetic Aneuploidy Screening in IVF", Human Reproduction Update, 13(1), 2007, 15-25.
Echeverri, et al., "Caffeine's Vascular Mechanisms of Action", International Journal of Vascular Medicine vol. 2010(2010), 10 pages, Aug. 25, 2010.
Ehrich, Mathias et al., "Noninvasive Detection of Fetal Trisomy 21 by Sequencing of DNA in Maternal Blood: A Study in a Clinical Setting", American Journal of Obstetrics & Gynecology, 204, 2011, 205.e1-205.e11.
Eichler, H, "Mild Course of Fetal Rh D Haemolytic Disease due to Maternal Alloimmunisation to Paternal HLA Class I and II Antigens", Vox Sang, 68, 1995, 243-247.
Ellison, Aaron M., "Bayesian Inference in Ecology", Ecology Letters, vol. 7, 2004, 509-520.
Ellonen, P. et al., "Development of SNP Microarray for Supplementary Paternity Testing", International Congress Series,1261, 2004, 12-14.
EP06838311.6, , "European Communication and Extended European Search Report", dated Dec. 30, 2008, 8 pgs.
EP08742125.1, , "European Communication pursuant to Article 94(3) EPC and Examination Report", dated Feb. 12, 2010, 5 pgs.
Everitt, B. S., "Medical Statistics From A to Z", 2003, 3 pages.

(56) References Cited

OTHER PUBLICATIONS

Fan, et al., "Whole-genome molecular haplotyping of single cells", Nature Biotechnology, vol. 29, No. 1, Jan. 1, 2011, 51-57.
Fan, Christina H. et al., "Non-Invasive Prenatal Measurement of the Fetal Genome", Nature, doi:10.1038/nature11251, 2012, 26 pgs.
Fan, Christina H et al., "Noninvasive Diagnosis of Fetal Aneuploidy by Shotgun Sequencing DNA from Maternal Blood", PNAS, 105, 42, 2008, 16266-16271.
Fan, H. C. et al., "Microfluidic digital PCR enables rapid prenatal diagnosis of fetal aneuploidy", American Journal of Obstetrics & Gynecology, vol. 200, May 2009, 543.e1-543.e7.
Fan, H. Christina et al., "Sensitivity of Noninvasive Prenatal Detection of Fetal Aneuploidy from Maternal Plasma Using Shotgun Sequencing Is Limited Only by Counting Statistics", PLoS One, vol. 5, Issue 5 (e10439), May 3, 2010, 1-6.
Fan, Jian-Bing et al., "Highly Parallel Genomic Assay", Nature Reviews, 7, 2006, 632-644.
Fazio, Gennaro. et al., "Identification of RAPD Markers Linked to Fusarium Crown and Root Rot Resistance (Frl) in Tomato", Euphytica 105, 1999, 205-210.
Fiorentino, F. et al., "Development and Clinical Application of a Strategy for Preimplantation Genetic Diagnosis of Single Gene Disorders Combined with HLA Matching", Molecular Human Reproduction (Advance Access publication), 10 (6), 2004, 445-460.
Fiorentino, F et al., "Strategies and Clinical Outcome of 250 Cycles of Preimplantation Genetic Diagnosis for Single Gene Disorders", Human Reproduction, 21, 3, 2006, 670-684.
Fiorentino, Francesco et al., "Short Tandem Repeats Haplotyping of the HLA Region in Preimplantation HLA Matching", European Journal of Human Genetics, 13, 2005, 953-958.
Ford, E. et al., "A method for generating highly multiplexed ChIP-seq libraries", BMC Research Notes, vol. 7, No. 312, May 22, 2014, 1-5.
Forejt, et al., "Segmental trisomy of mouse chromosome 17: introducing an alternative model of Down's syndrome", Genomics, 4(6), 2003, 647-652.
Forshew, et al., "Noninvasive Identification and Monitoring of Cancer Mutations by Targeted Deep Sequencing of Plasma DNA", Noninvasive identification and monitoring of cancer mutations by targeted deep sequencing of plasma DNA. Sci. Transl. Med. 4, 136 30 (2012)., 1-12.
Forshew, T. et al., "Supplementary Materials for Noninvasive Identification and Monitoring of Cancer Mutations by Targeted Deep Sequencing of Plasma DNA", Sci. Transl. Med, vol. 4, May 30, 2012, 20 pgs.
Fredriksson, et al., "Multiplex amplification of all coding sequences within 10 cancer genes by Gene-Collector", Nucleic Acids Research, 2007, vol. 35, No. 7 e47, 1-6.
Freeman, Jennifer L. et al., "Copy Number Variation: New Insights in Genome Diversity", Genome Research, 16, 2006, 949-961.
Frost, Mackenzie S et al., "Differential Effects of Chronic Pulsatile Versus Chronic Constant Maternal Hyperglycemia on Fetal Pancreatic B-Cells", Journal of Pregnancy, 2012,, Article ID 812094, 2012, 8.
Fu, G. K. et al., "Counting individual DNA molecules by the stochastic attachment of diverse labels", PNAS, vol. 108, No. 22, May 31, 2011, 9026-9031.
Fu, G. K. et al., "Digital Encoding of Cellular mRNAs Enabling Precise and Absolute Gene Expression Measurement by Single-Molecule Counting", Analytical Chemistry, vol. 86, Mar. 3, 2014, 2867-2870.
Ganshirt-Ahlert, D. et al., "Ratio of Fetal to Maternal DNA is Less Than 1 in 5000 at different Gestational Ages in Maternal Blood", Clinical Genetics,38, 1990, 38-43.
Ganshirt-Ahlert, D. et al., "Fetal DNA in Uterine Vein Blood", Obstetrics & Gynecology, 80 (4), 1992, 601-603.
Ganshirt-Ahlert, Dorothee et al., "Three Cases of 45,X/46,XYnf Mosaicism", Human Genetics, 76, 1987, 153-156.
Garcia-Murillas, I. et al., "Mutation tracking in circulating tumor DNA predicts relapse in early breast cancer", Science Translational Medicine, vol. 7, No. 302, Aug. 26, 2015, 1-2.
Gardina, P. et al., "Ploidy Status and Copy Number Aberrations in Primary Glioblastomas Defined by Integrated Analysis of Allelic Ratios, Signal Ratios and Loss of Heterozygosity Using 500K SNP Mapping Arrays", BMC Genomics, 9 (489), (doi:10.1186/1471-2164-9-489), 2008, 16 pgs.
Geiss, G. K. et al., "Direct multiplexed measurement of gene expression with color-coded probe pairs", Nature Biotechnology, vol. 26, No. 3, Feb. 17, 2008, 317-325.
Ghanta, Sujana et al., "Non-Invasive Prenatal Detection of Trisomy 21 Using Tandem Single Nucleotide Polymorphisms", PLoS One, 5 (10), 2010, 10 pgs.
Gjertson, David W. et al., "Assessing Probability of Paternity and the Product Rule in DNA Systems", Genetica, 96, 1995, 89-98.
Greenwalt, T. et al., "The Quantification of Fetomaternal Hemorrhage by an Enzyme-Linked Antibody Test with Glutaraldehyde Fixation", Vox Sang, 63, 1992, 268-271.
Guerra, J. , "Terminal Contributions for Duplex Oligonucleotide Thermodynamic Properties in the Context of Nearest Neighbor Models", Biopolymers, 95(3), (2010), 2011, 194-201.
Guetta, Esther et al., "Analysis of Fetal Blood Cells in the Maternal Circulation: Challenges, Ongoing Efforts, and Potential Solutions", Stem Cells and Development, 13, 2004, 93-99.
Guichoux, et al., "Current Trends in Microsatellite Genotyping", Molecular Ecology Resources, 11, 2011, 591-911.
Gunderson, K. L. et al., "A genome-wide scalable SNP genotyping assay using microarray technology", Nature Genetics, vol. 37, No. 5, May 2005, 549-554.
Hall, M. , "Panorama Non-Invasive Prenatal Screening for Microdeletion Syndromes", Apr. 1, 2014 (Apr. 1, 2014), XP055157224, Retrieved from the Internet: URL:http://www.panoramatest.com/sites/default/files/files/PanoramaMicrodeletionsWhite Paper-2.pdf [retrieved on Dec. 8, 2014].
Han, S-W et al., "Predictive and Prognostic Impact of Epidermal Growth Factor Receptor Mutation in Non-Small-Cell Lung Cancer Patients Treated With Gefitinib", Journal of Clinical Oncology, vol. 23, No. 11, Apr. 10, 2005, 2493-2501.
Handyside, et al., "Isothermal whole genome amplification from single and small numbers of cells: a new era for preimplantation genetic diagnosis of inherited disease", Molecular Human Reproduction vol. IO, No. 10 pp. 767-772, 2004.
Hara, Eiji et al., "Subtractive eDNA cloning using oligo(dT)3o-latex and PCR: isolation of eDNA clones specific to undifferentiated human embryonal carcinoma cells", Nucleic Acids Research, 19(25), 1991, 7097-7104.
Hardenbol, P. , "Multiplexed Genotyping With Sequence-Tagged Molecular Inversion Probes", Nature Biotechnology, 21 (6), 2003, 673-678.
Hardenbol, Paul et al., "Highly multiplexed molecular inversion probe genotyping: Over 10,000 targeted SNPs genotyped in a singled tube assay", Genome Research, 15, 2005, 269-275.
Harismendy, O. et al., "Method for Improving Sequence Coverage Uniformity of Targeted Genomic Intervals Amplified by LR-PCR Using Illumina GA Sequencing-By-Synthesis Technology", Bio Techniques, 46(3), 2009, 229-231.
Harper, J. C. et al., "Recent Advances and Future Developments in PGD", Prenatal Diagnosis, 19, 1999, 1193-1199.
Harton, G.L. et al., "Preimplantation Genetic Testing for Marfan Syndrome", Molecular Human Reproduction, 2 (9), 1996, 713-715.
Hartwell, L. H. et al., "Chapter 11: The Direct Detection of Genotype Distinguishes Individual Genomes", Genetics: From Genes to Genomes, Second Edition, 2004, 371-414.
Hartwell, L. H. et al., "Chapter 13: Chromosomal Rearrangements and Changes in Chromosome Number Reshape Eukaryotic Genomes", Genetics: From Genes to Genomes, Second Edition, 2004, 441-486.
Hattori, M. et al., "The DNA sequence of human chromosome 21", Nature, vol. 405, May 18, 2000, 311-319.
Hawkins, T. et al., "Whole genome amplification—applications and advances", Current Opinion in Biotechnology, 13, 2002, 65-67.

(56) References Cited

OTHER PUBLICATIONS

Hayden, et al., "Multiplex-Ready PCR: A new method for multiplexed SSR and SNP genotyping", BMC Genomics 2008, 9(80), 1-12.

Hellani, A. et al., "Clinical Application of Multiple Displacement Amplification in Preimplantation Genetic Diagnosis", Reproductive BioMedicine Online, 10 (3), 2005, 376-380.

Hellani, Ali et al., "Multiple displacement amplification on single cell and possible PGD applications", Molecular Human Reproduction, 10(11), 2004, 847-852.

Hojsgaard, S. et al., "BIFROST—Block recursive models induced from relevant knowledge, observations, and statistical techniques", Computational Statistics & Data Analysis, 19(2), 1995, 155-175.

Hollas, B. et al., "A stochastic approach to count RN A molecules using DNA sequencing methods", Lecture Notes in Computer Science, vol. 2812, 2003, 55-62.

Holleley, et al., "Multiplex Manager 1.0: a Cross-Platform Computer Program that Plans and Optimizes Multiplex PCR", BioTechniques46:511-517 (Jun. 2009), 511-517.

Hollox, E. et al., "Extensive Normal Copy Number Variation of a β-Defensin Antimicrobial-Gene Cluster", Am. J. Hum. Genet., 73, 2003, 591-600.

Homer, et al., "Resolving Individuals Contributing Trace Amounts of DNA to Highly Complex Mixtures Using High-Density SNP Genotyping Microarrays", PLOS Genetics, 4(8), 2008, 9 pgs.

Hoogendoorn, Bastiaan et al., "Genotyping Single Nucleotide Polymorphisms by Primer Extension and High Performance Liquid Chromatography", Hum Genet, 104, 1999, 89-93.

Hornak, M. et al., "Aneuploidy Detection in Pigs Using Comparative Genomic Hybridization: From the Oocytes to Blastocysts", PLoS One, vol. 7, No. 1, Jan. 2012, 6 pages.

Hospital, F. et al., "A General Algorithm to Compute Multilocus Genotype Frequencies Under Various Mating Systems" vol. 12, No. 6, Jan. 1, 1996 (Jan. 1, 1996), pp. 455-462.

Howie, et al., "Fast and accurate genotype imputation in genome-wide association studies through pre-phasing", Nature Genetics, vol. 44, No. 8, Jul. 22, 2012, 955-959.

Hu, Dong Gui et al., "Aneuploidy Detection in Single Cells Using DNA Array-Based Comparative Genomic Hybridization", Molecular Human Reproduction, 10(4), 2004, 283-289.

Hug, H. et al., "Measurement of the Number of molecules of a single mRNA species in a complex mRNA preparation", J. Theor. Biol., vol. 221, 2003, 615-624.

Hultin, E. et al., "Competitive enzymatic reaction to control allele-specific extensions", Nucleic Acids Research, vol. 33, No. 5, Mar. 14, 2005, 1-10.

Ido, Yasuo et al., "Hyperglycemia-Induced Apoptosis in Human Umbilical Vein Endothelial Cells: Inhibition by the AMP-Activated Protein Kinase Activation", Diabetes, 51, 2002, 159-167.

Illumina, , "Patent Owner Illumina's Preliminary Response to Petition", Oct. 17, 2018, 75 pgs.

Illumina, , "Petition for Inter Partes Review of U.S. Pat. No. 8,682,592", Jun. 13, 2019, 91 pages.

Illumina, , "Plaintiff/Counterclaim Defendant Illumina, Inc.'s Amended Patent L.R. 3-3 Preliminary Invalidity Contentions for U.S. Pat. No. 8,682,592", Oct. 30, 2018, 22 pages.

Illumina, , "Plaintiff/Counterclaim-Defendant Illumina, Inc.'s Patent L.R. 3-3 Contentions for U.S. Patent Preliminary Invalidity Contentions for U.S. Pat. No. 8,682,592", Oct. 9, 2018, 81 pages.

Illumina Catalog, "Paired-End Sample Preparation Guide, Illumina Catalog# PE-930-1 001, Part# 1005063 Rev. E", 2011, 1-40.

Illumina, Inc., , "Declaration of David Peters, Ph.D. in Support of Petition for Inter Partes Review of U.S. Pat. No. 8,682,592", Jun. 13, 2019, 136 pages.

*Illumina, Inc. V. Natera, Inc.*, , "Order Re: Claim Construction", Jan. 30, 2019, 16 pgs.

Ishii, et al., "Optimization of Annealing Temperature to Reduce Bias Caused by a Primer Mismatch in Multitemplate PCR", Applied and Environmental Microbiology, Aug. 2001, p. 3753-3755.

Jabara, C. B. et al., "Accurate sampling and deep sequencing of the HIV-1 protease gene using a Primer ID", PNAS, vol. 108, No. 50, Dec. 13, 2011, 20166-20171.

Jahr, S. et al., "DNA Fragments in the Blood Plasma of Cancer Patients: Quantitations and Evidence for Their Origin from Apoptotic and Necrotic Cells", Cancer Research, vol. 61, Feb. 15, 2001, 1659-1665.

Jamal-Hanjani, M. et al., "Detection of ubiquitous and heterogeneous mutations in cell-free DNA from patients with early-stage non-small-cell lung cancer", Annals of Oncology, vol. 27, No. 5, Jan. 28, 2016, 862-867.

Jamal-Hanjani, M. et al., "Tracking Genomic Cancer Evolution for Precision Medicine: The Lung TRACERx Study", PLOS Biology, vol. 12, No. 7, Jul. 2014, 1-7.

Jamal-Hanjani, M. et al., "Tracking the Evolution of Non-Small-Cell Lung Cancer", The New England Journal of Medicine, vol. 376, No. 22, Jun. 1, 2017, 2109-2121.

Jarvie, T. , "Next generation sequencing technologies", Drug Discovery Today: Technologies, vol. 2, No. 3, 2005, 255-260.

Jenkins, S. et al., "High-throughput SNP genotyping", Comparative and Functional Genomics, vol. 3, Dec. 5, 2001, 57-66.

Johnson, D.S. et al., "Comprehensive Analysis of Karyotypic Mosaicism Between Trophectoderm and Inner Cell Mass", Molecular Human Reproduction, 16(12), 2010, 944-949.

Johnson D.S, et al., "Preclinical Validation of a Microarray Method for Full Molecular Karyotyping of Blastomeres in a 24-h Protocol", Human Reproduction, 25 (4), 2010, 1066-1075.

Kamat, A. A. et al., "Quantification of total plasma cell-free DNA in ovarian cancer using real-time PCR", Ann N Y Acad Sci., vol. 1075, Sep. 2006, 230-234.

Kaplinski, Lauris et al., "MultiPLX: Automatic Grouping and Evaluation of PCR Primers", Bioinformatics, 21(8), 2005, 1701-1702.

Kazakov, V.I. et al., "Extracellular DNA in the Blood of Pregnant Women", Tsitologia, vol. 37, No. 3, 1995, 1-8.

Kijak, G. et al., "Discrepant Results in the Interpretation of HIV-1 Drug-Resistance Genotypic Data Among Widely Used Algorithms", HIV Medicine, 4, 2003, 72-78.

Kim, H. et al., "Whole-genome and multisector exome sequencing of primary and post-treatment glioblastoma reveals patterns of tumor evolution", Genome Research, vol. 25, No. 3, Feb. 3, 2015, 316-327.

Kinde, I. et al., "Detection and quantification of rare mutations with massively parallel sequencing", PNAS, vol. 108, No. 23, Jun. 7, 2011, 9530-9535.

Kinnings, S. L. et al., "Factors affecting levels of circulating cell-free fetal DNA in maternal plasma and their implications for noninvasive prenatal testing", Prenatal Diagnosis, vol. 35, 2015, 816-822.

Kirkizlar, E. et al., "Detection of Clonal and Subclonal Copy-Number Variants in Cell-Free DNA from Patients with Breast Cancer Using a Massively Multiplexed PCR Methodology", Translational Oncology, vol. 8, No. 5, Oct. 2015, pp. 407-416.

Kivioja, T. et al., "Counting absolute numbers of molecules using unique molecular identifiers", Nature Methods, Advance Online Publication, Nov. 20, 2011, 1-5.

Konfortov, Bernard A. et al., "An Efficient Method for Multi-Locus Molecular Haplotyping", Nucleic Acids Research, 35(1), e6, 2007, 8 pgs.

Krjutskov, K. et al., "Development of a single tube 640-plex genotyping method for detection of nucleic acid variations on microarrays", Nucleic Acids Research, vol. 36, No. 12, May 23, 2008, 7 pages.

Kuliev, Anver et al., "Thirteen Years' Experience on Preimplantation Diagnosis: Report of the Fifth International Symposium on Preimplantation Genetics", Reproductive BioMedicine Online, 8, 2, 2004, 229-235.

Kunishima, S. et al., "First description of somatic mosaicism in MYH9 disorders", British Journal of Haematology, vol. 128, 2005, 360-365.

Kwok, P. Y. , "High-throughput genotyping assay approaches", Pharmacogenomics, vol. 1, No. 1, 2000, 1-5.

(56) References Cited

OTHER PUBLICATIONS

Lambert-Messerlian, G. et al., "Adjustment of Serum Markers in First Trimester Screening", Journal of Medical Screening, 16 (2), 2009, 102-103.

Lander, E. S. et al., "Initial sequencing and analysis of the human genome", Nature, vol. 409, Feb. 15, 2001, 860-921.

Lathi, Ruth B. et al., "Informatics Enhanced SNP Microarray Analysis of 30 Miscarriage Samples Compared to Routine Cytogenetics", PLoS One, 7(3), 2012, 5 pgs.

Leary, R. J. et al., "Development of Personalized Tumor Biomarkers Using Massively Parallel Sequencing", Science Translational Medicine, vol. 2, No. 20, Feb. 24, 2010, 1-8.

Leary, Rebecca J et al., "Detection of Chromosomal Alterations in the Circulation of Cancer Patients with Whole-Genome Sequencing", Science Translational Medicine, 4, 162, 2012, 12.

Levsky, J. M. et al., "Fluorescence in situ hybridization: past, present and future", Journal of Cell Science, vol. 116, No. 14, 2003, 2833-2838.

Li, B. , "Highly Multiplexed Amplicon Preparation for Targeted Re-Sequencing of Sample Limited Specimens Using the Ion AmpliSeq Technology and Semiconductor Sequencing", Proceedings of the Annual Meeting of the American Society of Human Genetics [retrieved on Oct. 30, 2012]. Retrieved from the Internet: <URL: http://www.ashg.org/2012meeting/abstracts/fulltext/f120121811.htm>, 2012, 1 pg.

Li, Y. et al., "Non-Invasive Prenatal Diagnosis Using Cell-Free Fetal DNA in Maternal Plasma from PGD Pregnancies", Reproductive BioMedicine Online, 19 (5), 2009, 714-720.

Li, Ying et al., "Size Separation of Circulatory DNA in Maternal Plasma Permits Ready Detection of Fetal DNA Polymorphisms", Clinical Chemistry, 50, 6, 2004, 1002-1011.

Liao, Gary J.W. et al., "Targeted Massively Parallel Sequencing of Maternal Plasma DNA Permits Efficient and Unbiased Detection of Fetal Alleles", Clinical Chemistry, 57 (1), 2011, 92-101.

Liao, J. et al., "An Alternative Linker-Mediated Polymerase Chain Reaction Method Using a Dideoxynucleotide to Reduce Amplification Background", Analytical Biochemistry 253, 137-139 (1997).

Liew, Michael et al., "Genotyping of Single-Nucleotide Polymorphisms", Clinical Chemistry, 50(7), 2004, 1156-1164.

Lindroos, Katarina et al., "Genotyping SNPs by Minisequencing Primer Extension Using Oligonucleotide Microarrays", Methods in Molecular Biology, 212, Single Nucleotide Polymorphisms: Methods and Protocols, P-K Kwok (ed.), Humana Press, Inc., Totowa, NJ, 2003, 149-165.

Lo, et al., "Digital PCR for the Molecular Detection of Fetal Chromosomal Aneuploidy", PNAS, vol. 104, No. 32, Aug. 7, 2007, 13116-13121.

Lo, et al., "Fetal Nucleic Acids in Maternal Blood: the Promises", Clin. Chem. Lab. Med., 50(6), 2012, 995-998.

Lo, et al., "Free Fetal DNA in Maternal Circulation", JAMA, 292(23), (Letters to the Editor), 2004, 2835-2836.

Lo, , "Non-Invasive Prenatal Diagnosis by Massively parallel Sequencing of Maternal Plasma DNA", Open Biol 2: 120086, 2012, 1-5.

Lo, et al., "Prenatal Sex Determination by DNA Amplification from Maternal Peripheral Blood", The Lancet,2, 8676, 1989, 1363-1365.

Lo, et al., "Rapid Clearance of Fetal DNA from Maternal Plasma", Am. J. Hum. Genet., 64, 1999, 218-224.

Lo, et al., "Strategies for the Detection of Autosomal Fetal DNA Sequence from Maternal Peripheral Blood", Annals New York Academy of Sciences,731, 1994, 204-213.

Lo, et al., "Two-way cell traffic between mother and fetus: biologic and clinical implications", Blood, 88(11), Dec. 1, 1996, 4390-4395.

Lo, Y. , "Noninvasive prenatal detection of fetal chromosomal aneuploidies by maternal plasma nucleic acid analysis: a review of the current state of the art", BJOG An International Journal of Obstetrics and Gynaecology, vol. 116, 2009, 152-157.

Lo, Y.M. Dennis , "Fetal Nucleic Acids in Maternal Plasma: Toward the Development of Noninvasive Prenatal Diagnosis of Fetal Chromosomal Aneuploidies", Ann. N.Y. Acad. Sci., 1137, 2008, 140-143.

Lo, Y.M. Dennis et al., "Maternal Plasma DNA Sequencing Reveals the Genome-Wide Genetic and Mutational Profile of the Fetus", Science Translational Medicine,, 2 (61), 2010, 13.

Lo, Y.M. Dennis et al., "Plasma placental RNA allelic ratio permits noninvasive prenatal chromosomal aneuploidy detection", Nature Medicine, 13 (2), 2007, 218-223.

Lo, Y.M. Dennis et al., "Presence of Fetal DNA in Maternal Plasma and Serum", The Lancet, 350, 1997, 485-487.

Lo, Y.M. Dennis et al., "Quantitative Analysis of Fetal DNA in Maternal Plasma and Serum: Implications for Noninvasive Prenatal Diagnosis", Am. J. Hum. Genet., 62, 1998, 768-775.

Lo, Y-M D. , "Non-invasive prenatal diagnosis using fetal cells in maternal blood", J. Clin. Pathol., vol. 47, 1994, 1060-1065.

Lo, Y-M.D et al., "Detection of Single-Copy Fetal DNA Sequence from Maternal Blood", The Lancet, 335, 1990, 1463-1464.

Lo, Y-M.D et al., "Prenatal Determination of Fetal Rhesus D Status by DNA Amplification of Peripheral Blood of Rhesus-Negative Mothers", Annals New York Academy of Sciences, 731, 1994, 229-236.

Lo, Y-M.D. et al., "Detection of Fetal RhD Sequence from Peripheral Blood of Sensitized RhD-Negative Pregnant Women", British Journal of Haematology, 87, 1994, 658-660.

Lo, Y-M.D. et al., "Prenatal Determination of Fetal RhD Status by Analysis of Peripheral Blood of Rhesus Negative Mothers", The Lancet, 341, 1993, 1147-1148.

Lu, I. et al., "Establishment of a system based on universal multiplex-PCR for screening genetically modified crops", Anal. Bioanal. Chem, vol. 396, Oct. 24, 2009, 2055-2064.

Lun, Fiona M. et al., "Noninvasive Prenatal Diagnosis of Monogenic Diseases by Digital Size Selection and Relative Mutation Dosage on DNA in Maternal Plasma", PNAS, 105(50), 2008, 19920-19925.

Ma, Xiaotu et al., "Rise and fall of subclones from diagnosis to relapse in pediatric B-acute lymphoblastic leukaemia", Nature Communications, vol. 6, Mar. 19, 2015, 1-12.

Magbanua, M. J. et al., "Abstract PD2-01: Personalized serial circulating tumor DNA (ctDNA) analysis in high-risk early stage breast cancer patients to monitor and predict response to neoadjuvant therapy and outcome in the I-SPY 2 Trial", Cancer Research, vol. 79, No. 4 Supplement, Feb. 15, 2019.

Mamon, H. et al., "Letters to the Editor: Preferential Amplification of Apoptotic DNA from Plasma: Potential for Enhancing Detection of Minor DNA Alterations in Circulating DNA", Clinical Chemistry, vol. 54, No. 9, 2008, 1582-1584.

Maniatis, T. et al., "In: Molecular Cloning: A Laboratory Manual", Cold Spring Harbor Laboratory, New York, Thirteenth Printing, 1986, 458-459.

Mansfield, Elaine S , "Diagnosis of Down Syndrome and Other Aneuploidies Using Quantitative Polymerase Chain Reaction and Small Tandem Repeat Polymorphisms", Human Molecular Genetics, 2, 1, 1993, 43-50.

Mardis, E. R. , "The impact of next-generation sequencing technology on genetics", Trends in Genetics, vol. 24, No. 3, Feb. 11, 2008, 133-141.

Margulies, M. et al., "Genome sequencing in microfabricated high-density picolitre reactors", Nature, vol. 437, Sep. 15, 2005, 376-380.

Margulies, M. et al., "Genome sequencing in microfabricated high-density picolitre reactors plus Supplemental Methods", Nature, vol. 437, Sep. 15, 2005, 40 pgs.

Markoulatos, P. et al., "Multiplex Polymerase Chain Reaction: A Practical Approach", Journal of Clinical Laboratory Analysis, vol. 16, 2002, 47-51.

May, Robert M. , "How Many Species Are There on Earth?", Science, 241, Sep. 16, 1988, 1441-1449.

McBride, D. et al., "Use of Cancer-Specific Genomic Rearrangements to Quantify Disease Burden in Plasma from Patients with Solid Tumors", Genes, Chromosomes & Cancer, vol. 49, Aug. 19, 2010, 1062-1069.

(56) References Cited

OTHER PUBLICATIONS

McCloskey, M. L. et al., "Encoding PCR Products with Batch-stamps and Barcodes", Biochem Genet., vol. 45, Oct. 23, 2007, 761-767.
McCray, Alexa T. et al., "Aggregating UMLS Semantic Types for Reducing Conceptual Complexity", MEDINFO 2001: Proceedings of the 10th World Congress on Medical Informatics (Studies in Health Technology and Informatics, 84, V. Patel et al. (eds.), IOS Press Amsterdam, 2001, 216-220.
McDonald, B. R. et al., "Abstract P4-01-21: Multiplexed targeted digital sequencing of circulating tumor DNA to detect minimal residual disease in early and locally advanced breast cancer", Cancer Research, vol. 79, No. 4 Supplement, Feb. 15, 2019.
Mennuti, M. et al., "Is It Time to Sound an Alarm About False-Positive Cell-Free DNA Testing for Fetal Aneuploidy?", American Journal of Obstetrics, 2013, 5 pgs.
Merriam-Webster, , "Medical Definition of Stimulant", http://www.merriam-webster.com/medical/stimulant, Mar. 14, 2016, 7 pages.
Mersy, et al., "Noninvasive Detection of Fetal Trisomy 21: Systematic Review and Report of Quality and Outcomes of Diagnostic Accuracy Studies Performed Between 1997 and 2012", Human Reproduction Update, 19(4), 2013, 318-329.
Mertes, F. et al., "Targeted enrichment of genomic DNA regions for next-generation sequencing", Briefings in Functional Genomics, vol. 10, No. 6, Nov. 26, 2011, 374-386.
Miller, Robert , "Hyperglycemia-Induced Changes in Hepatic Membrane Fatty Acid Composition Correlate with Increased Caspase-3 Activities and Reduced Chick Embryo Viability", Comparative Biochemistry and Physiology, Part B, 141, 2005, 323-330.
Miller, Robert R. , "Homocysteine-Induced Changes in Brain Membrane Composition Correlate with Increased Brain Caspase-3 Activities and Reduced Chick Embryo Viability", Comparative Biochemistry and Physiology Part B, 136, 2003, 521-532.
Miner, B. E. et al., "Molecular barcodes detect redundancy and contamination in hairpin-bisulfite PCR", Nucleic Acids Research, vol. 32, No. 17, Sep. 30, 2004, 1-4.
Minkoff, E. et al., "Stem Cells, Cell Division, and Cancer", Biology Today Third Edition, Chapter 12, 2004, 10 pages.
Morand, et al., "Hesperidin contributes to the vascular protective effects of orange juice: a randomized crossover study in healthy volunteers", Am J Clin Nutr. Jan. 2011;93(1):73-80. Epub Nov. 10, 2010.
Munne, S. et al., "Chromosome abnormalities in human embryos", Human Reproduction update, 4 (6), 842-855.
Munne, S. et al., "Chromosome Abnormalities in Human Embryos", Textbook of Assisted Reproductive Techniques, 2004, pp. 355-377.
Munne, S. et al., "Improved implantation after preimplantation genetic diagnosis of aneuploidy", Reproductive BioMedicine Online, vol. 7., No. 1., May 15, 2003, 91-97.
Murtaza, M. et al., "Non-Invasive Analysis of Acquired Resistance to Cancer Therapy by Sequencing of Plasma DNA", Nature (doi:10.1038/nature12065), 2013, 6 pgs.
Muse, Spencer V. , "Examining rates and patterns of nucleotide substitution in plants", Plant Molecular Biology 42: 25-43, 2000.
Myers, Chad L. et al., "Accurate Detection of Aneuploidies in Array CGH and Gene Expression Microarray Data", Bioinformatics, 20(18), 2004, 3533-3543.
Nannya, Yasuhito et al., "A Robust Algorithm for Copy Number Detection Using High-density Oligonucleotide Single Nucleotide Polymorphism Genotyping Arrays", Cancer Res., 65, 14, 2005, 6071-6079.
Narayan, A. et al., "Ultrasensitive measurement of hotspot mutations in tumor DNA in blood using error-suppressed multiplexed deep sequencing", Cancer Research, vol. 72, No. 14, Jul. 15, 2012, 3492-3498.
Natera, Inc. "Declaration of Sandra L. Haberny", May 16, 2019, 3 pages.
Natera, Inc., , "Defendant Natera, Inc.'s Invalidity Contentions Under Patent L.R. 3-3; Document Production Accompanying Invalidity Contentions Under Patent L.R. 3-4", Aug. 20, 2018, 17 pages.
Natera, Inc., , "Exhibit 8 EHRICH Invalidity Chart", Aug. 20, 2018, 16 pages.
Natera, Inc., , "Exhibits A-H to Haberny Declaration", May 16, 2019, 192 pages.
Natera, Inc., , "Motion to Dismiss", May 16, 2019, 2 pages.
Natera, Inc., , "Natera Inc.'s First Amended Answer, Affirmative Defenses and Counterclaims", Aug. 16, 2018, 28 pages.
Natera, Inc., , "Natera, Inc.'s Supplemental Objections and Response to Plaintiff Illumina, Inc.'s Interrogatory No. 8", Mar. 20, 2019, 29 pages.
Natera, Inc., , "Opening Brief in Support of Motion to Dismiss", May 16, 2019, 26 pages.
Natera, Inc., , "Petitioner Reply Per Board Order of Nov. 2, 2018 (Paper No. 10)", Nov. 9, 2018, 8 pgs.
Newman, A. M. et al., "Integrated digital error suppression for improved detection of circulating tumor DNA", Nature Biotechnology, vol. 34, No. 5, May 2016, 547-555.
Ng, S. B. et al., "Individualised multiplexed circulating tumour DNA assays for monitoring of tumour presence in patients after colorectal cancer surgery", Scientific Reports, vol. 7, No. 40737, Jan. 19, 2017, 11 pages.
Nicolaides, K. et al., "Noninvasive Prenatal Testing for Fetal Trisomies in a Routinely Screened First-Trimester Population", American Journal of Obstetrics (article in press), 207, 2012, 1.e1-1.e6.
Nicolaides, K.H et al., "Validation of Targeted Sequencing of Single-Nucleotide Polymorphisms for Non-Invasive Prenatal Detection of Aneuploidy of Chromosomes 13, 18, 21, X, and Y", Prenatal Diagnosis, 33, 2013, 575-579.
Nicolaides, Kypros H. et al., "Prenatal Detection of Fetal Triploidy from Cell-Free DNA Testing in Maternal Blood", Fetal Diagnosis and Therapy, 2013, 1-6.
Nygren, et al., "Quantification of Fetal DNA by Use of Methylation-Based DNA Discrimination", Clinical Chemistry 56:10 1627-1635 (2010).
Ogino, S. et al., "Bayesian Analysis and Risk Assessment in Genetic Counseling and Testing", Journal of Molecular Diagnostics, 6 (1), 2004, 9 pgs.
Ohsawa, M. et al., "Prenatal Diagnosis of Two Pedigrees of Fukuyama Type Congenital Muscular Dystrophy by Polymorphism Analysis", The Health and Welfare Ministry, 1994, 5 pgs.
O'Malley, R. et al., "An adapter ligation-mediated PCR method for high-throughput mapping of T-DNA inserts in the *Arabidopsis* genome", Nat. Protoc., 2, 2007, 2910-2917.
Orozco A.F., et al., "Placental Release of Distinct DNA-Associated Micro-Particles into Maternal Circulation: Reflective of Gestation Time and Preeclampsia", Placenta,30, 2009, 891-897.
Ozawa, Makiko et al., "Two Families with Fukuyama Congenital Muscular Dystrophy that Underwent in Utero Diagnosis Based on Polymorphism Analysis", Clinical Muscular Dystrophy: Research in Immunology and Genetic Counseling—FY 1994 Research Report, (including text in Japanese), 1994, 8.
Paez, Guillermo J. et al., "Genome coverage and sequence fidelity of $\phi$29 polymerase-based multiple strand displacement whole genome amplification", Nucleic Acids Research, 32(9), 2004, 1-11.
Page, S. L. et al., "Chromosome Choreography: The Meiotic Ballet", Science, 301, 2003, 785-789.
Palomaki, G. E. et al., "DNA sequencing of maternal plasma to detect Down syndrome: An international clinical validation study", Genetics in Medicine, vol. 13, No. 1, Nov. 2011, 913-920.
Palomaki, Glenn et al., "DNA Sequencing of Maternal Plasma Reliably Identifies Trisomy 18 and Trisomy 13 as Well as Down Syndrome: an International Collaborative Study", Genetics in Medicine, 2012, 10.
Palomaki, Glenn E. et al., "DNA Sequencing of Maternal Plasma to Detect Down Syndrome: An International Clinical Validation Study", Genetics in Medicine (pre-print version), 13, 2011, 8 pgs.
Papadopoulou, E. et al., "Cell-Free DNA and RNA in Plasma as a New Molecular Marker for Prostate Cancer", Oncology Research, vol. 14, 2004, 439-445.
Papageorgiou, Elisavet A. et al., "Fetal-Specific DNA Methylation Ratio Permits Noninvasive Prenatal Diagnosis of Trisomy 21", Nature Medicine (advance online publication),17, 2011, 5 pgs.

(56) References Cited

OTHER PUBLICATIONS

Pastinen, T. et al., "Minisequencing: A Specific Tool for DNA Analysis and Diagnostics on Oligonucleotide Arrays", Genome Research, vol. 7, 1997, 606-614.
Pathak, A. et al., "Circulating Cell-Free DNA in Plasma/Serum of Lung Cancer Patients as a Potential Screening and Prognostic Tool", Clinical Chemistry, 52, 2006, 1833-1842.
PCT/US2006/045281, , "International Preliminary Report on Patentability", dated May 27, 2008, 1 pg.
PCT/US2006/045281, , "International Search Report and Written Opinion", dated Sep. 28, 2007, 7 pgs.
PCT/US2008/003547, , "International Search Report", dated Apr. 15, 2009, 5 pgs.
PCT/US2009/034506, , "International Search Report", dated Jul. 8, 2009, 2 pgs.
PCT/US2009/045335, , "International Search Report", dated Jul. 27, 2009, 1 pg.
PCT/US2009/052730, , "International Search Report", dated Sep. 28, 2009, 1 pg.
PCT/US2010/050824, , "International Search Report", dated Nov. 15, 2010, 2 pgs.
PCT/US2011/037018, , "International Search Report", dated Sep. 27, 2011, 2 pgs.
PCT/US2011/061506, , "International Search Report", dated Mar. 16, 2012, 1 pgs.
PCT/US2011/066938, , "International Search Report", dated Jun. 20, 2012, 1 pg.
PCT/US2012066339, , "International Search Report", dated Mar. 5, 2013, 1 pg.
PCT/US2013/028378, , "International Search Report and Written Opinion", dated May 28, 2013, 11 pgs.
PCT/US2013/57924, , "International Search Report and Written Opinion", dated Feb. 18, 2014, 8 pgs.
PCT/US2014/051926, , "International Search Report and Written Opinion", dated Dec. 9, 2014, 3 pgs.
Pearson, K. , "On the criterion that a given system of deviations from the probable in the case of a correlated system of variables is such that it can be reasonably supposed to have arisen from random sampling", Philosophical Magazine Series 5, vol. 50, Issue 302, 1900, 157-175.
Pena, Sergio D.J et al., "Paternity Testing in the DNA Era", Trends in Genetics, 10, 6, 1994, 204-209.
Pergament, E. et al., "Single-Nucleotide Polymorphism-Based Non-invasive Prenatal Screening in a High-Risk and Low-Risk Cohort", Obstetrics & Gynecology, vol. 124, No. 2, Part 1, Aug. 2014, 210-218 + Appendices.
Perkel, Jeffrey M. , "Overcoming the Challenges of Multiplex PCR", Biocompare Editorial Article, Null, 2012, 1-5.
Perry, George H. et al., "The Fine-Scale and Complex Architecture of Human Copy-Number Variation", The American Journal of Human Genetics,82, 2008, 685-695.
Pertl, B. et al., "Detection of Male and Female Fetal DNA in Maternal Plasma by Multiplex Fluorescent Polymerase Chain Reaction Amplification of Short Tandem Repeats", Hum. Genet., 106, 2000, 45-49.
Peters, D. , "List of Materials Considered by David Peters, Ph.D.", Jun. 13, 2019, 2 pages.
Peters, David P. et al., "Noninvasive Prenatal Diagnosis of a Fetal Microdeletion Syndrome", New England Journal of Medicine, 365(19), 2011, 1847-1848.
Pfaffl, Michael W. , "Relative Expression Software Tool (REST©) for Group-Wise Comparison and Statistical Analysis of Relative Expression Results in real-Time PCR", Nucleic Acids Research, 30(9), 2002, 10 pgs.
Phillips, C. et al., "Resolving Relationship Tests that Show Ambiguous STR Results Using Autosomal SNPs as Supplementary Markers", Forensic Science International: Genetics 2, 2008, 198-204.
Podder, Mohua et al., "Robust SN P genotyping by multiplex PCR and arrayed primer", BMC Medical Genomics,1(5), 2008, 1-15.
Poirier, K. et al., "Maternal mosaicism for mutations in the ARX gene in a family with X linked mental retardation", Human Genetics, vol. 118, Aug. 3, 2005, 45-48.
Poon, L. L. et al., "Differential DNA Methylation between Fetus and Mother as a Strategy for Detecting Fetal DNA in Maternal Plasma", Clinical Chemistry, vol. 48, No. 1, 2002, 35-41.
Popova, T. et al., "Genome Alteration Print (GAP): a tool to visualize and mine complex cancer genomic profiles obtained by SNP arrays", Genome Biology, vol. 10, R128, Nov. 11, 2009, 1-14.
Porreca, Gregory J et al., "Multiplex Amplification of Large Sets of Human Exons", Nature Methods, 4, (advance online publication), 2007, 6.
Price, T.S. et al., ""SW-ARRAY: a dynamic programming solution for the identification of copy-number changes in genomic DNA using array comparative genome hybridization data",", Nucleic Acids Research, vol. 33, No. 11, Jun. 16, 2005, 3455-3464.
Primdahl, H. et al., "Allelic Imbalances in Human Bladder Cancer: Genome-Wide Detection With High-Density Single-Nucleotide Polymorphism Arrays", Journal of the National Cancer Institute, vol. 94, No. 3, Feb. 6, 2002, 216-223.
Quinn, G. P. et al., "Experimental Design and Data Analysis for Biologists", Graphical Exploration of Data, 2002, 64-67.
Rabinowitz, et al., "Accurate Prediction of HIV-1 Drug Response from the Reverse Transcriptase and Protease Amino Acid Sequences Using Sparse Models Created by Convex Optimization", Bioinformatics, 22, 5, 2006, 541-549.
Rabinowitz, Matthew et al., "Origins and rates of aneuploidy inhuman blastomeres", Fertility and Sterility, vol. 97, No. 2, Feb. 2012, 395-401.
Rabinowitz, Matthew. et al., "Non-Invasive Prenatal Aneuploidy Testing of Chromosomes 13, 18, 21, X, and Y Using Targeted Sequencing of Polymorphic Loci", The American Society of Human Genetics, meeting poster, 2012, 1 pg.
Rachlin, J. et al., "Computational tradeoffs in multiplex PCR assay design for SNP genotyping", BMC Genomics, vol. 6, No. 102, Jul. 25, 2005, 11 pages.
Ragoussis, J. , "Genotyping Technologies for Genetic Research", Annual Review of Genomics and Human Genetics, vol. 10 (1), Sep. 1, 2009, 117-133.
Rahmann, Sven et al., "Mean and variance of the Gibbs free energy of oligonucleotides in the nearest neighbor model under varying conditions", Bioinformatics, 20(17), 2004, 2928-2933.
Rava, Richard P. et al., "Circulating Fetal Cell-Free DNA Fraction Differ in Autosomal Aneuploidies and Monosomy X", Clinical Chemistry, 60(1), (papers in press), 2013, 8 pgs.
Rechitsky, Svetlana et al., "Preimplantation Genetic Diagnosis with HLA Matching", Reproductive Bio Medicine Online, 9, 2, 2004, 210-221.
Reinert, T. et al., "Analysis of circulating tumour DNA to monitor disease burden following colorectal cancer surgery", Gut, vol. 65, 2016, 625-634.
Renwick, P. et al., "Proof of Principle and First Cases Using Preimplantation Genetic Haplotyping—A Paradigm Shift for Embryo Diagnosis", Reproductive BioMedicine Online, 13 (1), 2006, 110-119.
Ricciotti, Hope , "Eating by Trimester", Online]. Retrieved from Internet<http://www.youandyourfamily.com/article.php?story=Eating+by+Trimester>, 2014, 3.
Riley, D. E. , "DNA Testing: An Introduction for Non-Scientists an Illustrated Explanation", Scientific Testimony: An Online Journal, http://www.scientific.org/tutorials/articles/riley/riley.html, Apr. 6, 2005, 22 pages.
Riva, F. , "Patient-Specific Circulating Tumor DNA Detection during Neoadjuvant Chemotherapy in Triple-Negative Breast Cancer", Clinical Chemistry, vol. 63, No. 3, 2017, 691-699.
Rogaeva, E. et al., "The Solved and Unsolved Mysteries of the Genetics of Early-Onset Alzheimer's Disease", NeuroMolecular Medicine, vol. 2, 2002, 1-10.
Roper, Stephen M. et al., "Forensic Aspects of DNA-Based Human Identity Testing", Journal of Forensic Nursing, 4, 2008, 150-156.
Roux, K. , "Optimization and Troubleshooting in PCR", PCR Methods Appl. 4, 1995, 185-194.

(56) References Cited

OTHER PUBLICATIONS

Rozen, Steve et al., "Primer3 on the WWW for General Users and for Biologis Programmers", Methods in Molecular Biology, 132: Bioinformatics Methods and Protocols, 1999, 365-386.
Russell, L. M., "X Chromosome Loss and Ageing", Cytogenetic and Genome Res., 116, 2007, 181-185.
Ryan, A. et al., "Informatics-Based, Highly Accurate, Noninvasive Prenatal Paternity Testing", Genetics in Medicine (advance online publication), 2012, 5 pgs.
Rychlik, et al., "Optimization of the annealing temperature for DNA amplification in vitro", Nucleic Acids Research, 18(21), 1990, 6409-6412.
Sahota, A., "Evaluation of Seven PCR-Based Assays for the Analysis of Microchimerism", Clinical Biochemistry, vol. 31, No. 8., 1998, 641-645.
Saker, A. et al., "Genetic characterisation of circulating fetal cells allows non-invasive prenatal diagnosis of cystic fibrosis", Prenatal Diagnosis, vol. 26, Jul. 11, 2006, 906-916.
Samango-Sprouse, C. et al., "SNP-Based Non-Invasive Prenatal Testing Detects Sex Chromosome Aneuploidies with High Accuracy", Prenatal Diagnosis, 33, 2013, 1-7.
Sander, Chris, "Genetic Medicine and the Future of Health Care", Science, 287(5460), 2000, 1977-1978.
Santalucia, J. et al., "The Thermodynamics of DNA Structural Motifs", Annu. Rev. Biophys. Biomol. Struct., 33, 2004, 415-440.
Santalucia, John J.R et al., "Improved Nearest-Neighbor Parameters for Predicting DNA Duplex Stability", Biochemistry, 35, 1996, 3555-3562.
Sasabe, Yutaka, "Genetic Diagnosis of Gametes and Embryos Resulting from ART", Japanese Journal of Fertility and Sterility, vol. 46, No. 1, 2001, 43-46.
Schmitt, M. W. et al., "Detection of ultra-rare mutations by next-generation sequencing", PNAS, vol. 109, No. 36, Sep. 4, 2012, 14508-14513.
Schoumans, J et al., "Detection of chromosomal imbalances in children with idiopathic mental retardation by array based comparative genomic hybridisation (array-CGH)", JMed Genet, 42, 2005, 699-705.
Sebat, Jonathan et al., "Strong Association of De Novo Copy Number Mutations with Autism", Science, 316, 2007, 445-449.
Sehnert, A. et al., "Optimal Detection of Fetal Chromosomal Abnormalities by Massively Parallel DNA Sequencing of Cell-Free Fetal DNA from Maternal Blood", Clinical Chemistry (papers in press), 57 (7), 2011, 8 pgs.
Sermon, Karen et al., "Preimplantation genetic diagnosis", The Lancet, Lancet Limited. 363(9421), 2000, 1633-1641.
Servin, B et al., "MOM: A Program to Compute Fully Informative Genotype Frequencies in Complex Breeding Schemes", Journal of Heredity, vol. 93, No. 3, Jan. 1, 2002 (Jan. 1, 2002), pp. 227-228.
Sham, P. et al., "DNA Pooling: A Tool for Large-Scale Association Studies", Nature Reviews Genetics, vol. 3, Nov. 2002, 862-871.
Shaw-Smith, et al., "Microarray Based Comparative Genomic Hybridisation (array-CGH) Detects Submicroscopic Chromosomal Deletions and Duplications in Patients with Learning Disability/Mental Retardation and Dysmorphic Features", J. Med. Genet., 41, 2004, 241-248.
Shen, et al., "High-quality DNA sequence capture of 524 disease candidate genes", High-quality DNA sequence capture of 524 disease candidate genes, Proceedings of the National Academy of Sciences, vol. 108, No. 16, Apr. 5, 2011 (Apr. 5, 2011), pp. 6549-6554.
Shen, R. et al., "High-throughput SNP genotyping on universal bead arrays", Mutation Research, vol. 573, Feb. 11, 2005, 70-82.
Shen, Zhiyong, "MPprimer: a program for reliable multiplex PCR primer design", BMC Bioinformatics 2010, 11:143, 1-7.
Sherlock, J et al., "Assessment of Diagnostic Quantitative Fluorescent Multiplex Polymerase Chain Reaction Assays Performed on Single Cells", Annals of Human Genetics,62, 1, 1998, 9-23.

Shiroguchi, K. et al., "Digital RNA sequencing minimizes sequence-dependent bias and amplification noise with optimized single-molecule barcodes", PNAS, vol. 109, No. 4, Jan. 24, 2012, 1347-1352.
Sigdel, T. et al., "Plasma Donor-Derived Cell-Free DNA Quantification by massively multiplex PCR Distinguishes Kidney Transplant Acute Rejection", Transplantation, vol. 102, No. 7S, Jul. 2018, S178-S179.
Sigdel, T. K. et al., "Optimizing Detection of Kidney Transplant Injury by Assessment of Donor-Derived Cell-Free DNA via Massively Multiplex PCR", Journal of Clinical Medicine, vol. 8, No. 19, Dec. 23, 2018, 17 pages.
Simpson, J. et al., "Fetal Cells in Maternal Blood: Overview and Historical Perspective", Annals New York Academy of Sciences, 731, 1994, 1-8.
Sint, Daniela et al., "Advances in Multiplex PCR: Balancing Primer Efficiencies and Improving Detection Success", Methods in Ecology and Evolution, 3, 2012, 898-905.
Slater, Howard et al., "High-Resolution Identification of Chromosomal Abnormalities Using Oligonucleotide Arrays Containing 116,204 SNPs", Am. J. Hum. Genet., 77, 5, 2005, 709-726.
Snijders, Antoine et al., "Assembly of Microarrays for Genome-Wide Measurement of DNA Copy Number", Nature Genetic, 29, 2001, 263-264.
Snyder, T. M. et al., "Universal noninvasive detection of solid organ transplant rejection", PNAS, vol. 108, No. 15, Apr. 12, 2011, 6229-6234.
Sparks, A. et al., "Non-Invasive Prenatal Detection and Selective Analysis of Cell-Free DNA Obtained from Maternal Blood: Evaluation for Trisomy 21 and Trisomy 18", American Journal of Obstetrics & Gynecology 206, 2012, 319.e1-319.e9.
Sparks, Andrew B. et al., "Selective Analysis of Cell-Free DNA in Maternal Blood for Evaluation of Fetal Trisomy", Prenatal Diagnosis, 32, 2012, 1-7.
Spiro, Alexander et al., "A Bead-Based Method for Multiplexed Identification and Quantitation of DNA Sequences Using Flow Cytometry", Applied and Environmental Microbiology, 66, 10, 2000, 4258-4265.
Spits, C et al., "Optimization and Evaluation of Single-Cell Whole Genome Multiple Displacement Amplification", Human Mutation, 27(5), 496-503, 2006.
Srinivasan, et al., "Noninvasive Detection of Fetal Subchromosome Abnormalities via Deep Sequencing of Maternal Plasma", The American Journal of Human Genetics 92, 167-176, Feb. 7, 2013.
Stephens, Mathews. et al., "A Comparison of Bayesian Methods for Haplotype Reconstruction from Population Genotype Data", Am. J. Hum. Genet.,73, 2003, 1162-1169.
Stevens, Robert et al., "Ontology-Based Knowledge Representation for Bioinformatics", Briefings in Bioinformatics, 1, 4, 2000, 398-414.
Steyerberg, E.W et al., "Application of Shrinkage Techniques in Logistic Regression Analysis: A Case Study", Statistica Neerlandica, 55(1), 2001, 76-88.
Strom, C. et al., "Three births after preimplantation genetic diagnosis for cystic fibrosis with sequential first and second polar body analysis", American Journal of Obstetrics and Gynecology, 178 (6), 1998, 1298-1306.
Strom, Charles M. et al., "Neonatal Outcome of Preimplantation Genetic Diagnosis by Polar Body Removal: The First 109 Infants", Pediatrics, 106( 4), 2000, 650-653.
Stroun, Maurice et al., "Prehistory of the Notion of Circulating Nucleic Acids in Plasma/Serum (CNAPS): Birth of a Hypothesis", Ann. N.Y. Acad. Sci., 1075, 2006, 10-20.
Su, S.Y. et al., ""Inferring combined CNV/SNP haplotypes from genotype data"", Bioinformatics, vol. 26, No. 11,1, Jun. 1, 2010, 1437-1445.
Sun, Guihua et al., "SNPs in human miRNA genes affect biogenesis and function", RNA, 15(9), 2009, 1640-1651.
Sweet-Kind Singer, J. A. et al., "Log-penalized linear regression", IEEE International Symposium on Information Theory, 2003. Proceedings, 2003, 286.

(56) References Cited

OTHER PUBLICATIONS

Taliun, D. et al., "Efficient haplotype block recognition of very long and dense genetic sequences", BMC Bioinformatics, vol. 15 (10), 2014, 1-18.

Tamura, et al., "Sibling Incest and formulation of paternity probability: case report", Legal Medicine, 2000, vol. 2, p. 189-196.

Tang, et al., , Multiplex fluorescent PCR for noninvasive prenatal detection of fetal-derived paternally inherited diseases using circulatory fetal DNA in maternal plasma, Eur J Obstet Gynecol Reprod Biol, 2009, v.144, No. 1, p. 35-39.

Tang, N. et al., "Detection of Fetal-Derived Paternally Inherited X-Chromosome Polymorphisms in Maternal Plasma", Clinical Chemistry, 45 (11), 1999, 2033-2035.

Tebbutt, S. J. et al., "Microarray genotyping resource to determine population stratification in genetic association studies of complex disease", BioTechniques, vol. 37, Dec. 2004, 977-985.

Ten Bosch, J. , "Keeping Up With the Next Generation Massively Parallel Sequencing in Clinical Diagnostics", Journal of Molecular Diagnostics, vol. 10, No. 6, 2008, 484-492.

Tewhey, R. et al., "The importance of phase information for human genomics", Nature Reviews Genetics, vol. 12, No. 3, Mar. 1, 2011, 215-223.

The International Hapmap Consort, , "The International HapMap Project", Nature, vol. 426, Dec. 18, 2003, 789-796.

Thermofisher Scientific, "Ion AmpliSeq Cancer Hotspot Panel v2", Retrieved from the Internet: https://tools.thermofisher.com/content/sfs/brochures/Ion-AmpliSeq-Cancer-Hotspot-Panel-Flyer.pdf, 2015, 2 pages.

Thomas, M.R et al., "The Time of Appearance and Disappearance of Fetal DNA from the Maternal Circulation", Prenatal Diagnosis, 15, 1995, 641-646.

Tiersch, T. R. et al., "Reference Standards for Flow Cytometry and Application in Comparative Studies of Nuclear DNA Content", Cytometry, vol. 10, Mar. 21, 1989, 706-710.

Tong, Yu et al., "Noninvasive Prenatal Detection of Fetal Trisomy 18 by Epigenetic Allelic Ratio Analysis in Maternal Plasma: Theoretical and Empirical Considerations", Clinical Chemistry, 52(12), 2006, 2194-2202.

Tong, Yu K. et al., "Noninvasive Prenatal Detection of Trisomy 21 by Epigenetic-Genetic Chromosome-Dosage Approach", Clinical Chemistry, 56(1), 2010, 90-98.

Troyanskaya, Olga G. et al., "A Bayesian Framework for Combining Heterogeneous Data Sources for Gene Function Prediction (in *Saccharomyces cerevisiae*)", PNAS, 100(14), 2003, 8348-8353.

Tsui, Nancy B.Y et al., "Non-Invasive Prenatal Detection of Fetal Trisomy 18 by RNA-SNP Allelic Ratio Analysis Using Maternal Plasma SERPINB2 mRNA: A Feasibility Study", Prenatal Diagnosis, 29, 2009, 1031-1037.

Tu, J. et al., "Pair-barcode high-throughput sequencing for large-scale multiplexed sample analysis", BMC Genomics, vol. 13, No. 43, Jan. 25, 2012, 1-9.

Turner, E. et al., "Massively Parallel Exon Capture and Library-Free Resequencing Across 16 Genomes", Nature Methods, 6 (5), 2009, 315-316.

Vallone, Peter , "AutoDimer: a Screening Tool for Primer-Dimer and Hairpin Structures", Bio Techniques, 37, 2004, 226-231.

Varley, Katherine Elena et al., "Nested Patch PCR Enables Highly Multiplexed Mutation Discovery in Candidate Genes", Genome Res., 18(11), 2008, 1844-1850.

Verlinsky, Y. et al., "Over a Decade of Experience with Preimplantation Genetic Diagnosis", Fertility and Sterility, 82 (2), 2004, 302-303.

Wagner, Jasenka et al., "Non-Invasive Prenatal Paternity Testing from Maternal Blood", Int. J. Legal Med., 123, 2009, 75-79.

Wang, D. G. et al., "Large-Scale Identification, Mapping, and Genotyping of Single-Nucleotide Polymorphisms in the Human Genome", Science, vol. 280, May 15, 1998, 1077-1082.

Wang, Eric et al., "Gestational Age and Maternal Weight Effects on Fetal Cell-Free DNA in Maternal Plasma", Prenatal Diagnosis, 33, 2013, 662-666.

Wang, Hui-Yun et al., "A genotyping system capable of simultaneously analyzing >1000 single nucleotide polymorphisms in a haploid genome", Genome Res., 15, 2005, 276-283.

Wang, T.L. et al., "Digital karyotyping", PNAS, vol. 99, No. 25, Dec. 10, 2002, 16156-16161.

Wang, Yuker et al., "Allele quantification using molecular inversion probes (MIP)", Nucleic Acids Research, vol. 33, No. 21, Nov. 28, 2005, 14 pgs.

Wapner, R. et al., "Chromosomal Microarray Versus Karyotyping for Prenatal Diagnosis", The New England Journal of Medicine, 367 (23), 2012, 2175-2184.

Wapner, R. et al., "First-Trimester Screening for Trisomies 21 and 18", The New England Journal of Medicine, vol. 349, No. 15, Oct. 9, 2003, 1405-1413.

Watkins, N. et al., "Thermodynamic contributions of single internal rA •dA, rC • dC, rG • dG and rU • dT mismatches in RNA/DNA duplexes", Nucleic Acids Research, 9 (5),, 2010, 1894-1902.

Weiss, C. A. , "Chapter 8: Confidence Intervals for One Population Mean", Introductory Statistics, Sixth Edition, 2002, 340-381.

Wells, D , "Microarray for Analysis and Diagnosis of Human Embryos", 12th International Congress on Prenatal Diagnosis and Therapy, Budapest, Hungary, 2004, 9-17.

Wells, Dagan , "Advances in Preimplantation Genetic Diagnosis", European Journal of Obstetrics and Gynecology and Reproductive Biology, 115S, 2004, S97-S101.

Wells, Dagan , "Detailed Chromosomal and Molecular Genetic Analysis of Single Cells by Whole Genome Amplification and Comparative Genomic Hybridisation", Nucleic Acids Research, 27, 4, 1999, 1214-1218.

Wen, Daxing et al., "Universal Multiples PCR: A Novel Method of Simultaneous Amplification of Multiple DNA Fragments", Plant Methods, 8(32), Null, 2012, 1-9.

Wikipedia, "Buffy coat", Retrieved from "https://en.wikipedia.orgJw/index.php?title=Buffy_coat&oldid=900992886", Jun. 9, 2019, 2 pgs.

Wikipedia, , "Maximum a posteriori estimation", https://en.wikipedia.org/w/index.php?title=Maximum_a_posteriori_estimation&oldid=26878808, [retrieved on Aug. 1, 2017], Oct. 30, 2005, 2 pages.

Wilton, et al., "Birth of a Healthy Infant After Preimplantation Confirmation of Euploidy by Comparative Genomic Hybridization", N. Engl. J. Med., 345(21), 2001, 1537-1541.

Wilton, L. , "Preimplantation Genetic Diagnosis and Chromosome Analysis of Blastomeres Using Comparative Genomic Hybridization", Human Reproduction Update, 11 (1), 2005, 33-41.

Wong, K. K. et al., "Allelic imbalance analysis by high-density single nucleotide polymorphic allele (SNP) array with whole genome amplified DNA", Nucleic Acids Research, vol. 32, No. 9, May 17, 2004, 8 pages.

Wright, C. et al., "The use of cell-free fetal nucleic acids in maternal blood for non-invasive prenatal diagnosis", Human Reproduction Update, vol. 15, No. 1, 2009, 139-151.

Wright, C. F. et al., "Cell-free fetal DNA and RNA in maternal blood: implications for safer antenatal testing", BMJ, vol. 39, Jul. 18, 2009, 161-165.

Wu, Y. Y. et al., "Rapid and/or high-throughput genotyping for human red blood cell, platelet and leukocyte antigens, and forensic applications", Clinica Chimica Acta, vol. 363, 2006, 165-176.

Xia, Tianbing et al., "Thermodynamic Parameters for an Expanded Nearest-Neighbor Model for Formation of RNA Duplexes with Watson-Crick Base Pairs", Biochemistry, 37, 1998, 14719-14735.

Xu, N. et al., "A Mutation in the Fibroblast Growth Factor Receptor 1 Gene Causes Fully Penetrant Normosmic Isolated Hypogonadotropic Hypogonadism", The Journal of Clinical Endocrinology & Metabolism, vol. 92, No. 3, 2007, 1155-1158.

Xu, S. et al., "Circulating tumor DNA identified by targeted sequencing in advanced-stage non-small cell lung cancer patients", Cancer Letters, vol. 370, 2016, 324-331.

Yeh, Iwei et al., "Knowledge Acquisition, Consistency Checking and Concurrency Control for Gene Ontology (GO)", Bioinformatics, 19, 2, 2003, 241-248.

(56) References Cited

OTHER PUBLICATIONS

You, Frank M. et al., "BatchPrimer3: A high throughput web application for PCR and sequencing primer design", BMC Bioinformatics, Biomed Central, London, GB, vol. 9, No. 1, May 29, 2008 (May 29, 2008), p. 253.

Yuan, X. et al., "Probability Theory-based SNP Association Study Method for Identifying Susceptibility Loci and Genetic Disease Models in Human Case-Control Data", IEEE Trans Nanobioscience, vol. 9, No. 4, Dec. 2010, 232-241.

Zhang, L. et al., "Whole genome amplification from a single cell: Implications for genetic analysis", Proc. Nat'l. Acad. Sci. USA, vol. 89, Jul. 1992, 5847-5851.

Zhang, Rui et al., "Quantifying RNA allelic ratios by microfluidic multiplex PCR and sequencing", Nature Methods, 11(1), 2014, 51-56.

Zhao, Xiaojun. et al., "An Integrated View of Copy Number and Allelic Alterations in the Cancer Genome Using Single Nucleotide Polymorphism Arrays", Cancer Research,64, 2004, 3060-3071.

Zhong, X. et al., "Risk free simultaneous prenatal identification of fetal Rhesus D status and sex by multiplex real-time PCR using cell free fetal DNA in maternal plasma", Swiss Medical Weekly, vol. 131, Mar. 2001, 70-74.

Zhou, W. et al., "Counting Alleles Reveals a Connection Between Chromosome 18q Loss and Vascular Invasion", Nature Biotechnology, 19, 2001, 78-81.

Zimmermann, et al., "Noninvasive Prenatal Aneuploidy Testing of Chromosomes 13, 18, 21 X, and Y, Using targeted Sequencing of Polymorphic Loci", Prenatal Diagnosis, 32, 2012, 1-9.

Zimmermann, B. , "Noninvasive prenatal aneuploidy testing of chromosomes 13, 18, 21, X, and Y, using targeted sequencing of polymorphic loci, Supplemental Information", Prenatal Diagnosis, vol. 32, 2012, 7 pages.

Allan, J. et al., "Micrococcal Nuclease Does Not Substantially Bias Nucleosome Mapping", Journal of Molecular Biology, vol. 417, Jan. 30, 2012, 152-164.

Beck, J. et al., "Digital Droplet PCR for Rapid Quantification of Donor DNA in the Circulation of Transplant Recipients as a Potential Universal Biomarker of Graft Injury", Clinical Chemistry, vol. 59, No. 12, 2013, 1732-1741.

Dawson, S.J. et al., "Analysis of Circulating Tumor DNA to Monitor Metastatic Breast Cancer", The New England Journal of Medicine, vol. 368, No. 13, Mar. 28, 20136, 1199-1209.

Diehl, F. et al., "Circulating mutant DNA to assess tumor dynamics", Nature Medicine, vol. 14, No. 9, Jul. 31, 2008, 985-990.

Gielis, E. M. et al., "Plasma donor-derived cell-free DNA kinetics after kidney transplantation using a single tube multiplex PCR assay", PLOS One, vol. 13, No. 12, e0208207, Dec. 6, 2018, 16 pgs.

Imielinski, M. et al., "Mapping the Hallmarks of Lung Adenocarcinoma with Massively Parallel Sequencing", Cell, vol. 150, Sep. 14, 2012, 1107-1120.

Lindberg, J. et al., "Exome Sequencing of Prostate Cancer Supports the Hypothesis of Independent Tumour Origins", European Urology, vol. 63, 2013, 347-353.

NCBI, , "dbSNP record for rs1294331", Retrieved from the Internet: <URL: www.ncbi.nlm.nih.gov/snp/?term=rs 1294331 >, 2019, 2 pgs.

NCBI, , "dbSNP record for rs1872575", Retrieved from the Internet: <URL: www.ncbi.nlm.nih.gov/snp/?term=rs1872575, 2019, 2 pgs.

NCBI, , "dbSNP record for rs2362450", Retrieved from the Internet: <URL: www.ncbi.nlm.nih.gov/snp/?term=rs2362450>, 2019, 1 pg.

NCBI, , "dbSNP record for rs2384571", Retrieved from the Internet: <URL: www.ncbi.nlm.nih.gov/snp/?term=rs2384571>, 2019, 2 pgs.

NCBI, , "dbSNP record for rs2498982", Retrieved from the Internet: <URL: www.ncbi.nlm.nih.gov/snp/?term=rs2498982>, 2019, 3 pgs.

NCBI, , "dbSNP record for rs3731877", Retrieved from the Internet: <URL: www.ncbi.nlm.nih.gov/snp/?term=rs3731877>, 2019, 2 pgs.

Shi, H. et al., "Melanoma whole-exome sequencing identifies V600E B-RAF amplification-mediated acquired B-RAF inhibitor resistance", Nature Communications, vol. 3, No. 724, Mar. 6, 2012, 8 pages.

Tynan, J. A. et al., "Restriction Enzyme-Mediated Enhanced Detection of Circulating Cell-Free Fetal DNA in Maternal Plasma", The Journal of Molecular Diagnostics, vol. 13, No. 4, Jul. 2011, 382-389.

Widlak, P. et al., "Cleavage Preferences of the Apoptotic Endonuclease DFF 40 (Caspase-activated DNase or Nuclease) on Naked DNA and Chromatin Substrates", The Journal of Biological Chemistry, vol. 275, No. 11, Mar. 17, 2000, 8228-8232.

Yung, T. K. et al., "Single-Molecule Detection of Epidermal Growth Factor Receptor Mutations in Plasma by Microfluidics Digital PCR in Non-Small Cell Lung Cancer Patients", Clinical Cancer Research, vol. 15, Mar. 10, 2009, 2076-2084.

\* cited by examiner

| | | |
|---|---|---|
| The sequencing-adaptor sequence is located inside the primer sequence and flanked by target specific sequence on both sides. 10 bases are target-specific at the 3'-end of each primer. Primers were tested successfully in real-time PCR. For sequencing this reduces the number of primer bases that need to be sequenced. | | |
| rs8130564 | int-tag 1.10 | AACTCACATAGCACACGACGCTCTTCCGATCTTGCAAGCACA |
| rs2832093 | int-tag 2.10 | TCCTCTGTGACACGACGCTCTTCCGATCTCCCTGCTCTT |
| rs12011281 | int-tag 3.10 | tcctctctctACACGACGCTCTTCCGATCTcGGGCTGTCA |
| rs6719561 | int-tag 4.10 | TACATCCTTGAGACACGACGCTCTTCCGATCTGCTGTGCAGT |
| rs10187018 | int-tag 5.10 | tttgcttgagctACACGACGCTCTTCCGATCTcgggagtttc |
| rs10460481 | int-tag 6.10 | gtcttatggtggACACGACGCTCTTCCGATCTcaaagccagt |
| The sequencing-adaptor sequence is located inside the primer sequence and flanked by target specific sequence on both sides. The internal tag is formed into a hairpin structure by 10 complementary bases on either end. This brings the target-specific ends of the primer into close proximity and hinders unspecific binding to the "internal tag". 10 bases are target-specific at the 3'-end of each primer. Primers were tested successfully in real-time PCR. | | |
| rs8130564 | loop-int-tag 1.10 | AACTCACATAGCtgatcggtACACGACGCTCTTCCGATCTTGCAAGCACA |
| rs2832093 | loop-int-tag 2.10 | TCCTCTGTGtgatcggtACACGACGCTCTTCCGATCTCCCTGCTCTT |
| rs12011281 | loop-int-tag 3.10 | tcctctcttgatcggtACACGACGCTCTTCCGATCTcGGGCTGTCA |
| rs6719561 | loop-int-tag 4.10 | TACATCCTTGAgatcggtACACGACGCTCTTCCGATCTGCTGTGCAGT |
| rs10187018 | loop-int-tag 5.10 | tttgcttgagcttgatcggtACACGACGCTCTTCCGATCTcgggagtttc |
| rs10460481 | loop-int-tag 6.10 | gtcttatggtgatcggtACACGACGCTCTTCCGATCTcaaagccagt |

FIG. 12

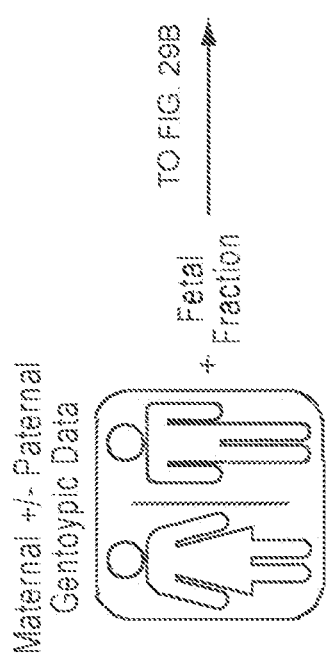
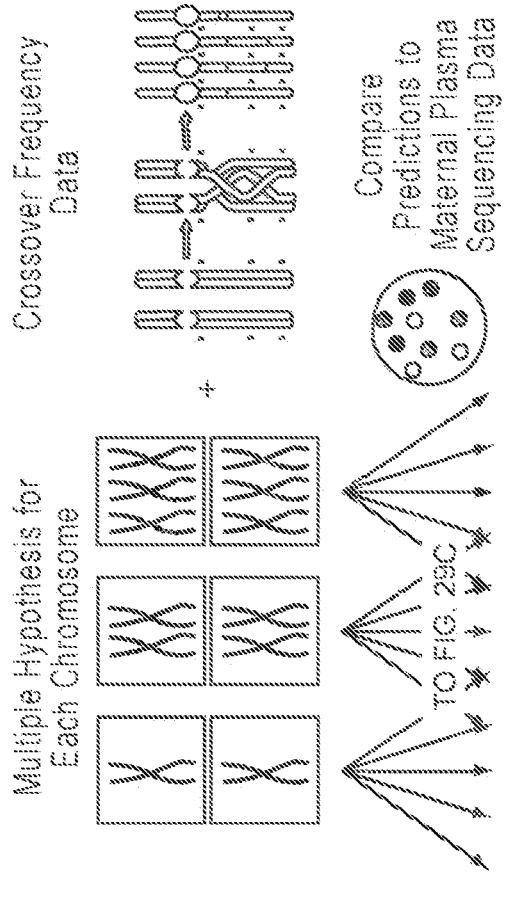
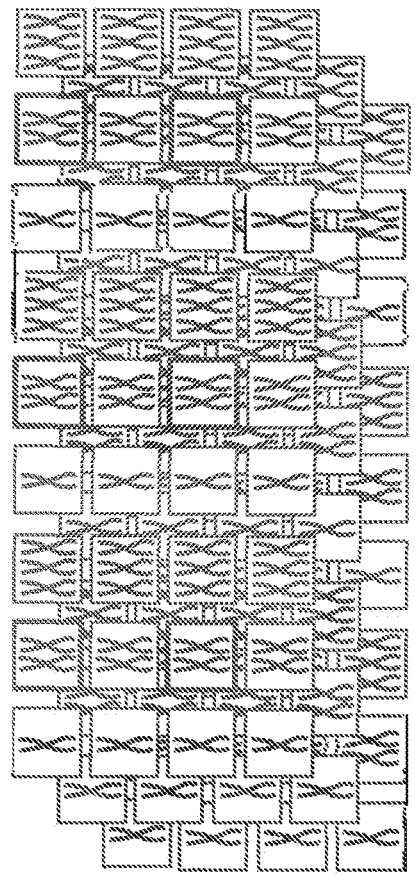
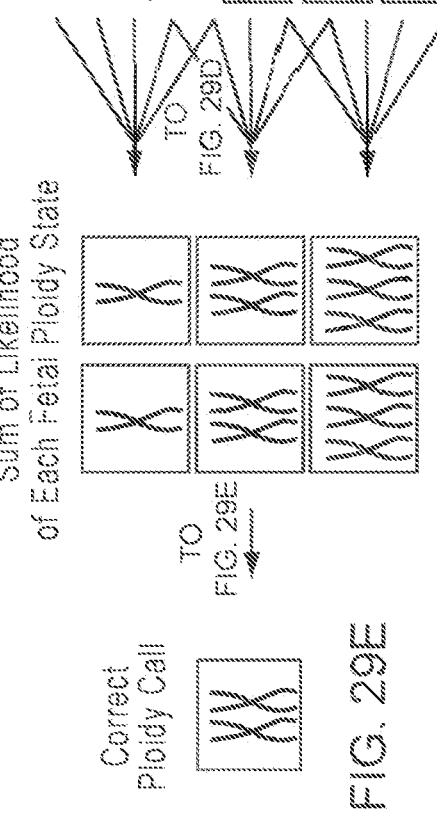
FIG. 29A
FIG. 29B
FIG. 29C
FIG. 29D
FIG. 29E

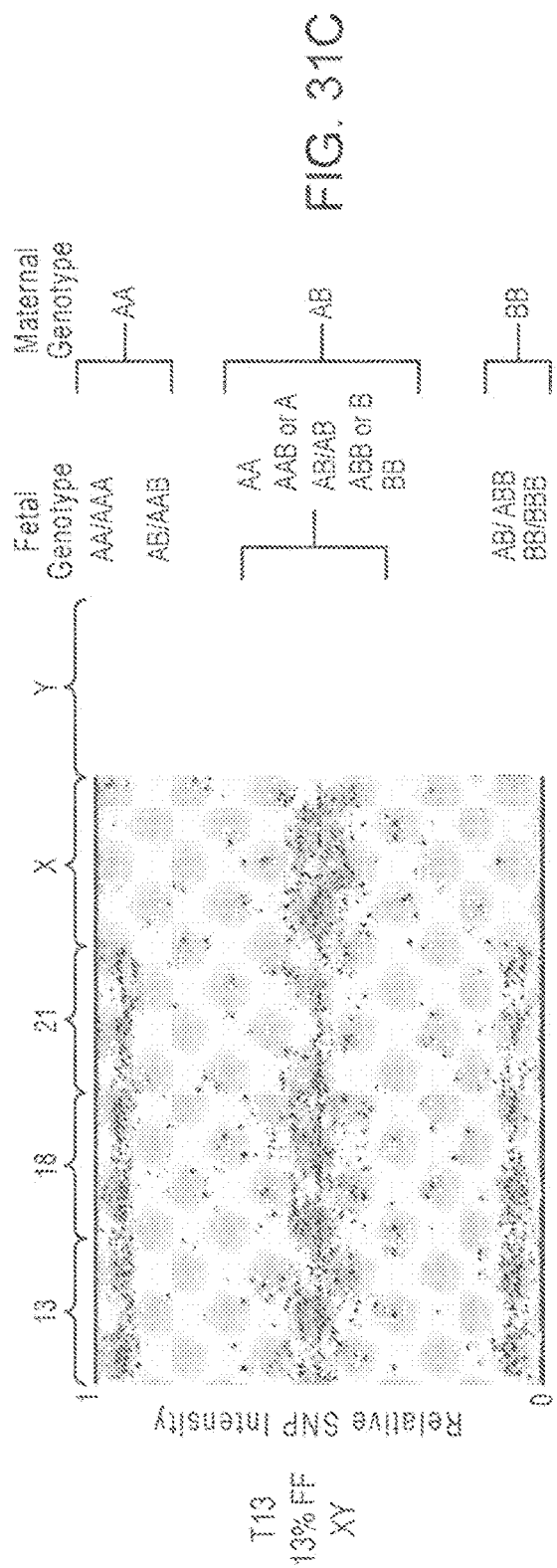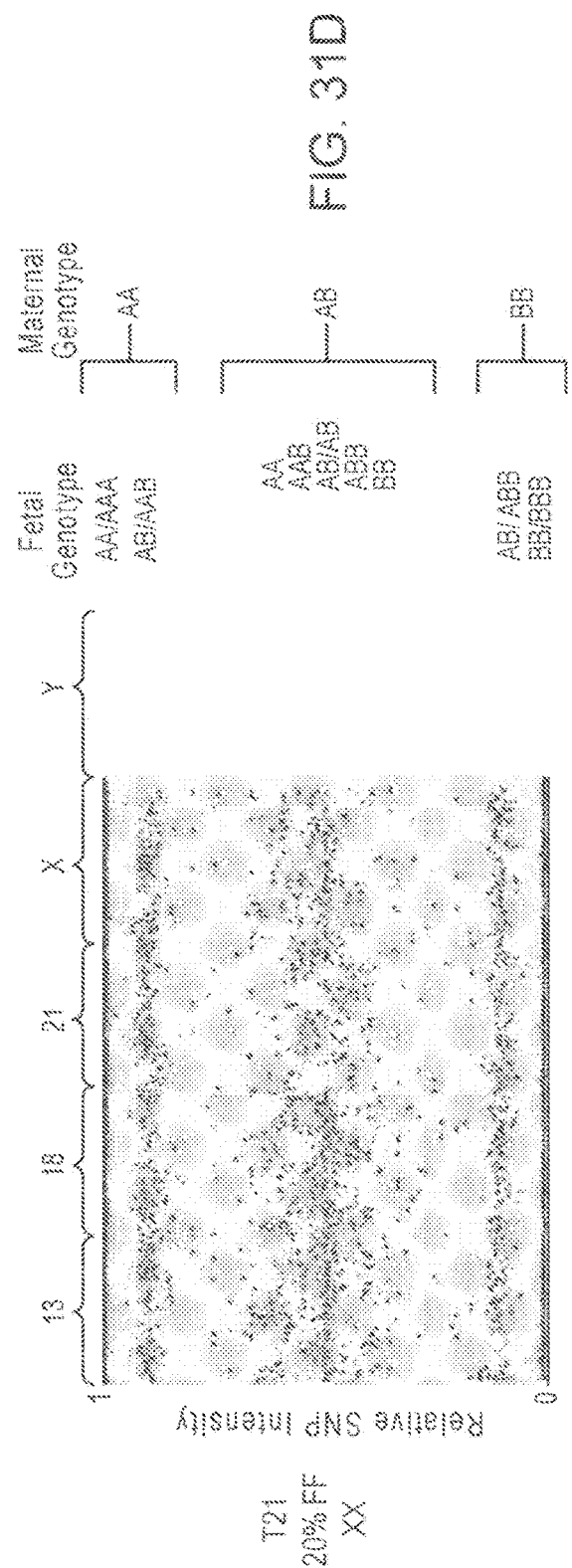

$$\Delta G = \Delta G_1 + \Delta G_2 + ... + \Delta G_x$$

| Target No. | Pool A Sequence (5' to 3') | SEQ ID NO. | Pool B Sequence (5' to 3') | SEQ ID NO. | Pool C Sequence (5' to 3') | SEQ ID NO. |
|---|---|---|---|---|---|---|
| 1 | GGCACAACSTTCKKAGBCAAA | 1 | CTCACTAAACTTTTCCCAGAACTCA | 1201 | GCTTAAGCCACAGAAAGGCACAAC | 2401 |
| 2 | CCTGGAACCTGAAAGCTTGCAAAAG | 2 | CCTCTGAAGGGAGACTGAAACAAC | 1202 | CGACTGCCCTGGAACCTGAAA | 2402 |
| 3 | ACAGGCTCCTCCTCTTGA | 3 | GCAAGAATCCTTGGCTGCAA | 1203 | AGCCACCACTCCTCCTTCTGA | 2403 |
| 4 | CGAGCAAACAGGTAGACCCTGGTA | 4 | GTGGCATTTCACTGCCCTTTG | 1204 | TTGGGGACCCCTGGACTAAG | 2404 |
| 5 | CTGAACAACAGGCTCCAGGAT | 5 | CCAGTTGTTCAATTGTCTTCA | 1205 | CCTGCCCAGTATCTTACCACTACAAC | 2405 |
| 6 | TGTCCTTGGTCGTATGTGAGACA | 6 | GTGAGGATGAGTTTTCAGTGGCTATC | 1206 | CACCAAGCCTCAACTCCTAAA | 2406 |
| 7 | GCACCAACTGGCTTCCCTTT | 7 | CCCTGGACAAAATGTAACAGCCAAAGT | 1207 | GAACTGAAGAAAATGGCACCAACT | 2407 |
| 8 | AGGTTTCGGCTTAGTTGTGTGA | 8 | ACCTAGCTATCCTTCCAGCATTTC | 1208 | GCTGCTATTGTTTTCGGCATACAGCTT | 2408 |
| 9 | TGTCTGGTTCTGCCGGCATTC | 9 | GCTGGACAAACTACTGCCCTTC | 1209 | GTGGGAGCAAATTAGATCTGTCTTCT | 2409 |
| 10 | GTCCCTCACACCTTTCTACCAGAAG | 10 | GCCAATAGCTCCTTGATGCAAT | 1210 | GGGGAAGTCCCCACACCTTT | 2410 |
| 11 | GGCTGCAGCAGTAGCCTCTAAATG | 11 | TAGTTGCCCGGGATTCCCAAGA | 1211 | TGGGTCTGCTGCAGGACTA | 2411 |
| 12 | GGCAAGAAGAAAACTGGAGCCAAGA | 12 | GGGAGAGGCTGGTCCTGAGT | 1212 | CTGAAGCCAAGTGGCAGAAG | 2412 |
| 13 | GAGCCTGGTTCTTGATCACTACA | 13 | GCTTTGTGAAAGGTCAATGTGAGCAA | 1213 | AAGTCCTGAGCCTGAGTTCTTC | 2413 |
| 14 | CCTGGAAAAGCCCCGGTAGA | 14 | GTCCTCGGGAGCTCACAACCTTA | 1214 | TCTCAGGGTGCCTGGAAAAG | 2414 |
| 15 | GCAATGGTCCAGTGAGAGTT | 15 | TCCCACTGATCCCAGACCAA | 1215 | CCCACTGCAAAGGAGACCCTATTG | 2415 |
| 16 | GCCCTTTCGGAACCTGACCAA | 16 | CCCAGCTTAACCAAAATAGCGCAAGTA | 1216 | TGGGAACCACCCCTTTCGGAA | 2416 |
| 17 | GGCCTTGATTTCACCCTTCTTTTC | 17 | TGGCCAGTAGTAAGTTGAGAAGACTA | 1217 | GGCTTCACTATCAAGAAGCCCTTGATTT | 2417 |
| 18 | GCACCCGTTCTGAAACACATC | 18 | TGGGAAGCTTCACCTTCTGT | 1218 | AAGAGCCGACCCCCTTCT | 2418 |
| 19 | TTGGCCTAAAGCCCAAACA | 19 | GGAGGGAGAGGTCCATCTCTGA | 1219 | TGGACCAGGCTGCCCCTAA | 2419 |
| 20 | CCTTCCCCGCTTCTGGATATGAAA | 20 | CCGGCAATAGGACTCAGCAA | 1220 | CCGAAAACCTTCCCCGCTTCT | 2420 |
| 21 | GTCAGGCTTTACGGCTATTGAGT | 21 | TACGGCAGGTGTCCTCTGCAT | 1221 | GGAAGGGAATTTGTCAGCGTTTA | 2421 |
| 22 | GCATCTCCAGTGGCTCTGT | 22 | GTGAACCAAGCTATACTACCTGCTTTC | 1222 | GCAGTCTCACCCTTCCTTTGCAT | 2422 |
| 23 | CATCTTCCTAGACATGCACAAC | 23 | GGCTTCTGTGCTCATAGTTCACACT | 1223 | GTTGGGAAGCATCTTCCTAGACAT | 2423 |
| 24 | GTCCCAACTCAACTCCATCT | 24 | GGGCACACGGAGGTGAAAAGT | 1224 | GCCTATTTTGGAGTCCCAACTCAA | 2424 |
| 25 | GGGTCACCACAGCTAACACA | 25 | CGGGAGCCGTTATACCAGCTTAG | 1225 | TGGCCCACGTTGCCTACT | 2425 |
| 26 | TCAGAATGGGAGGCAACATTCAA | 26 | GCTTCCTATGACCAAGTCCCTTT | 1226 | CACGTTATTACTAGCTTCCTCTGACAATG | 2426 |
| 27 | CGTAAAGCTTGGTTGTAAAGCTCCACAT | 27 | GTGTTGCCCAGACCCACTGT | 1227 | ACTGGGGTAAAGGGCCGTTGT | 2427 |
| 28 | CCCGACTCAAACGGGAACTCCTACT | 28 | GGGCACTTTTGAGTTGGGCTTTG | 1228 | AAGCCTCGTGGGCGACTCAAT | 2428 |
| 29 | TCCTTACACCTTGGGGGTCTA | 29 | GCAGCTCGGTGCCTAATGGTT | 1229 | AACAGGGCGTCAGTTTTCGTT | 2429 |
| 30 | GGGCATTCTAAGACACTTGGACAGT | 30 | CAGACCTGGCAGGATCAGAATACT | 1230 | GGAGACCCCAGCCCATTTCTAAG | 2430 |
| 31 | CACTCTATCTCAAAGGGCAAAACAA | 31 | TGCAATGCAGAGGAGAAAGGTT | 1231 | CAGCCTGCTAGGAACACACTGTA | 2431 |
| 32 | ACTTGTCTCTGCAGACAGTTTCA | 32 | AGTCACAGGTATCCTGACTCTCATA | 1232 | GGTGATTCTGGCCGAACTTGTCT | 2432 |
| 33 | GGGCTCTTCCTGCCTCTCTT | 33 | GGAGCAATCAGCCCTTGCACAGA | 1233 | TGGATGCAAAACGCAGACTCA | 2433 |
| 34 | GCTAGAGAAACAAGACAACATCCAAGTTC | 34 | TGGCGCCCGGAAAACCAT | 1234 | CCTGAGACCCTTTGTAGAGAAACAAG | 2434 |
| 35 | GGGGGCATAGAGAAGGAAAT | 35 | TTCAAGAGCATCCTTGCGCTAT | 1235 | TGGGATGCGGGCATAGAGA | 2435 |
| 36 | GGCTTCAGTCCTTCACTCTTTC | 36 | ACCTTGAGAAGGTGCTATTGTGT | 1236 | TCTCCCAGGCTTCACTCCTT | 2436 |
| 37 | TCAGAGTCTAGCCCAGCAT | 37 | AGAAAGACCCAGGTAAGAACCAT | 1237 | CCAAGTTGTGCCTGCTGCTCAGA | 2437 |
| 38 | GCTTCCTCATCGAAGACTGTTTG | 38 | GACTCACACATCCACAGGAGACA | 1238 | GGGAACCTGAAAGACCCTTGCTT | 2438 |
| 39 | GTTGGAAGGCAGTAAGATCAGACAA | 39 | GACCCAGTATCCCACAGCCATT | 1239 | GGTGGGATACTTGAGAACCCAGTAA | 2439 |
| 40 | CTCCCGCTCTAAATGAATGCAT | 40 | ACCAGCTCTGAGTCAGGAAGT | 1240 | CCTTAGCTCCCGCTCTAAA | 2440 |
| 41 | CATTCCCTCCCTACCCTGGAAA | 41 | CCCAGAGTCGACGAGTGTTTT | 1241 | GGATGAGCATAGCCAGTGGTTCA | 2441 |
| 42 | GAGACTCAATCCTGCCACTTCT | 42 | TCACTCCACTTTACAGGCACATATT | 1242 | AGGACTGAGAAGCCAGACTCAATC | 2442 |
| 43 | CCCGGCTGCCATTTAAGACCAT | 43 | ACGAGGATCAGACAAGTCACAGA | 1243 | TCAAGTCCCGCTGCCATT | 2443 |
| 44 | GATCAGGCTGACTATGGTCAAG | 44 | CCCATGACCCAGGTTGGAATTG | 1244 | GCAGAGAGATGAGGCTCAGT | 2444 |
| 45 | CCCTTCCTCAACCCTTCATT | 45 | CACTCTGTGCACTTGCTGGTT | 1245 | AATTGCCACTTGTATTCTCATTCT | 2445 |
| 46 | AGCACTACCAAAGAAGAGACAAG | 46 | GTCCTTCCAGGCACACCTTGAA | 1246 | GCAGGAGGATGGGAACCAAG | 2446 |
| 47 | CATCACTACCCACAATAGGTTTAACT | 47 | GGCTTTCCACTGAGCCATGA | 1247 | GCATCAGGATGGAATTGGCTCATCA | 2447 |
| 48 | GGAGCTCAGTATGACTAGAGGGGAAA | 48 | CAGGCTGGTTGGTTAGATTCTGT | 1248 | GACCTTCAAGGGAGCTCAGTAT | 2448 |
| 49 | TTGTGCACCACGCTGGAATG | 49 | CTTATGTGTGGCTTTGCCTTGTG | 1249 | TCTGATATGCAACCCAGGGATTCT | 2449 |
| 50 | TCCCTAGCCCATTGCTCCTGTT | 50 | GCCCCTGAATCAGACAAGGAA | 1250 | TGCAGCATCCTAGGCCATT | 2450 |
| 51 | CACCGACACCCTTAGTAACGTTGGAT | 51 | CACAGCTTGAAGGCCTGAA | 1251 | GTCAGTTCACACGACACCTTAGA | 2451 |
| 52 | TGGCACAAGCCACGGTCAT | 52 | CTCATCATCTCAAATGCTGCTCAA | 1252 | AGCCTGCAAAGCTGCACAA | 2452 |
| 53 | GCGTCCTGTGCTGTCTGAACCAA | 53 | GTTCTGCTGACACAAACCTTCT | 1253 | TTCCCAGCCTGCTCTGCTCT | 2453 |
| 54 | TGCAGGCATGGTTCACGTT | 54 | TGAGCAGCACAGTCCAATTCT | 1254 | CTCAAAGGGGAAGAACCTCAGT | 2454 |
| 55 | TGGTAGTCAGCCTAGTGACTT | 55 | CCCCTGGGAAAGTTACTGTGGAT | 1255 | TCTGCTGCTCACTTGCTGGTA | 2455 |
| 56 | CAGGTCTTCCAAAGGCTATTCAGA | 56 | GTCAGTGAGCTGCCAGTTTTC | 1256 | AGGTGACAGAGTGTCTTCCAAAG | 2456 |
| 57 | CCTGAGCCCTGCACAGTATTCT | 57 | TCCCAAATCCTCAGGCTGTCA | 1257 | TCCCAAATCCTCAGCCTGTCA | 2457 |

| | | | |
|---|---|---|---|
| 678 CCTTAGTCCTACTTTTTCCCTTGCAT | 678 GGATCCAGACGGCAGGAATG | 1878 CATGCCTATCTCCCTTAGTCCTACT | 3078 |
| 679 GACCTTGCAACAACGGAGTCA | 679 GGACAGAGAATCAGGTCACGGTAT | 1879 AGTCAGCTCAGGGCTGACCTT | 3079 |
| 680 GACTGCCATCTGGCATTGAGAAC | 680 ACCTCGGCCTCAGGACTTCT | 1880 CCACAGCACTGACTGCCATCT | 3080 |
| 681 AGCCCCTCCTGCTTTTTCA | 681 TGCTCACAGCCTCGGAGATACT | 1881 ACATCCTGAAGCCAAACCTCTA | 3081 |
| 682 GCCAAAAGTGCAGACTTATTTCAGT | 682 AGCAGTCAGCTGCTCCTCCTT | 1882 CAGAATAGCACACAGTGTCACAGA | 3082 |
| 683 TATTGGCCGCCAGCACTGT | 683 TGGTATGGGCGGCAGTGA | 1883 CCACATCCTCCCATAGGAGCTA | 3083 |
| 684 CACCCCCTACTCACTACTTTCT | 684 CCCACCTCACACAGCCTCAT | 1884 TAGGCAAAGAGCGCCTAGT | 3084 |
| 685 GAAGCCAAGTTGGTGCAGGAT | 685 GTGTCCAGTCTCCTTGAGTCATTTG | 1885 GGAATTCGTAGCTAAGAAGCCAAGT | 3085 |
| 686 GAGAAGGGAGACATGCATGGCTTT | 686 GGAGGCATGCCCCATCTCA | 1886 GCTCCCAACCCAGAACACT | 3086 |
| 687 GGCACCCCTCTCCATCTTTA | 687 CTCCTGCTTCTTGCCACTGT | 1887 GGCATTCCAGCACTGACCTAG | 3087 |
| 688 TGAATGCTGCCCAATTGTGT | 688 GGGCAGTGATAGAACTGACATTTG | 1888 CCATGGGCACAATCCAAGCCTAT | 3088 |
| 689 GCCTTTCTGCAGGTACTTGAGCTTAT | 689 GGAACGTCAGTGGTCAGCTT | 1889 GGGGCCCTTTCTGGAGCTA | 3089 |
| 690 GCACTCTCCACTGCTCTTCTTC | 690 TGTCACCCTCTCTCCTCATAACT | 1890 AACGGCACGTGAGCACTCT | 3090 |
| 691 CTTCAGCCACAGCCAGAAATGT | 691 GTTCCATCCCAAGGACACAGA | 1891 GTGGTTCGTTTCACCTACTTCTTC | 3091 |
| 692 CTGCCTTGGAACAGAAACCATGACT | 692 GGGACTGGACCAAGAAGGGTATG | 1892 GACTCCTGGCTTGGAACAGAA | 3092 |
| 693 AAGCCTTGAGACCTCCTTCT | 693 CCATCGCACAAGCTCAGCAAAC | 1893 GCAAAGATGACATAAGCAAACCCTTCA | 3093 |
| 694 GCTGCAGTGAGCCACGAT | 694 GGTCTCGCTCTGTCACACCATT | 1894 GGAGTATGACTTTAGCACTGCAGTT | 3094 |
| 695 TGCCTGCAGCAGAGTGAACA | 695 GCTTCCCCGTGACTGTCTCCTAT | 1895 AGGATGGGTCAGGCCAGTGT | 3095 |
| 696 CCGCCATCAGGGGTTGATGTAA | 696 GAGAGGGTACTGGTAGAAGCATTTC | 1896 TCCAAGCCAAGGGCCATCA | 3096 |
| 697 AGGGATCCAGGGCCATCTTCA | 697 AAGTGTGGGGCCTCCTAAG | 1897 CCTCCACTCTACCAAAGCTTATAACA | 3097 |
| 698 AGTCAGCAGGCTGGAAAAACT | 698 GCAGCTGCTCTCTCTGCAATTC | 1898 TACGCTGACCACCCTGCACAT | 3098 |
| 699 CTGTGCAGGAAGCAAGGTAGAT | 699 CCTTGTCCTGTGCATCTCTGT | 1899 GTGGGTACTACTCTGTGCAGCAA | 3099 |
| 700 TGCAGTCAAGGTGATACTTGCTTCTT | 700 CAAAGGCAAAAAGTGGCATCTGT | 1900 TGAGGCATTTGAGTCAAGGTCATAC | 3100 |
| 701 ACCTATAACAAAGGGGAAGTCAGGAT | 701 GAGCCTACCTCTCTGGACTTCA | 1901 TGCCTGGGTTAAGGCGCATA | 3101 |
| 702 ACCTTCCCCACCATGTTCTACA | 702 GGAAAACCCTCTGAGCCTCACATT | 1902 GGGAACCTTACTGATCACTACTACAAAAC | 3102 |
| 703 CACATGCCCAGTAAATGGAACAAA | 703 CGGCCCCTTAGCTTGAGTTAGT | 1903 CTCCTGACACATGCCCAGTAAA | 3103 |
| 704 CACCTGGAAGCTGAAGCCAAAG | 704 GAGGCTGCCTAGAGAGACAGA | 1904 AGTGTGGGGCACCTGGAA | 3104 |
| 705 AGTGGGCAGCGCCCCTTAT | 705 GGCCACGCATGGGCATTTG | 1905 ATGTCGGCTGGAGGTACAGT | 3105 |
| 706 AGCCCTCCTGCCTGGACAA | 706 GGGGGCTCGCGTCTCTGTTT | 1906 AATACTGCCTCCCCGGACTACA | 3106 |
| 707 CTTGGCAAACTAAGTGAGCGCAAAG | 707 CTCTCGGATGTCCTGGAACTAC | 1907 CACTGCACCAAAGGCTTTCAAC | 3107 |
| 708 GCAGCTTTTCCTGGTGTCTTC | 708 CTTCGAGAAAGGCTTGGAGATACT | 1908 CTCAGCTCTGTGCCTGGATAATG | 3108 |
| 709 GGGGTGGTTAAGTATGGGCTAGCAA | 709 TGGCCCTCAAGGAGCTGTA | 1909 CTGATGAATTGCTGGGGTGGTTAAG | 3109 |
| 710 AGTCACCATACAGCTTCTCAGAAAT | 710 GCACCCAGCCAGCAATTGATA | 1910 GGTTTAGCTCCTCCATAGTCAGCATA | 3110 |
| 711 GGATCTAAGCAGTGCATCTCTGT | 711 CCCCGATTCTGCGTTTGCTT | 1911 CGGGTTCTTTCTTGCAGGGCATCT | 3111 |
| 712 GGTGACTGTGCACGCGTTAAT | 712 AGAACCCGGTCCACATGCTAAC | 1912 AGGCTTCCCTGGTGACTGT | 3112 |
| 713 GCTCAAGTACTCCCTGCCTTCT | 713 CCAAGCCCCTCCTCTCTCTAAG | 1913 AGAGCTCCCAGCCTCAAGTA | 3113 |
| 714 CACGGATCTTCTTTGTTTGAAGGAGCTT | 714 CACAGGCAGTTAGGGTAGGTTCT | 1914 CTGGGGCCTTGAGTTTGATT | 3114 |
| 715 GGCAGACAAATCAGCCCAGTT | 715 TCCCCCACGATGGCAGTGAGTT | 1915 GCAGCCTGATCTTGGCAGACA | 3115 |
| 716 GTGATTCAACTGCCCTTGCAT | 716 TGGCACGAATATGCTGCACTGTT | 1916 CACCTCGACTAACCATTAATTACCTCAT | 3116 |
| 717 GGGACTACAGATAAGCCACCACTGT | 717 CACTCTCTCAAGTTTTGCCGTCTT | 1917 TCTCACCTTAGCCTCCCAAGCT | 3117 |
| 718 CAAAGAGGCCCTCATGCTCAGT | 718 GCAGGCATGACAGACTTTCCTT | 1918 TGCCTGCCCTCCTTCCATGAT | 3118 |
| 719 TTCCTCCTACAACCAACCAACT | 719 GCCTTCCCCATCCCATCTCTAAA | 1919 CCCAGGACTGTATCTTGCTCCTACA | 3119 |
| 720 GCCAGAGATCAATGGTTTGCGAATG | 720 TTGCAGTGGACGTCTTCCTATTTC | 1920 GGGGTTTTGAAGCCAGAGATGA | 3120 |
| 721 CCTGTGCTATAGAATCAGCACTCT | 721 CAGGGCTCCCTCCTCGATTT | 1921 CCATATGAGCTCTCCCTGTGCTA | 3121 |
| 722 TGTCTCTTGTCCACAGGCACAT | 722 CAGCACTCAGTTCATTCCCTCAAAAA | 1922 GGGTCGTCGCACAGGCACTT | 3122 |
| 723 GAAGCTCCTTACATTAGTGCCAGCTT | 723 GCCATAGGAGAGACCCTGAATCT | 1923 TCCTCTTCTGGAAGGCTGGTT | 3123 |
| 724 TGCACTCACAGGGAAGTTAAAACA | 724 GACTGCAACAGAGGCTGACCTA | 1924 TGTAAAACAGGAGGATGCACTCA | 3124 |
| 725 CCATCAAACTTCAAGCACTTACTCTCA | 725 TGCCCTGCCTGCTCTTCT | 1925 CCTCCTCTGAGGATCAAAGTTCAAG | 3125 |
| 726 CGGCCACCAGCATTTGAGTCTTG | 726 CAGCAGAGACCTGATAGCCCTATGT | 1926 GGAAAATCGCCACCAGCAT | 3126 |
| 727 CGGGCCAAGAAGCTAGCAA | 727 GCCAACAGGTTTTCTGGTCTGGTT | 1927 AGCAGCAGTCAGTTCCAGCTA | 3127 |
| 728 GGGCTTTCTGGGCCAATGAA | 728 CCTCCTCCTCCTCCCATCCAAA | 1928 GGTCAATCGTTACCCGGCTTTC | 3128 |
| 729 GCCACAGGTTGGAGGCAAGA | 729 CTGGAAACGGCCCCAGAGT | 1929 GGCTCTCTTGCCACAGGTT | 3129 |
| 730 AGTGCCCTCCTCAACCAATAC | 730 TGGTGGCGACATTTTCCTGAAG | 1930 CACGCCCAGAATCAAACCAAAG | 3130 |
| 731 TCCCTCTTCTTTCAGCTTTCT | 731 CTCGTTGCAGTGTGGAGCAT | 1931 CCTCTTACCTCTCCCTCTCTTTC | 3131 |
| 732 GGAGGCTCCATCCACAGTGA | 732 TCAGATGTCAACCCGCCTAT | 1932 ACACACCCACAGCTTCTTC | 3132 |
| 733 GGGCAAATCTGTCTCTCAGATA | 733 CGGCGACTACTCGAGGCTTT | 1933 GGCTGCAGGGCAAATCTGTGT | 3133 |
| 734 CCGTTGCAGCGTTCAGTGTCGCATT | 734 AGCAGCCCACCAGTTCTCAGG | 1934 CCCATCAGGCACGGGTGCAGGTT | 3134 |
| 735 CCTAGCCTACAAGGGCACTT | 735 TGGCCTGCCTCACTTCCTTA | 1935 TCACTAAGTAATAAGGGCTAGCCTACAA | 3135 |
| 736 GAGTACTGAGCCAGGGAACGTTT | 736 TCCGGAAGACACGAGACGAAA | 1936 TCGTCGAATGTCAAAAGCACAGAGT | 3136 |
| 737 CCAATGACTTCTACAGCTCACATTCT | 737 ACATCCGTTTTGACTCAGCCATT | 1937 CAACCCGATAAGCCCAATGACT | 3137 |
| 738 GAGCCCTGTAGTCAACTGTGT | 738 GAACCTTGGCTCTTTGCAAGTCATC | 1938 CCTGAGGTGAGGGGTCCTAGT | 3138 |
| 739 AATGCCAAGGGACCCTGGAA | 739 TGACTGACTGGGCCTTCAGA | 1939 GGCATGGTCTTCAGGGAGAGTTAC | 3139 |

| | | | |
|---|---|---|---|
| 864 GGCCAACAGAACTAACATCCATTAC | 864 CCCCTCAGCCTGTATGTCTCT | 2064 AGCACAGCCCAACAGAAGTAAC | 3264 |
| 865 TCTGCTACAGTCTTTGCGTTCA | 865 CCCTTCCTAAGTGCCAGAGAAAC | 2065 GGGCCAACATCTAGTTCTGTTACA | 3265 |
| 866 TGACCTTTTCAGCTTCCGTTCT | 866 AACCTCACTGTTGCGTGAGT | 2066 GAGAAAGCAGGTACTGACCTTTTCA | 3266 |
| 867 TCCAGGACCAAAGCCCTCAT | 867 CCCTGCTCCCACAAACTCTTTA | 2067 CCACTCTCCATCTCCAGCAGCAA | 3267 |
| 868 GTGACACCTCTGCCTTTGCATCT | 868 CAGAGTAGGATTAGCCACTTCAGTAAG | 2068 GGCAAGGGCATCATAGATTTACTCACA | 3268 |
| 869 TCTGGGATTTCAGCATGCAACTT | 869 GCTGGGAGACTCTCCCTCTCTAT | 2069 CCCCACCTCTTTCTGGCATTTG | 3269 |
| 870 CACCCTCTACTAACACCACCAACT | 870 CCTCAATCCAGGGCCAGTCTAT | 2070 AGTGGCTGAACACCCTCTAC | 3270 |
| 871 GGTCTAAGACTAGGCTCCCTCTA | 871 AAAATTCTAGCCCCACCCATGT | 2071 CAGCCTAGTCAGGGTGTAAGGCTA | 3271 |
| 872 GGGCCGTAGTGAATCTCCAATG | 872 GGGAGTTTACCGCTAAGATGTTTTC | 2072 GGGTGTGGGGCCTAGTGAA | 3272 |
| 873 ACCACCACACTCCCCTTCTCT | 873 CCCTCAGGTCCATCACTTTGT | 2073 GCACAGGCACCACCACACT | 3273 |
| 874 GAGAGGTCAAAGACAGGAGACTCAATC | 874 AGGGCCCACTGTCACATGCAT | 2074 CCTGCATACCGAGACAGTCAAAG | 3274 |
| 875 GGCATAGCTCACATGCCATCAGA | 875 GCGGTAGGCTGCCTGAACA | 2075 GCGCCATCTTTTCGAGGCATAG | 3275 |
| 876 CACACAATCGAACTACCCCTGCAT | 876 TGGCTTCCCCGACCCTCTGT | 2076 GGAAGGTTCTGACAGACAATGGAACT | 3276 |
| 877 CGCCTGAGCTTAGACTTCACCTACA | 877 CATAGCACTGGGATCAAGAAAGACT | 2077 CATCTTCCACCCTGACCTT | 3277 |
| 878 TCCCCACCTGGAGCCCAAAAT | 878 GTCTCTTCACTCCAAAGCACAAG | 2078 GCTCATGGGCAGGGTTCACTT | 3278 |
| 879 CTCTCCAGACTTGTCCCCAACA | 879 AGGGACCCTACAGCACACCAAA | 2079 GCACAAGCACTGTCCACACT | 3279 |
| 880 AGGAGACAGTGCAAGCTTTTGT | 880 CTGCTGTTGGACCCTAAACACT | 2080 CCTTCTATCAGTAGCAAGGAGACAGT | 3280 |
| 881 TGCACTCACTGTTCTCCAAGTGA | 881 TCAGGGTTTCCTGTCCCTCTT | 2081 AGCGGGTTGGACTCACTGTT | 3281 |
| 882 GCCCTGCTCAATGCACATTTTG | 882 TTGCATATTGTTTCTCACCCCTACA | 2082 GGCTAACTCAGCCCTCCTCAATG | 3282 |
| 883 TGGCATCGAGGATGGCATGA | 883 GGCCCCACCTCGTCACTATG | 2083 GTGCAGACCTACATGCCAGTCA | 3283 |
| 884 TCCTGTTTGTTATGGCAACCAAGT | 884 GCTACAACGCAACTTCACACA | 2084 CCGCCCATCTCTCCTGTTTCTT | 3284 |
| 885 GCATCCAGCCGAAATCCTCACT | 885 CCCACCCTCAGCCCTTCACTTC | 2085 GGGCAACAGCTGCAAAAGCAT | 3285 |
| 886 TCCTCCCTGAGACCACAGCTT | 886 TTGGTGGCGCCCATGAGTCT | 2086 AGTCTGCCCTGTCGTCTCTGT | 3286 |
| 887 CCATCACCCATTTACCCCTACTTG | 887 TTGAAAGCCTCGTGCCATTTG | 2087 AGGGACCCCATCACCCATTTAC | 3287 |
| 888 ACTCGCTGTCAGGCTTGCTT | 888 TTTAGCTGGGATGTGAATGTGTCA | 2088 GGAACTACAATACACATAAACTGGCTGTCG | 3288 |
| 889 GCACGAGATGAACTAAGACACCATT | 889 CACATAAGGGAACAAGCGCACAA | 2089 TGTTTTAGCAGCACGAGATGAACT | 3289 |
| 890 GAGGGAATGGTACCTGGATTAGCAA | 890 CCTCCAACCTAGACTGGATGTCA | 2090 AGGGCAAATGGCAGGAGGGAATG | 3290 |
| 891 TGCCACTTCACCCATACTGAATTT | 891 CACTTGGTCGTGGGTTTTCAGA | 2091 CAGATTACAGGAGCATGCCACTTC | 3291 |
| 892 CACACTGCCACCTGCTTGAGTA | 892 TGACTGCTGACACGGGAGCAAT | 2092 TGCTTTCGAGAAAAGCCACACT | 3292 |
| 893 TGATGAGTGGAAGCCCATGTTG | 893 TGGTGGCGAGGGTAGAAGAT | 2093 GCAGCGGGTATAGACAGATCCAA | 3293 |
| 894 TGCTCATCATGGCTATGCTTTCT | 894 ACTCACAGTAATCCAGGGGAAAAG | 2094 GCACTGCCTCTGCCTCAAAA | 3294 |
| 895 GCTGATCCAGAGATGGACACAA | 895 CTGCAAAAATACCAGGGAGGAACT | 2095 TACCACCAGGGCTGATCCAGAGA | 3295 |
| 896 GCAGTGCTGTGTATGCCAATG | 896 ACTCTCACACCCTTAGGCCTTT | 2096 GTGGTCTCCAGTCACATCTTCA | 3296 |
| 897 GCCAGATCTGGAGTTAACAAGTCA | 897 ACCGCGCCCCATCACTTACT | 2097 GTCCATCAGCCAGATCTGGAGTT | 3297 |
| 898 TGACTTAACAGGTGACCTAGACACA | 898 CTGACCCTGGGCAAATGACTCT | 2098 GGGTCTCTCGCCTGACTTAACA | 3298 |
| 899 CCTTGGAGCCCAGCAACAA | 899 CGCCACCGACTAATGCTCTT | 2099 AGAGGTCACCCTCAAGCACTA | 3299 |
| 900 GAGCCACTGATTCATTCAACAGGATT | 900 TTGGCTTTGTATCTCCAGCAACT | 2100 GGAAAAAGTCCAGCCACTGATTCATTC | 3300 |
| 901 CCCATGGTAAACTGCTGTAAGTA | 901 CATCGGCACCGGGTTATGTTTTC | 2101 AGACAATAGTACCTCCCATGGGTAAA | 3301 |
| 902 CAGGGCCTCAAACACCAAGAAG | 902 GAGGGCAAAATCCCCACCTAA | 2102 GCACAGCCACCCCTCAAACC | 3302 |
| 903 GGGGAGAAGTGTCACCAGATTCA | 903 CCCTGCCCTTCTCACTCACAAA | 2103 TGAGTGCGTGCGGCTGCAGA | 3303 |
| 904 GCGGGTTAGGAAGATTCCCTGAAG | 904 CATGCATGACCCTGCTCACTTT | 2104 GTGGGAAGCGGGTTAGGAAGAT | 3304 |
| 905 CTTCCTCACCCCTCCTTAATAACA | 905 CGGGTCCCTTAACTTCTCCTAAAG | 2105 GGGGACAGCTTCTTGGTCCTT | 3305 |
| 906 GGTGCTTTCCTTTGCACCGAAGT | 906 GGAGTTCTGCACTTGTGATGTTC | 2106 CCCTTGTGCTGCTTTCCTTTC | 3306 |
| 907 GGGAGGACAGTGATCTGAGCAT | 907 GCGTCCAAGGCTGGGTAAAGA | 2107 AATTTTCAGAGCAAAGGGAGGAACA | 3307 |
| 908 CAGCAATTAAACACCCCTTTCACCCATT | 908 CCCACCCTGGGTATGTCTTG | 2108 GCACCACATGCTCACAGCAA | 3308 |
| 909 CACCGAGCACTCGGCTGAATAA | 909 TCAACTTGATTGTCTCCACACTCTA | 2109 AGTCCACCTCGCCCGTAA | 3309 |
| 910 TTGATGGCTCCCATGTAAGTTTGA | 910 GGCGGGCCATCCCAGTATAATTT | 2110 TCCTCAGGTTGTTAGGCATTTTGA | 3310 |
| 911 CCAACAAGCAAGACGGCACTAAG | 911 CTGGGCGGCTTCAGGCAT | 2111 GGGACTGCCCAACAGGAAGAA | 3311 |
| 912 GTGTGGGGAATGCCTAACAATGA | 912 TTGTTCCTATCGATTACCACCAAA | 2112 TCCTGCTTGCCTCTGGGCAAT | 3312 |
| 913 CAGCAATGAGGCAGCCTAGTT | 913 CTAGTACCACTTTCTCCTTGCTCATT | 2113 AGGGTGCTGGGATCCAGAAA | 3313 |
| 914 GGCTATCACAAACAAAAGCCAACTGA | 914 CTCCCACACCACACCAATCTCA | 2114 CCACCCCTATCCACAAAGAAAA | 3314 |
| 915 GGTTCCTGCAACTCAGGACTCA | 915 CCAGGCAGGACGCAACTCA | 2115 GCTCAAATCACCTTCCTGCAAGT | 3315 |
| 916 GCCGTAGGTACTTCCATGCTAA | 916 TGGTATAGCCACTCTGGCATTTT | 2116 GGTACTTTACTTTTGCCGTAGGTAGT | 3316 |
| 917 CATGCTCTTCCCCTGTGTCACT | 917 CCACGGACTGCCTGCAGAACTATCA | 2117 GCGCTGTTACCTCATCCTCTTG | 3317 |
| 918 CAAGTAGGCGTTCATCCTGGGAA | 918 GCCTCTGTTTCTCGGGTAAG | 2118 CATCATCCCAAGTAGGCGTTCA | 3318 |
| 919 GGCCTGAAATTGGAAGCAAAT | 919 GGATCTACCCTGTCGCCAGAAA | 2119 GGGATTTTTGGCCCCTGAAATTG | 3319 |
| 920 CCTACACACTCTCTACAACTCTTACT | 920 CCCGCCTTCCACAAGCCAACAAC | 2120 ACACCCGACCCTTCTCACAAT | 3320 |
| 921 GGCAACACTCTGTACAACTCTTACT | 921 TCCGCTTCCACAAGCCAACAAC | 2121 TCGCTCAGCAACACTCTCTA | 3321 |
| 922 AGGGCCTTCAAGAGTTGAAACA | 922 CCACTTTGCCAAATTCCCTTTCATC | 2122 CTCAAGGCTAAAGTAGCTCCTTGGAAAG | 3322 |
| 923 CCCCTGTAGCCAACACACTCAAG | 923 ACCAGCACCCCGCCATGTCT | 2123 AGTCTCCAGACACCCCTGTA | 3323 |
| 924 TGTCGCTACAGGGCCCATCT | 924 CGGCCAGAGACTCACTCAGAA | 2124 TGCTGCTAGGTGTGTGGTACA | 3324 |
| 925 GCTCTCAAGGACTTTGCAGTCT | 925 ACCCACCAACACCACATTGAT | 2125 AGCACAGGCCTGGCTCTGA | 3325 |

| | | | |
|---|---|---|---|
| 1174 CAGGCATGAATAACCCTCATGAAAGA | 1174 CACCCTGCCCAGCCTGTAA | 2374 GACTGCTTTCCCATCAGGCATCA | 3574 |
| 1175 ACTGCAACACTGTCATTGTCTTCA | 1175 GGCATGTTAGCGAGCATTTTACA | 2375 GGCAAAACTGCAACACTGTCA | 3575 |
| 1176 TTCGCTGCCCAGAGTGTTCT | 1176 GTTCTCGTTCAGACAGTGGTTCT | 2376 TGCAGGTTTCTCACATAACTCCTT | 3576 |
| 1177 CAGTCCAAAGAGTCCAAAGCATGA | 1177 CAGCAACCTCATCCTGAGTTCATTT | 2377 TTCTCTCCACCAGCACTCTTTATT | 3577 |
| 1178 TGAACCATCTGCCCTGTCTGA | 1178 TCTTCCTGGACCAGACTGTGA | 2378 CTGTGGCCCATGAAGCATCT | 3578 |
| 1179 TTCGGGTGCATCCTCACAT | 1179 AGGCCCGAGGGAGTTTGTTTG | 2379 TGTCTGCTTCCTAGCGTCTTC | 3579 |
| 1180 CATCCACACCTCTCTCCCTGTA | 1180 CCCCCTCAAAGTGGTGAAGACT | 2380 CACACATTTCACCAGCTTCATCTCATC | 3580 |
| 1181 TTCCAGGTTGTTTCTCCAAAGTAG | 1181 CCTTGCCTGAGCTGGTATTTCT | 2381 GGAACCATCTTCCTTTCCAGCTTCTT | 3581 |
| 1182 TCCCAGAGACACAGCTAGTTAAAAC | 1182 TGTGGCTACAACTCAGGCAAA | 2382 TCATCATCCCAGAGACACAGCTA | 3582 |
| 1183 TCCTCCTCCTACACTGGAAAC | 1183 GACATTGCTTCACTTGGGTGTGT | 2383 CCTTGTCCTGCTAACCATGAGACT | 3583 |
| 1184 GGACCAGTATCATTTTGGTGCATTG | 1184 CTCACCGCTCCATGAATGAATC | 2384 GGACCCTACTGATTCTCCCGTCAT | 3584 |
| 1185 CGGTGCTCCCTTTCTTTTAACT | 1185 TGTGTGCTGACAGGTTTCTGA | 2385 CACACTTTTCGCTGCTGCCTTT | 3585 |
| 1186 CCAGAAGCAATGTCAGCAAGCAAAC | 1186 CCAACACCACCTACTTCCCAAA | 2386 AGCAGCCAAGAACAAGGAGAAC | 3586 |
| 1187 AGTAGGTGTGATGGCCAGGAT | 1187 GCCCCTGTTGTTGTGCTGAT | 2387 TGCCCATAACAGAGTGGTGTGA | 3587 |
| 1188 TGTCTTCCTAGCCTCATCTCTCA | 1188 GGCTGCAGCATAAGGAATGTGA | 2388 TAGCCCCACCTGTCTTCCTA | 3588 |
| 1189 CCTACCGGATACTCACTCCTCCAT | 1189 CCACACCATTCCTTCGAGGACATA | 2389 ACTTGTTCACTTGCTAGCGCATAG | 3589 |
| 1190 CCCAAAGAGTCCCCATCTGGTT | 1190 CTGAGCTGGAAGACTCAAACT | 2390 CAGAGAGAAGCAGGGCCCAAAGA | 3590 |
| 1191 AGACCTAGCGCGCAAACAAA | 1191 GCAACTTTAGGCCCAGCTGAGTT | 2391 TGTCAGTAACGGTGCAGAGCCTA | 3591 |
| 1192 AGTTCCTCGAACCCAGCTATTAAA | 1192 AAGACACCCTGGGAGATCTACT | 2392 GCCTTTTAATTACCCTTGCACCTT | 3592 |
| 1193 CGTAAGCATAGGGGCTGCAGTA | 1193 CCTGGATTTGGGCATACGTGAA | 2393 AGTGGGAGCCTCGTAAGCAT | 3593 |
| 1194 GCAGTTGAGGGAGTTCAACTAAAGA | 1194 TTCCTGCAACTCTTGCTGGTTT | 2394 GGAATAGGTAGGTGCAAGCAGTTG | 3594 |
| 1195 CCTAGGCTAGAAGCCCAGCAAAAC | 1195 GGGTTGAAACTCGAGGCTTCTTC | 2395 ATCCACAAFTTCCGTAGCCTAGAAG | 3595 |
| 1196 CCTTCCCTTTGTCACACCACATC | 1196 ACTCTGTACCGGGTATTTCACACT | 2396 GCCTAGGGTTCTCTTCCCTTCCCTTT | 3596 |
| 1197 CCTGTCTTCAGGAAGAATGAGGAT | 1197 GCCCATCCAGACCCTTCTAATTG | 2397 TGGTTCCCCGAGCTCTTTTC | 3597 |
| 1198 CAAGCAAACTGACTTTGCAGCTTAAC | 1198 CAGCCTCCTGCAGCAGTTG | 2398 TGCCTCTAGAACCAAACTGACTTTG | 3598 |
| 1199 AGGGAGAAAATCACACTCTTGCAT | 1199 AGAACCCCATACCTGCATTACAAA | 2399 GGGCTCAGGGAGAAAATCACA | 3599 |
| 1200 GGGGACGAAGTCAAGGTGTAG | 1200 TCCCTGGAACCTCCAAAACT | 2400 TGAGTCTTACGGGACGAACT | 3600 |

This page is too low-resolution to reliably transcribe the sequence listings.

This page is too faded/low-resolution to reliably transcribe the sequence data.

The page content is too faded/low-resolution to read reliably.

| | | | |
|---|---|---|---|
| 2598 GGGATTCCTGCACTAAAGACCTTAC | 14256 GGCACACGACCCACCTATCT | 25240 CCCCTTAGGGATTCCTGCACTA | 36224 |
| 2599 CTCATTCCATCCTTCCCTGTCCAA | 14257 GGAAGGGCATAGAGAGACCATCT | 25241 GCCCAGACAAGACTCATCCATCCTT | 36225 |
| 2600 CAGAAGCCATGGTGGAGATTTGA | 14258 ACTAATGGTGACATTGGTGGAACA | 25242 TGGGCTTCTGGGGCAAAAA | 36226 |
| 2601 AGATGGTGGCACCCCGTCAT | 14259 GTGCCACACCATCCTCACCTA | 25243 GCAACTAACCACCCTCCAGATG | 36227 |
| 2602 CCAGAACAGCTTCCGAAACACT | 14260 GGCCAGTCCCTTCAATGTCA | 25244 GGTGGGTATCTCCAGAACAGCTT | 36228 |
| 2603 GCTCAGTGGTTGCTGCAGATGT | 14261 TTCCCTGCCCTTCCACCTTTC | 25245 GCTGGCTGAAGCTCAGTGGTT | 36229 |
| 2604 GCTCAAGCCCCATGAATAAGGTT | 14262 AGAATTCAACCACCATTGGCAGAT | 25246 GGGGTTTCAGCGGACTGTGA | 36230 |
| 2605 GAGAGACAACTGCATGCTCAGA | 14263 GCTGGTCCCTGGAAGGGGATA | 25247 AGCCTCTGCCTTGAGAGACAAC | 36231 |
| 2606 GATGGACTGGTAGTCTGTAACCCAAT | 14264 CCATCCCTGCAGGAGAGGAGAT | 25248 GCTGGCTGATGGACTGGTAGTCT | 36232 |
| 2607 ACTGCTCAACCAACATCTGTTCA | 14265 TTCCCTCCCCAAAGCCACAA | 25249 GGGACACACTAACTGCTCAACCAA | 36233 |
| 2608 GGGCCATGGCACTAGGGTAA | 14266 CTCCTCAGCAGGAGGAGTTTGT | 25250 GCAGCACACACAGCCTGGACATTC | 36234 |
| 2609 CAAGGGAGGCTGAAGAACGTCAT | 14267 AGCACAGGGCTCACAGCTA | 25251 GCCATATCTTGTTCAAGGGAGGCTGAA | 36235 |
| 2610 TCACCCACTCCACAGCATGTTC | 14268 GCTGCCTGAGAACGTCTTGA | 25252 GCTGACTTGGAATTGTTCACTTGT | 36236 |
| 2611 CTTCCCCAGTTGACAAGGACAAAG | 14269 CGAAAGAGCACAGCCAAACACA | 25253 GCGTCCTTCCCCAGTTGACA | 36237 |
| 2612 TGGTGATGGGGAGCCACTCTT | 14270 ACAGAGCTCCTGGAGGCAAGAT | 25254 CAGATGGCCCAACTTGGTGATG | 36238 |
| 2613 GGTGCCTGCTTGTCCCTGAATA | 14271 GGCTGCTCAGCTTGCCTGTA | 25255 AAGCTGGTGGTGCCTGCTTGT | 36239 |
| 2614 GATCCTCCCCAAGGGTTAAGAATG | 14272 CCCCGGTGGAGACAAGGAA | 25256 CGTTTACCAACGGGCGAAGA | 36240 |
| 2615 GCCACAGCTGTCTGAGGGTTA | 14273 CACTGCCAGGGTGGTCAATC | 25257 GGAGGCAGGAAGAAGTCCACAT | 36241 |
| 2616 CCTTTCCATGGACTGTGCAACT | 14274 TGGAGACCGTTCTCGGCTAT | 25258 CGGTGAGTTTGTCTGCGTTCCTTTC | 36242 |
| 2617 GGTGACTCAGATCAGGGGTTCCAA | 14275 GGGCTAGGGAGTGTTTCTCAAAG | 25259 ACCAGTCCCTGGTGACTCAGAT | 36243 |
| 2618 GGTGTGTGTGGAAGGACTGTGA | 14276 GATGCTACCCTGAGGCTTGAAA | 25260 GGTGAGGGGTGTGTGTGGAA | 36244 |
| 2619 GAGGAAGGAGATATTGGAGGTGTCT | 14277 CCAGCCAGCAAGCATCCTGAA | 25261 ACCCACCCAGAGGAAGGAGATA | 36245 |
| 2620 GCCAGCCTTGAGTCCAGTGA | 14278 GGGGTGACTTGTAAACCATCTTGT | 25262 AGCCATCTGCCAGCCTTGA | 36246 |
| 2621 AACCTGTCAGCTTCAGCCAAA | 14279 AAAACTGGCTACGCACTTTGTAAG | 25263 GGCAGATATTTTAATCCACCTAACCTGTCA | 36247 |
| 2622 TGCGCTGATTATTAGTGTCAGGTT | 14280 CCCTGCCATGAGCCCTTCA | 25264 TGTATAAGGGCTGCGCTGATTAT | 36248 |
| 2623 GAGTTCACCCTTCAGCAAATGAACA | 14281 GCCCCTCTGCTCTTCTCACA | 25265 GGTGCTTTGAAGACCGATGAGTTC | 36249 |
| 2624 ACACTGATCTCCACTCCCAGAT | 14282 CAATCCTAGCATAGGGTGCTTCA | 25266 CTCCTATGTCAGCCACACTGATCT | 36250 |
| 2625 AGCCTCGAACCTCCGCAAA | 14283 CGTGTCGCTGCCAGACAGAT | 25267 TGACAGTGGGAGCCTCGAA | 36251 |
| 2626 GGAGAAACAAAGGCCCACAGT | 14284 GCTTAAACCTCAGCTCCACCTTA | 25268 CCAGTTGAAGGAGGAGAAACCAA | 36252 |
| 2627 GAAGAAGAAGGACCAATGTGACCAT | 14285 TGTGCCCTCTCTCTCCAAT | 25269 GACAGACGAGGAGAAGTCAAACAT | 36253 |
| 2628 ACCCCACCCGCTTTCTCCAT | 14286 TGAACTGCTGTCCAGGGTCGAT | 25270 GCAGGTCAACCTTGGCTCTTAC | 36254 |
| 2629 CCAGAGAACACGGGCTGTTT | 14287 GCATCGCGTCGAGAGGAA | 25271 CAGCAGGGTCATTTCCAGAGA | 36255 |
| 2630 CCCAGTTCCCCTCCTGAGTTTAGA | 14288 TCTGCCCACCATCTGACTGT | 25272 GGGACTCAAAAAGTGACATCCCAGTTC | 36256 |
| 2631 CACCCTGAACTCCCTGCGTAAT | 14289 ATGCTAATTGCTGGGCCCTATT | 25273 GCATATTCTCACATTCCACCCTGAAC | 36257 |
| 2632 CCTTTCACAGCCCGGTGCATA | 14290 CCTGGAACACAAAACCAGAAGTCAGA | 25274 CCCTCATCGATGCCCCTTCTTT | 36258 |
| 2633 GTGACAATCAGGGTCCTTGTCTCT | 14291 TCCCAGGCTCCCACACTT | 25275 CCCCAGGCTAAGCAGTGACAAT | 36259 |
| 2634 TGAATGACTGATGAGATCCGTTGT | 14292 TCTCCACACCCTTTGCCAGAATG | 25276 GTGACAGGGAGCTATTGAATGACTGA | 36260 |
| 2635 TGGCAGGAAGATGGCTTGAGA | 14293 TGAGCCTCGCTGCACCCTTT | 25277 GGGTAGAGCATGGCAGGAAGAT | 36261 |
| 2636 AGCCAGTAAGGGATGGGCTGAT | 14294 TGGGCTCCTCCCCTGAAAATAC | 25278 AGGTCTGGGCTTCAGTGGAT | 36262 |
| 2637 TCTTCTCCCTCACAGCAAATCTTTT | 14295 GCAACATGGCTGGTACACATTTC | 25279 GCCATTGCCTCCTCCATTGTTC | 36263 |
| 2638 CCAGGCATCTGATTCAGTGTCAA | 14296 GCAGGGTTTGCCTTCTGCTCTA | 25280 GTCTGAATGACCAGGCATCTGATT | 36264 |
| 2639 CCTGGAATGGGCTTAGGCATCA | 14297 GGAAACAGGCCCAAGGTGCAT | 25281 CTCATAACTCCTGATTGCCTGGAATG | 36265 |
| 2640 ACAGGCCCTTTTGGCTTTGT | 14298 TGCTAGACAACCTGGGTAGTAACA | 25282 GCGGTAGGATTGGTCTGGGAAT | 36266 |
| 2641 GGAGGCCATCCAACAGAAGATTG | 14299 TGCTCCTCCTCCGAGGTAAAGA | 25283 CCTGAGGCATAACCAGTTGATCTTG | 36267 |
| 2642 AGCAGGCAAGGCCAGAGTAG | 14300 CACAGGCAACCTCTGCTCAT | 25284 TCTGTCGCTTTGGGCTCTTC | 36268 |
| 2643 GTGAAACCCCTGTTCTTGGTTGA | 14301 CACGGACGCGCATGAAAGAA | 25285 CAGACTGTAAAGTGAAACCCCTGTT | 36269 |
| 2644 AGGAGGGGCACCAACTTACAGA | 14302 TGTGTCCTCGGCGGTGTGT | 25286 TGGGCCATAAGAGGCTGGTCTA | 36270 |
| 2645 GGGGCTAAAGTCATCTCACCCTAAAG | 14303 GGGAGATCTGGGCTCACGTT | 25287 CTCTGTCAATTTGGGCTAAAGTCAT | 36271 |
| 2646 CTGCCCCATTGACAGAGGTTCT | 14304 GACCTCCAACTTGTGGCAGACA | 25288 TGGCTCCTCTGCCCCATTGA | 36272 |
| 2647 CACCTCCTCACCCGCTATTGTA | 14305 GGGCACAAAACCTCTGGATGCAA | 25289 TGTGGCAGGGGACACCTTCT | 36273 |
| 2648 GATGTAGGAGTCATGGGGATCTTG | 14306 AGCCGTGGCTGTCCACAT | 25290 GTGGTTGGCGGAGACACAAAA | 36274 |
| 2649 GAGCTAGCAGTATAGCACTGGTT | 14307 TCCTGGTTCCTCCCACTGCAT | 25291 TCTCCTCTTCTTTGAGCTAGCAGTAT | 36275 |
| 2650 CAAGCGGGTGCAACAGATGA | 14308 CAGTTTTGTGGGGCTCTGTCT | 25292 TGTGTACCTGGAGGGCACAAG | 36276 |
| 2651 CACGTGGTCCCTGCAGTCAT | 14309 GCCATCCATCTCCTCTTTCCTACA | 25293 GCTGGATGCCACATTGAAC | 36277 |
| 2652 GCCTGAGGAGAATGAAGGGTTCT | 14310 TGGGCACCTCAAACTTAACACA | 25294 CACCTGGCCTGAGGAGAAT | 36278 |
| 2653 GCAGTGGTGATTGGGCAGTT | 14311 TTGGGCCAACTCCCACTCTT | 25295 CCACGAGTTAGGGGAGACTTTG | 36279 |
| 2654 CGGGAACAAGCTTCTTTGGTAAATG | 14312 TCCTGTATCCCTGACTTGACTAGAA | 25296 CTGGAAAAATGCCCGGGAACAAG | 36280 |
| 2655 ATACCCTGGGACGAGAGGGACAT | 14313 GAGATATGGACGGGAAGCAGAAAC | 25297 CAACTCTGGCTGCTCGGTAA | 36281 |
| 2656 GAAACCTTGCAGGTGTATTGACTCT | 14314 TCGACTCATAAATGGCTGTGAAACA | 25298 CCCAATAAAATGGCCTCTGAAACCTT | 36282 |
| 2657 CCACTAGCCTGTAGGGTAAAGTTC | 14315 GGGCTTCATTTGCCATACTGAGA | 25299 CCTACCAGCCACAATTCCTTCT | 36283 |
| 2658 CCTTGCCCTCCAAATCTATGTGACT | 14316 AGGGCACAAAATGCTTCAAGTTC | 25300 GCTAAATTGATTTCCTTGCCCTCAA | 36284 |
| 2659 GAGCAAAACCACCAGGGAACAA | 14317 GGACATGGAGCAGGTAGTTAGCAA | 25301 GCCTCCCTGCTACTTGAGCAAA | 36285 |
| 2660 GTGTAGACAGAAACCTTGACCCAGAT | 14318 GCAGCCAGACCCACTCTGA | 25302 GGGGTAGTTGGTGTAGACAGAAACCTT | 36286 |
| 2661 GCCTGAGGTGGAACTTTGGTCTT | 14319 CCCAATGTTTTAGTCTGAACCTGAAG | 25303 TCTGACTGCCTGAGGTGGAA | 36287 |
| 2662 GCCTGGATTTGGCCTTCTCT | 14320 GTGGAAGCCACTGCCTGTTTG | 25304 CCTATCCTTGGGCCTGGATTTG | 36288 |

FIG. 36E1

| | | | | | |
|---|---|---|---|---|---|
| 2663 | TCAGGGCCTGCTCTTGCACTA | 14321 | AGGCCCACGCTGTCTTCCTA | 25305 | TCCACCCTGGGCTCCTCTGT | 36289 |
| 2664 | GGAGAGAACGTGGATTATAGACCGTTT | 14322 | CCCGGCCCTAAGAGTCACAT | 25306 | AGGGAGGAGAGAACGTGGATT | 36290 |
| 2665 | CCCATCTAGTCTTCTGCTGGCGATA | 14323 | GTGTATTTTGGCAATGGCATCCTT | 25307 | CAAACTGGATTTGACTAGCCCATCT | 36291 |
| 2666 | TCTTGGCTAGGGCGTTAGTAGA | 14324 | GAGCCCTTCGTGTTGATGAGA | 25308 | ATGGGACTACCTGGCTATAGTCTT | 36292 |
| 2667 | GTCTGACCCAAGGAAAACGTTCTGA | 14325 | GCAGCACCGGCAAACTAATACAAT | 25309 | GGACACAGTCTGACCCAAGGAA | 36293 |
| 2668 | GAGCTCAGGTCTGGACTACTTGAA | 14326 | CCCCTTGCCTAGAGTCATCAGA | 25310 | GTCTGGACAGGAGGGCTTCA | 36294 |
| 2669 | GGGTCTCCCAAAGATTCTCCAGAT | 14327 | GCTGCCTGCCATGACCTTGAT | 25311 | TGGGAAGGGTCTCCCAAAGA | 36295 |
| 2670 | GGGTGGATGATGCTTGGGTAAC | 14328 | ACCTGGGTTTAGGCTGATGAGAT | 25312 | TCTGGAGGTAGGGTGGATGATG | 36296 |
| 2671 | GTGAGGCAACCCAGAGAATCATA | 14329 | CTGGCCTAGGGTCTTAGTGGTT | 25313 | AGCCAAGCATGGGGTAGTGA | 36297 |
| 2672 | CCCACAATCAGGAAAATTGCTTCA | 14330 | GGACTTCCCCACCAGCGTTTTT | 25314 | CCACTTCCCTTCAGTATAAATCCCACAATC | 36298 |
| 2673 | CAGGGAACTGGGCATAAGCCTTT | 14331 | TCTTCCATGGAGCTCTTTCCAAATC | 25315 | CCTGAAACAGGCTTTAACAGGGAACT | 36299 |
| 2674 | AGCCCTGGCTAATTCTCTCTCA | 14332 | GAAACAGGTTCCAGTGGGTAAAGA | 25316 | TGGAGCCCTGACCTGCTTAG | 36300 |
| 2675 | CTTCCGGCCGAGAATATGGAA | 14333 | CAAGCAAGGCTTGGGATCAATAAAG | 25317 | GGTCTGGGAGCCAGTGTAACTTC | 36301 |
| 2676 | CCAGAGCCCCATTTTCCTACCAA | 14334 | ACTGGAAAAGCACCACCACAT | 25318 | TGTGCATCCAGAGCCCCATT | 36302 |
| 2677 | GGTGCAGACACAAGTAGTCAGA | 14335 | GCTCACCATCCATGAGGAAACA | 25319 | TCCAGGAGGTGCAGACACAA | 36303 |
| 2678 | GGCATAAGGCAAGAGCGTCAT | 14336 | CTCCATGGGGATAAAACAGTGGTAAC | 25320 | TGCAAAGCTTAGTACCTGGCATA | 36304 |
| 2679 | TGTTGTGACTGCTGCCTTGTA | 14337 | CGAGGCCCAGTTCCAAGAAAGA | 25321 | GGAGCGCATTTAAGGGGTTTTTG | 36305 |
| 2680 | CCGTCGCTGAAGTTGCATCA | 14338 | GCAGCTGGGGAGGAAAAGTGTAG | 25322 | ATGCCTTTCCCGTCGCTGAA | 36306 |
| 2681 | GAGCCTCCCTCACCTTTCAGAT | 14339 | CCATGGCTCAACTCTTTCCACGAA | 25323 | TTCACTTCCCAGGGGCTCTT | 36307 |
| 2682 | CTCAGGGGTGGATCTTTAAGCCTTT | 14340 | GGCATCACCTGATTGCTGATAGT | 25324 | TGCTGACTCAGGGGTGGATCTT | 36308 |
| 2683 | GCCAGCACACAGTCATAGTGAAC | 14341 | CTTCCAGCTTCCTGTTCTCCTT | 25325 | TGACGAGATGCCAGCACACA | 36309 |
| 2684 | AACCGCAGGTTTCTGAGTCAA | 14342 | AAGAGGGCAGGTCAGGGATTG | 25326 | GGCCCTGTTTGCCACAGAAAAG | 36310 |
| 2685 | GGTTTGTGCAGCTGGTTGACAT | 14343 | GCTGGATGAGGGAACACCTGATTTT | 25327 | GAACAGCTTCATTGAGTGGTTTGT | 36311 |
| 2686 | CCCTCCTGCAAACAAGCAACT | 14344 | GAGGGAGAGTTAGGGAGGCCATA | 25328 | ATGTTACCAATCCCTCCTGCAAA | 36312 |
| 2687 | GTGAGGCAGTATCCAGCTTCTCA | 14345 | TGCTGTCCAGCTCTCCTGTT | 25329 | CATACCCGAGTGAGGCAGTATC | 36313 |
| 2688 | CCAAACCTCCCAGCTCTGTCATTC | 14346 | ATGGACCCACGGGGACCTAAT | 25330 | GACCTCGCTAGTCTAACCCAAAC | 36314 |
| 2689 | ACTCAGCCCCTGCCAAAGAAG | 14347 | TTGTGCCCTAGAGGATGTCTACT | 25331 | GCTGAAAAAGATGGAGAGTTCCACTCA | 36315 |
| 2690 | CGCCCAGCCCTGTGATGTAAA | 14348 | TGTTTTTGTCCCCACTGACATCT | 25332 | GCCTCCCAAAGTGCGTGAAC | 36316 |
| 2691 | TTGTGCCCAGGCCCTTTTC | 14349 | CCACAGGGACCCCTATCACTTATG | 25333 | TCTCACTAATGCCCCTCACTGT | 36317 |
| 2692 | TGTTGTTGAGGTGTTACCACTGT | 14350 | AGGTTGCAGGCGGGATTGA | 25334 | CAGAGAAGGGAAAGCCAGTAAATAGTGT | 36318 |
| 2693 | TCTGCCCTTGGCACTGTGAGA | 14351 | GGCAGAGGGAGTGCCATAAACA | 25335 | AGTGATGCGGGTGTCCACTCT | 36319 |
| 2694 | GCATGTGGGGCAGCACGTA | 14352 | GCCTGCCATCCCTGTACACT | 25336 | AGAGGCGTCTCCAGGACTCTT | 36320 |
| 2695 | GGCTATTCCGTCAGTTACTGCACAT | 14353 | GTGGGAGCAGGTAGAGTGAGA | 25337 | GTCATAAGGGGCTATTCCGTCAGT | 36321 |
| 2696 | GCCAAGCCAGAGGGAGCATT | 14354 | GTCTATATGGTCTTGGCAGCTGAA | 25338 | TCAAAGCTCCGGGCTGTTTAG | 36322 |
| 2697 | CCACCCAGAGGCCAATGCTAAG | 14355 | GTGAGCAGTGGCGGTGACT | 25339 | GGACCGTGAAGGCACACAGA | 36323 |
| 2698 | TCCAAGCTTGCTGCTCTTG | 14356 | CTGTGGATAAAGCCAATGGATACTGTT | 25340 | TCCCATTGCGGCAGACATCA | 36324 |
| 2699 | AGACATGGCCAGACAAGACATAG | 14357 | GGCTGTCAGTGTTCAGTTGTGT | 25341 | AACCTGCCTGAAGCAAGACAT | 36325 |
| 2700 | CAGTCTTGCTCTTCCCCAGAGT | 14358 | TTTGGGCTGGAGACCTCGTT | 25342 | ACCCTGGCAGTCTTGCTCTT | 36326 |
| 2701 | AGCCAGGTGCGTAGCATAAG | 14359 | AACCTACCTCCTGCTGGTATATCT | 25343 | CCAGGCATGGGAAGGAGACA | 36327 |
| 2702 | TGGGCCCTTGTTGACCCAAT | 14360 | CGAGGCTCGAGCTGTTGTGA | 25344 | CAAGTCAAGTTTGGGCCCTTGT | 36328 |
| 2703 | GTAGGGTCGATTTCATCTTCCCACTA | 14361 | CCCCGTGACTCATTGGCTCAT | 25345 | CCTCATATCAAAGTAGGGTCGATTTCATC | 36329 |
| 2704 | GCATCTACACGGCACATCCATA | 14362 | GACATGTGGTGTAGACACGAGGTA | 25346 | CCACCCATCTATCCCATGCATCT | 36330 |
| 2705 | GAGGGTAAGCCAGAGAACCAATG | 14363 | AGGAGAGCAGGCACACCCATA | 25347 | TTCCGCCGCCCAGATTGTT | 36331 |
| 2706 | AGGAGCTCCGAGAAACAAGACT | 14364 | CTGCCTCAGTGAATCCAGACTGATG | 25348 | GGAGAATAGTCCCTGCCCTCAA | 36332 |
| 2707 | CAGGTGGCGGGAACTTAATGA | 14365 | ACTGTGTGCCACAGCAAACT | 25349 | GACTTCATGTGATGGGTGCATTC | 36333 |
| 2708 | GAGCTGCAGGAGGAAGAAGATG | 14366 | AGTCCCTTCCTGGGAGTCAAA | 25350 | GTCCCAGCTCCATTCCAGTAGA | 36334 |
| 2709 | GTGCCTATTGGAAGCCTGAATTGT | 14367 | CTCAAGTCCCTTCAACCTTCCTT | 25351 | AAAGCAGTAGTTCAGAGTGCCTATT | 36335 |
| 2710 | AGCCCTTGTAGACCTGGGATTC | 14368 | GGAACCTAGAACCTGTCCCTTGT | 25352 | GTGGCAAGTCAGCCCTTGTAGA | 36336 |
| 2711 | TTCAGGGGCCTTTGCCTCTTC | 14369 | GGGAATGGCTCGCTCACGTT | 25353 | TACGGAGGCCAAGGGTTCA | 36337 |
| 2712 | CCTGGACCTAAGCCGGAAGTCATA | 14370 | GGGACATGGCAGAGCTGAACTA | 25354 | TCGTAAAGGGGCCTGGACCTAA | 36338 |
| 2713 | GGGCATGATGAAGAGGCACTAA | 14371 | TTGGAGACCACCAAAGAATCAAGA | 25355 | CCACCTAGACTTGGGGCATGATGA | 36339 |
| 2714 | GCTCTCCCCAGCCTGTTCTCT | 14372 | CATGAAGAAAGCGGGTATCTGGAA | 25356 | AGCCTGCAGACCCCACCAA | 36340 |
| 2715 | CGACAGCCATCTCTGACTGGTT | 14373 | GCTTGAATCTTGCATTCATCTGCTT | 25357 | AGAACAATTTACCGACAGCCATCT | 36341 |
| 2716 | GATGCCAGGTAACGGTCATAG | 14374 | CGCCACCGAGTGCTTTCT | 25358 | GGCTGCAGATGGCCAGGTAA | 36342 |
| 2717 | TCGGGTTTGGAGGGGTAGAGA | 14375 | GGCTAGCAAAGCTCCCACACA | 25359 | TCAGGGTGGCTCGGGTTTG | 36343 |
| 2718 | GGAAACACCCTGAGGCTAGGTA | 14376 | GCTGGAGATACTACGCAAGCAA | 25360 | CAGTCAGTTCACCCCTGGAAAC | 36344 |
| 2719 | GGAGTGGGGTTACAGAGGATGTAG | 14377 | CTGCTGCTCCCCAATCCTAACT | 25361 | TCTGCCTGCTCTGTGGAGGAT | 36345 |
| 2720 | GTATGCCAGGTGCTATGCTAAAAG | 14378 | GGAACTGGGCCTCATTCACCATT | 25362 | TCCTACTGTATGCCAGGTGCTA | 36346 |
| 2721 | GTTTGCCACTTTCTCTCACCTCTT | 14379 | TGACAACCACCACGCTATTACA | 25363 | GCAGATGTACAGTGTTTGCCACTT | 36347 |
| 2722 | GACTTAATCCCAGGACCCTCTGTTTT | 14380 | ATGCGCCACAGTGGGTACA | 25364 | CAGTTGTAAGAGGCCAAGCCTAGA | 36348 |
| 2723 | GGCCCTTGTCAAGTTTCAGACA | 14381 | CCCCTTTGCCACATCTTGGTT | 25365 | AGAGGACAGGAGACCGGAGAA | 36349 |
| 2724 | CCCCTCACAAAAGCTTCTGCAT | 14382 | CCCTGTCATCCATGGGAGCTTA | 25366 | CGGGCTGCCCCTCACAAAA | 36350 |
| 2725 | TCCCTTAGAGACCGACCTTTGT | 14383 | CAAGAGCATGAAGCAAAGTGACAT | 25367 | GGTGATGTCTTTAATCCCTCCCTTAG | 36351 |
| 2726 | GGCACGTGGGATACACCACTA | 14384 | CCCCAGAACTCAGAGTCAGCTT | 25368 | GGGCTATACCAATCCAGCCTAT | 36352 |
| 2727 | AAACGGGGCCTTGCTGCTT | 14385 | GCTTTCTTGGGAACCAGAGCAGTT | 25369 | GGGGCTCCCTGGCCTTAAAAA | 36353 |

FIG. 36E2

| | | | |
|---|---|---|---|
| 2728 GGACATCTCCTCAAGGCTTGTT | 14386 AACAGCAGCTGCGCTCCAT | 25370 GGAATACAATCTGGGACAAGGACATC | 36354 |
| 2729 CACCCTTCTTGAAGCCTTCCTTGAT | 14387 GGGGCACAAAGGAGGAGACAATTA | 25371 CCCAGCTAAAGTGATACACCCTTCTTG | 36355 |
| 2730 TGCCACCATGCCCATCTAAG | 14388 AGGAAGACCCTGTCTCTACAAAATC | 25372 AGTAGCTGCATTTGCCACCAT | 36356 |
| 2731 TGGCAGGAAGCCACTGGAAA | 14389 CGTTTCCCACCTGTCGAGTCT | 25373 GGATGCTGGGTGTTATTCCAGTGT | 36357 |
| 2732 AGCCTCCACTCTTTCTCATAGGAT | 14390 TGGGAAGGAATGGCATCTAACTCT | 25374 GCTCCCCACTATTATTTCCCAGTTA | 36358 |
| 2733 AGCACCTTTGCAACCTCCTT | 14391 CCCAATCAGACGTGAAGTTTTCTTGT | 25375 GACACACTACTTCAGAAGCACCTT | 36359 |
| 2734 GTCCATGGGAAATTCACAGAGAAGGAA | 14392 CCTTCTCAGGTGCAGGAAAAGT | 25376 GGGGAGTCCCTTAGTCCATGGGAAA | 36360 |
| 2735 CAAGGCTGGAGCTTACCAGGTT | 14393 AGCAGGCCACTGCTCAAGT | 25377 CCCACCAATAGAAGAGCCTGAAC | 36361 |
| 2736 CGCCAGCTAAAACACCCAAATCA | 14394 CTGAGACAGCCACATTCTGGTAA | 25378 TGCCTCCGCCAGCTAAAACA | 36362 |
| 2737 CCAGCAGACACAGCAGTCTAGT | 14395 CTGCTTCCAAATCCCACCTTCT | 25379 ACCTAACACCCCAGCAGACA | 36363 |
| 2738 TGTAGGCCCAGTTGAGCTCTTG | 14396 GAAGACCTGTGTGAGAAGCAATGA | 25380 GGGCTAAATGTAGGCCCAGTT | 36364 |
| 2739 ACCATGGCCCAGGGCTTCTAT | 14397 TAGAGGCACACCCACCATGT | 25381 CCCAGCCATCACCCACCAT | 36365 |
| 2740 TGGCAGGGCTCATTCTGATG | 14398 AGCATCTCCGTGCGTGGAA | 25382 CCAAAGCCCAACCTGGCAAT | 36366 |
| 2741 GCCAAACTGGAAATTGTTTCGGTACT | 14399 CTGCCACAGAAGTTCACCAGAT | 25383 GGGCCTTTGTGAGCCAAACT | 36367 |
| 2742 TGGATGGAATGCTCTCCCTTCT | 14400 GTGGCTTTAGCTGAAGTGCTGAA | 25384 ATGCCCTCTCCCCATCCAGCTT | 36368 |
| 2743 TGAGCTGTGCTAAAATGGACTCTT | 14401 TGAGCATGTCAGCCATTACCAT | 25385 GTTCCGTAGATTTGAGCTGTGCTAA | 36369 |
| 2744 CTCCCCGACTCACCATTTGGAT | 14402 GGCTACAGGAACTGAATGTGGAT | 25386 CCAAGCACTCCCCGACTCA | 36370 |
| 2745 GCTTGCTGGAAAATGGCAAGT | 14403 TGAGGGCTGCCCACTGTAG | 25387 ACTGGGAGGCTTGCTGGAAA | 36371 |
| 2746 TGTTGACAGGCCCCAACCTT | 14404 GCCATCTCAACCTCTCTGTCTTC | 25388 AAGCAGCTCTAATGGCTGTTGA | 36372 |
| 2747 GCTTGGCCTATGGTTGGTTACT | 14405 CCCAAGGTCACTCGTTTACT | 25389 GGCCTGACTTTCTGTGGCACTA | 36373 |
| 2748 GATGGAAGCAGGTGACAGTGTTC | 14406 AGGACTTTTTCTCTCAGCACAACT | 25390 AAATGCATTCCCCAGAGATGGAA | 36374 |
| 2749 AGCACCCAGTTGTAACAAACAGT | 14407 GACTACATAGTACGTCTCCAGTGACA | 25391 TCTTTCCAAAGCACCCAGTTGT | 36375 |
| 2750 ATGTGGGTTCTGGGGCTCTGT | 14408 TGGGTGGTGACTTGTCCTGCTA | 25392 GGGCCAGAATAAGCAACAAAGCCAAT | 36376 |
| 2751 CTTGCTTGTGCAAGAACTGGAA | 14409 CCTGACTCCTTTGCTAGGCACTT | 25393 GGCGTGGCTGACACAAACTT | 36377 |
| 2752 ACCCGCCTTCACTGCAAATG | 14410 GCTGGTCCAGAGGAGAAATGATGA | 25394 TGGCCAAAACCCGCCTTCA | 36378 |
| 2753 AGGTCTACACCTGGCACTATGTA | 14411 CCCCAGCACAGGCAGATGT | 25395 GCAACTCCCATCCAGGTCTACA | 36379 |
| 2754 GGCTGAAAGGGGCTTGTAATGA | 14412 GACTCCCCAAGGGATAGGAGTATG | 25396 GCATAAACTCGGGTATGGCTGAAAG | 36380 |
| 2755 CTTGGCACTGCAGATTCAAAGTT | 14413 GTGACTTGAGGGCAGAAACTGA | 25397 ACCATGAACCTGTCCTCTCCTT | 36381 |
| 2756 ACGCAGAAAACTGGTGGATGT | 14414 CGAGAAGACTCTCCCACATGTGTTT | 25398 CCTGGACAGTCTCCCACATGACGCAGAAA | 36382 |
| 2757 TCCTGCCTCACGCCCTTTC | 14415 CGCCAGAGTAGTGTGTCTGCTATT | 25399 GCTCTTCCCTCCACCAGTCTCT | 36383 |
| 2758 GCGGGGCCACTTTCTTACAGTT | 14416 CATTACTGGAAGCCGCAGAGA | 25400 CATGTGCGGGGCCACTTT | 36384 |
| 2759 GACCTGGGGAGCAAATAGCAA | 14417 CATGATGTGCTGTCAGCCTGTT | 25401 GTTTTTACCTAGGGTGAACGGTACT | 36385 |
| 2760 GTTTTGCAAAGTTGCTGGGTAGA | 14418 GCCAACCCACCGACACCAT | 25402 CAGTGTCAGCTGTTTTGCAAAGTT | 36386 |
| 2761 TGGAGGCACCACTCAGGTTTGA | 14419 AGGACCTGTCAGGCCACATAGA | 25403 GGTACAAAATCCCTCAGTCCTAACCAT | 36387 |
| 2762 GAGTGCAGTGTCGTATGGTGGAA | 14420 CTGGGGTTCAAACCCTGGTCTTT | 25404 CACCTAGTATGGGAGTGCAGTGT | 36388 |
| 2763 CCCTGCCTGCTGTGTTTTTC | 14421 GGCTCCACACATGTGGCATT | 25405 GCTGGGAGTCACGCTGTTTCA | 36389 |
| 2764 TGCACCTCCAGCTGTGTGACT | 14422 GACCAAGGCCCCAAGTTGAAGT | 25406 GACTGTCCAGGTCCAAGTGCAT | 36390 |
| 2765 TCCCTTCACTCACCATCCAGAA | 14423 AAAAGACCCCAGGATGGACTATTATG | 25407 ACTGCCTGGCGTTCCCTTCA | 36391 |
| 2766 GGAGCCACCTTGGGGATCTT | 14424 ACGTACATCCTTGCCTCTTCTGA | 25408 TCTGGATACAGGAGCCACCTT | 36392 |
| 2767 GGGCCAGTCTTCATGGACCTT | 14425 GCTCACTTGTTTTAGCTCCTTCCTA | 25409 CAGTCTTCATGGGCCAGTCTTC | 36393 |
| 2768 CCAGATTGGCTCCCACTGAAA | 14426 GTTTTGCTCCAGGACTGTTTTGT | 25410 ACCACGTGTCACCCCAGATTG | 36394 |
| 2769 GCCTCTGTTCCATCCCCTTCTTC | 14427 AGCCCACAAGACTCACCTTTC | 25411 GATCTGTTGGCCTCTGTTCCAT | 36395 |
| 2770 CAGTAACGCTCACCACAAGTTACA | 14428 CTGCAGGGGCTGAGAAATGTAG | 25412 CTGATGACATGCAGCAGAGACAGT | 36396 |
| 2771 GCTGCTGGACACCAAGTGCAT | 14429 AGCAGGCACGGTCAGCTT | 25413 TTGCCTGCAAGGCCAACT | 36397 |
| 2772 TCCCCTCACGTGGCTGAA | 14430 GCGCCAAAGAGCTGGAAATG | 25414 CCAAGGAGGAACAAAAAGGAGACA | 36398 |
| 2773 TGGTCACGAATCAAAATCCTTCCTA | 14431 ACCTGGGACCCTCTGTTGAA | 25415 GGAGGACAGTGTATGGTCACGAATC | 36399 |
| 2774 GAAGGTAGCAGAAGGAGGTTTGAGA | 14432 CCCATCCGTATTTCCAGACTTCA | 25416 GAGGCAAGGCTGTTCTGTGA | 36400 |
| 2775 AACGGGAAGCCTCCAACCAA | 14433 GGTTGTGGACACGTCTGAGTTC | 25417 GGGTATGGAGAGGCCCACATTG | 36401 |
| 2776 CCCAACTCCATTGCCCCAGATT | 14434 GGGCCTACTTCCCCGACTCT | 25418 CATCTCCTGCCCAACTCCATTG | 36402 |
| 2777 TTTCACCACAATCCAGCAGTCT | 14435 AGCACAGGGTTCCCTAGAGTTG | 25419 CATGGGTTGGTTTTCACCACAATC | 36403 |
| 2778 TCTTTTGTATCCCCACAGTGCTT | 14436 ACAGGCTCTGGCCAAGGGTAAA | 25420 CCTGCCCTGGGGTTTCTTTTGT | 36404 |
| 2779 GCACCACGTATGTACTTGTAAGGGTTT | 14437 TGCCAGCCGAGGCAAAAT | 25421 CATTGAACTTCAGCACCACGTATG | 36405 |
| 2780 TGTCAAGCTGGTTGTGTCCTT | 14438 GAGGGGATTGAGTCAGACAGATTTAG | 25422 GGGCACTGTGTTTTCATTTTCTGTCAA | 36406 |
| 2781 TGGCAGAACATCCCGTGTCT | 14439 GCATCATTCATGCCACGCCATTG | 25423 CCTGCCGGATGCAGAACAT | 36407 |
| 2782 GGGGAGGCTTAAAGGAACAGCTTAG | 14440 GTCCAGGCTTGGTGGATGTTCA | 25424 GGGAGATGATTAGGGGAGGCTTA | 36408 |
| 2783 GCATCCGCTGAGAATTGGTGTTG | 14441 GACCAAAAGAGGCGGAACACATC | 25425 AGTGCTGCATCCGCTGAGAA | 36409 |
| 2784 AGAGTCTAAGGGGCTCTTTATCCTTA | 14442 GGGGCTGGGCAAATTCCAA | 25426 AGCGGCTCTCCTCCTACAGA | 36410 |
| 2785 TGTGGTCTCAAGCAGATGATACAA | 14443 CCTGTCCTGAATCAGTGGGAATTT | 25427 TGCCATGGTGTGGTCTCAAG | 36411 |
| 2786 TGTTCTAGGGAGTTCTCGGCTTT | 14444 TCCTTGCAACGTTCCCTGAAT | 25428 CCCGCCTGCTGGTCATTGTTCTA | 36412 |
| 2787 GGGCTGTATTCACACAGGGAACA | 14445 GTTCAGCCACTCTCTGCTAGGAT | 25429 GCCAATGGCTGGGCTGTATT | 36413 |
| 2788 GGGGCCAGTAAGCAAAGACTCA | 14446 TGTCAACACGGCCTTCACT | 25430 TGCCTCCTCCCTGGGGTTT | 36414 |
| 2789 CCAATCTGGGCATCTGAGTAACTT | 14447 GCAAGGGACCAAGTCCACAGT | 25431 CACAGCCAATCTGGGCATCT | 36415 |
| 2790 CCAGGTGCCCACATTTCTCT | 14448 TTCCCGGAGCGTGCTCATCT | 25432 GGCAGAGACGTATACCACCACCTT | 36416 |
| 2791 AAGACCTGCCAGGGTCATCA | 14449 CCAGGACTGCCTTTGGCCTTT | 25433 GCTCAATACGGGAGGTCGGAAAGA | 36417 |
| 2792 GGTGGGGCTAAAAATCAGGTAGATG | 14450 TCCCTGCAAGACCCCTTGT | 25434 CCCTGGGTGGGGCTAAAAATC | 36418 |

FIG. 36E3

| | | | |
|---|---|---|---|
| 2793 CCTCTGATCTCTTGTATCAGTGGGAATC | 14451 TGGGCTCTGGTAAGCCTCAGTT | 25435 CACATTGAAAAAGAACCCTCTGATCTCTTG | 36419 |
| 2794 CGAACAACACTGGGGTACAGCTA | 14452 CTCCGACATCTACCTGTCCTTTC | 25436 GCTGAGTATACAGCCATCTCGAACAAC | 36420 |
| 2795 GGGTCTACGTTTTTATGCAGTCAAG | 14453 CAGCAAACCAGTGCAACTCAAC | 25437 GGGAATAGCCTAATAGGGTCTACGTT | 36421 |
| 2796 GCCTCTGTGTCACTCTTGGCTTT | 14454 ACTGACCACGGAGTGTCTGA | 25438 AGCGTGGCCTCTGTGTCACT | 36422 |
| 2797 GGCTCTTGGTAATTGTTGCCATGT | 14455 GGAAATTGGGGCCCTGCATTCT | 25439 GATGAGCTTGGCTCTTGGTAATTG | 36423 |
| 2798 CAGAGTGTCTCAGCTGTCCTAAGT | 14456 GGTATTGCAGTGGCCAGGAA | 25440 GCTAGGTCTTGATGCCAGAGTGT | 36424 |
| 2799 GCACAGGTTTGGTGCCTGACA | 14457 GAGACCCAGAGCTAGAGTCCTT | 25441 GGTGAAGTAGTGAAGGGCACAGGTT | 36425 |
| 2800 CTCACTGCTTGCTGTGTTGTTG | 14458 GGAAACCAGATTCTCTGAGGGAAAA | 25442 GCATTTCTGCTTTCCAGGTTTCT | 36426 |
| 2801 GGTGTGCCTAAGAATGTAGTCCTAA | 14459 AGCAGTGCGAGCCAGTGAA | 25443 GGACGGGAAAAGGTGTGCCTAA | 36427 |
| 2802 GTCACTACAACTGCACCTTGTCTA | 14460 CTGGGGCAAACTACAGAGGATAG | 25444 ACCCAGCTTCAGTCACTACAAC | 36428 |
| 2803 TGTGCTCTACCCCACTCGTGT | 14461 GAGACCCTGTCTTGCAGCTTAG | 25445 ACCCCAAGAGCCCACTTTGT | 36429 |
| 2804 GCAGAAGCTTCCTCCTAGCAA | 14462 GTGGACACAGGGGAAGTAGGTGAA | 25446 GAGCGCACATTCATGTTGCAGAA | 36430 |
| 2805 TCCCCATCGCTTGTTGTTGA | 14463 TGGCCCCAGCAGTAGGTCTT | 25447 AGCCTGAGACCCTGACCTTTC | 36431 |
| 2806 AGGATGGCCTTAGCTGCTTTG | 14464 GGAGGCAGCCAGTGATCTTT | 25448 GGAAGGGATCAAGGATGGCCTTA | 36432 |
| 2807 GGGAGAGGAAACCAGTAGCCATT | 14465 GCACAGTGCTTGCTTCTCAGT | 25449 GGAAAGGAAATGTGGCACTCTTG | 36433 |
| 2808 CTGGAAGGCTGTCTTTCACTGGTT | 14466 ATGAGGCCTAGCAGCACTCT | 25450 CACAATCGGTCAGATCTTATCTGGAA | 36434 |
| 2809 AAGAGGCTCCGATGGTGTTTC | 14467 GACTGTTGGCCTGTGCTTAAGAGT | 25451 CCATGAACATTGGAGTTGCCTTTTG | 36435 |
| 2810 CCGCATGGTACCTGAGGACATC | 14468 TCTTTGGCCCTCTGCACTTC | 25452 AGCAGGGACATCCGCATGGTA | 36436 |
| 2811 GCTGACCACATCGGCTTTCA | 14469 CCTAGACCGGGCCGTAGAAG | 25453 GCTCAATCCGGACTGTGACGAGTT | 36437 |
| 2812 ACAGGGCTATTTCAGGCTCCTT | 14470 ACTTCTCTTTTGGCCTGTTTGTCA | 25454 GGTCGAACTGCTACAGGGCTAT | 36438 |
| 2813 TTGCAGGCGCCGGTAGTT | 14471 GCTCCGGTCAAAAGGGAAGT | 25455 GGCAAACAGGCATGGGAAAG | 36439 |
| 2814 CGGGGAAATGGCAAACAGGAT | 14472 TGTCTAGCGAGGAGCGTGTGA | 25456 CTCGGAAATCCACGGGGAAATG | 36440 |
| 2815 TGGGCCGAATTCACCACAGT | 14473 ACAGTCTGGCCACAGTCTCTT | 25457 GCTAAAGGGTCTGGGAGGTTTG | 36441 |
| 2816 CCAAGCCGATGCCCACTCTA | 14474 GGTGGCACAGACTTGGAGATGT | 25458 GGCTTCAGGGGCCTTAGACACTTG | 36442 |
| 2817 CGTCTTTTTCCCAGGGTTCGTACT | 14475 GGGGAGTTAGCCTGGGACCAAT | 25459 CGGAACTTTCTCATCTGACACGTCTTTTTC | 36443 |
| 2818 CTCAGACAGATCACTGCTTTGAAGA | 14476 GGCAGGGATTCCCAGGAGCTAT | 25460 GCATCTTCAGGTCTCAGACAGATCACT | 36444 |
| 2819 CTCATCCCTTTCTCCCCAGCAT | 14477 GCTGCCCTCCATGGTCTGT | 25461 TGAAGCACATCTCTCATCCCTTTC | 36445 |
| 2820 CCCGAGGCCTTGTCGTTTAGTT | 14478 GCTTGAGAAACCCTGCCCTAGTA | 25462 AGAGGTTTCCCGAGGCTTGT | 36446 |
| 2821 CAAAGCTCTTTGCATTACTGGCTTAC | 14479 AGGGGAGCGCTTGGACTATAC | 25463 ACCATTGCATGCCTGACTTCAA | 36447 |
| 2822 ATGGCAGTAGTGCCTTCTCTTC | 14480 CCCGGCTGGTAGCTCTCAGAA | 25464 CACTGTCAGAGCCGTCATCTTGT | 36448 |
| 2823 GTGGAAATGAAGAGAGGGTTGACAT | 14481 ACCTGCAAGTTACTGGAGCTTT | 25465 GGGCAAGCGTGGTAAGTGGAAA | 36449 |
| 2824 GGGGAGTGACAGAAGGGAATAGGATT | 14482 AAGCTGCGGCTCCTTGTGT | 25466 GCCACATCTGGGGAGTGACA | 36450 |
| 2825 CGTGACCTCGGCCTTCACT | 14483 CAGAACCTCCTTCTTGGCAATGAT | 25467 TGAGCTGGGGCGCTACTAC | 36451 |
| 2826 GACAAAGACAGCTTGGCAGTGA | 14484 CAGCGGCCTCACTCACAGTATT | 25468 CTGGGTTTGTCTTACTAAAGCCAATG | 36452 |
| 2827 CAGTGCTGGGTCTACAAAACACTTTC | 14485 CCCTAGAACTGCACCGAGTCAT | 25469 GCACACAGTGCTGGGTCTACAA | 36453 |
| 2828 TGAGGAATTCAAGCGTGAAGATGT | 14486 GGGGTGAGCGTCGGTGTCATC | 25470 CACAATGTTACAGAGGGTAGAGTCAT | 36454 |
| 2829 GGCTTGTCACCCCACCAATGAA | 14487 CCAGTTTTCCCCACAGAACACGAT | 25471 TCCCAATCGAGGGCTTGTCA | 36455 |
| 2830 GGCAATGGTGAAGCAGGTAAAAC | 14488 GGGAAGCCACAGAGAGCAAT | 25472 CCCCAGGGGCAATGGTGAA | 36456 |
| 2831 CCTATCCTGAGACGCAGGTGTGTA | 14489 CTGCCTTCCTAGGGCTGACA | 25473 CTGTGCAAAGAGGTCTCATCCTATC | 36457 |
| 2832 CACCCCACACTGTCCATTTCA | 14490 TGCAGATGCAACTGTGTCCAA | 25474 CCCGAAATCATAGTCACCCCACACT | 36458 |
| 2833 AACCTTCCTGCAAGGAGACAAA | 14491 GGGGTTGCAGCCTAGCTTAACTT | 25475 GCCAATGAGCAGCAAGGACAA | 36459 |
| 2834 GGGTGGGAAGTCTCCTCCTAGA | 14492 AGGAGGACCGCAGAATCTTCA | 25476 ACAGAGTGGGGTGGGAAGTCT | 36460 |
| 2835 ACGTTGAGAGCCAACACCAT | 14493 CTCACACTGGCGGGTTTTCA | 25477 ACTGCGGGTCACGTTGAGA | 36461 |
| 2836 AATTGTACCAGTGCCTGAAGTGA | 14494 GCCGGCCAGTATGCCCTATT | 25478 GGCAGATATTCCTTCCGCAAT | 36462 |
| 2837 TGGCACAGCCAGGGAACAGAT | 14495 CTCTCTCTCCCATTTGCAGAAGT | 25479 AGCTCCAATCGCCCATCTTG | 36463 |
| 2838 TGGCTACGACTGTCCTCCTTCT | 14496 GGTGGTTGTCGATGTCAGGAGACT | 25480 AGGGGCCGTGTCATTTTTGT | 36464 |
| 2839 GGCAGACCCATCTTTCACAATGA | 14497 GGTTTCTCCACGTAAGTAACAAAGTCT | 25481 GGAGAGTGGCAGACCCATCT | 36465 |
| 2840 CTGGGGACAAGCGCTCCTT | 14498 GGGACACAATTCACCCATAACATCT | 25482 CCCGAAATGCTTGCCGTCAT | 36466 |
| 2841 CTGGGGTCTTTGTACTCTGCTATT | 14499 GGAATCTGCTTCATTCCTTGCTCTT | 25483 CCTGGAAACTGGGGTCTTTGT | 36467 |
| 2842 GCCTGCTGTGTCAGAGGACAT | 14500 ACATCCTGCTCGACCCCAAA | 25484 TGTGGACTTGCCTGCTGTGT | 36468 |
| 2843 CACCAGGTACTCGATCCATCTCT | 14501 GCAGCTCCAAAGAGCAGAGGAGATA | 25485 CCTTTGGTCACTTTTCACCAGGTA | 36469 |
| 2844 AGTTCCGAGATGACCCCATGA | 14502 TGATTAAGCTGCATCGTGCATTG | 25486 TGGCTGGCCAAGTTCCGAGAT | 36470 |
| 2845 TCTTGGGGACCAGTGCATCA | 14503 GCCCAAGAACTCCATTGCTAAGTTC | 25487 GTCCACGCCACCATTATCTCTTG | 36471 |
| 2846 AGGGGACAGGGAGAGTGATCT | 14504 ACCAATTCAAGGAGCATTAGCAT | 25488 GGGTGGGCCTCCAGATACAGA | 36472 |
| 2847 CAGAACAGGTGGTAGGGAGAGA | 14505 GGGTCCCAATACTGCAACTGA | 25489 GGGTGAGAGGAATGCAGAACA | 36473 |
| 2848 GCTTCCCTCATTCTTGGGAACT | 14506 GATGCACCCTCCACTGGAAAA | 25490 CGCAAAACTTGATGCTTCCCTCATTC | 36474 |
| 2849 CTTCCGTGGTCTATGGTTTATGA | 14507 TGTGTTTCTGCACTTTGAGGAGTT | 25491 CGATCTCTAAGGATCTTCCGTGGTCTA | 36475 |
| 2850 CCTGGACTCTTTCAGGTTCTGAAGT | 14508 CAGGTGGCAGGAGCAGACAA | 25492 CCGTGACACCTGGACTCTTTC | 36476 |
| 2851 GCCAGGCCTTAGGCTTTGCTA | 14509 GGAGGAAGGGTTCTGAGCATTG | 25493 TGCTCCTCAAACATACCAAGCAT | 36477 |
| 2852 GAGAGATGCTGCACTGGACTCA | 14510 ACTAGGTCTGGGAGCCCTCCTT | 25494 AGAAGCCATGGTGGGGAAGA | 36478 |
| 2853 CAGCCTCGTGGAAGCAGAAGTA | 14511 TACCTGTGGCAGCCCTTCTTCA | 25495 GGTCAGCAGCCTCGTGGAA | 36479 |
| 2854 GGCAATGTTAGGAGGACTTTCTCA | 14512 TCTCCAGCACTGGTCTGTCT | 25496 GCGACATGATTTGCAGGCAATG | 36480 |
| 2855 AAGGACATCTGCGAGGAAAGTT | 14513 AGAGACCGTGGCACTTTGTTG | 25497 GCGGTGCAGAGCACAGAGA | 36481 |
| 2856 CCTCAATCAAACGGGGCAACCAA | 14514 CAGGCCAGCCTGGTAACCTAAC | 25498 GAGCTCTAAACCAAACCCTCAATCAAAC | 36482 |
| 2857 TCTCCCGCTGACCCGGTGTA | 14515 GCCACTTGTCAGGGCATCAA | 25499 ACTCACCGGCTCTCCTTTCTCT | 36483 |

FIG. 36E4

| | | | |
|---|---|---|---|
| 2858 TGACCAGTTCCCACCCTCTGT | 14516 AGGGGCCTGTTTGGGACAATG | 25500 GCCTGGACAGACAACAGCTACT | 36484 |
| 2859 GGCCACGTGAAGATGACAGA | 14517 GACAGCCAGGTGAATGTTCTACACA | 25501 ATGTCTGGCTGTGGCTGTTG | 36485 |
| 2860 GGTTTGTGGGATCAAGACCTTCT | 14518 TTGCCCACTCCTGACCTAGT | 25502 CCCTGAGCTAGGCCTTGGTTT | 36486 |
| 2861 TGTCTGTCCCCAAGCCAGACT | 14519 GCAGGGACCATACAGACTCCAA | 25503 GCCACAGCCAGAAGAAACACA | 36487 |
| 2862 GCCCATCTAGCCTGTGTTAGGAAGA | 14520 CCTCCACTCCCTATGGTGCTTAG | 25504 GGCAACAGACACAGCCCATCTA | 36488 |
| 2863 GCCTGGATTTGGATCGTAACTCTAC | 14521 GCTTGGGATTGCACGGATCA | 25505 GGAAAGAACTGGAAGCAGGCAACT | 36489 |
| 2864 AAGGCTGTTGGACAGACACAA | 14522 AGCAGGAGGGTGAAGACTGT | 25506 GGATAGGCTGGTACCATGAGAAG | 36490 |
| 2865 TGGCGCCATGACAGAGGGATA | 14523 AGGCCACGATGGCCACTA | 25507 TGGACAAGCCCTTAACACTTGATG | 36491 |
| 2866 GCCTGCCACCCACAGAACTT | 14524 CCATCCATCCTCCAGGTGTTC | 25508 GGCTCCAAGGATTAAGGTCCCAGAA | 36492 |
| 2867 GGAGCCTGTACTCTGCACTGA | 14525 CGTGAACTCTGACTCCTTTTCTGGAT | 25509 GGTCAATACTTAGGGAGCCTGTACT | 36493 |
| 2868 GTGGCGGGAACAGCAATATGA | 14526 TCTCACCAGCTTGTCCCTAAATTC | 25510 GTTTCCTAAGTGGCGGGAACA | 36494 |
| 2869 GGCCCTAGACTGGAGCCAAAAAG | 14527 AGGGGAAGACGTTTGGGGTAA | 25511 TTGCCCTTTGGCCCTAGACT | 36495 |
| 2870 AGGACTCCATCTGCCTTGTTC | 14528 CCAGGGAGCCTGCACACAT | 25512 TGTTCCCACCAGGACTCCATCT | 36496 |
| 2871 CACCAGCCTCACCCTTTGGATT | 14529 GTGGCATAGGCTGTCCTGCAT | 25513 ACCAGGGCTGGGAAGTCA | 36497 |
| 2872 CTCCTGCTGTCCTTTCTGCAA | 14530 CTCTCTAGCATGCGGTGGGTAA | 25514 GAGCCTAGTGATCGGGGTTTCT | 36498 |
| 2873 GTTGCCAGACCTCCCGTTAC | 14531 GGAAGGCAGTGGACGGTAATTG | 25515 GCCTGATGTGTTGCCAGTGTTG | 36499 |
| 2874 GGAAGTGGTGGGAGGGAGAA | 14532 GCCTTCCCCTACTTTACTGTCGAA | 25516 CTGGGGAAACTGCATGGGAAGT | 36500 |
| 2875 ACCAGGAAGTTGGATGGGACTTA | 14533 GGAAGGAGCCACGCTTACCAA | 25517 GACACAGACTGAAAACCAGGAAGT | 36501 |
| 2876 CGCAGGCAATTATCTCCTATACTTGA | 14534 AGGAGGAATACTCACCCCTGTTC | 25518 GTGCGTCTCGCAGGCAATTATC | 36502 |
| 2877 TCACCTCCTATTCACTCCTCAACA | 14535 TGGAATGGAGGACAAATTCCTGAAA | 25519 CTGTCTTCACACCTTCACCTCCTA | 36503 |
| 2878 CAGAGCCTCCATTTCCTTGCAT | 14536 TGCCTCTCCGCCAGTGTATG | 25520 GCAGGCCACTCTGCTCTCA | 36504 |
| 2879 TCACCCATGTCACATCCTGTCT | 14537 GAGGGCTGGACAAGGTGGAA | 25521 TGGGCACCTCACCCATGTCA | 36505 |
| 2880 CATCAACAAGGTGGTGACCTGAGA | 14538 CTGTGGATGTGCTGTGAATGTTGA | 25522 GAAGAAAAAGGGCCGTTCTACCAT | 36506 |
| 2881 CGTGCGGAAGGCAGTTCAAT | 14539 GAGTTGCTGGGTCACGGAGTTT | 25523 TCACTGGCTGACGACTCCAA | 36507 |
| 2882 TGTCTCCGGCACAGGTTTG | 14540 CCCCGAGAAAACCTTTCAGCACAA | 25524 CCTACTGGAGTTTGGCCTGTCT | 36508 |
| 2883 AGGTCCCAGCCTTGGTTCATC | 14541 AGCATCGCCATCCCAACACA | 25525 CACGGAGACCCCACCCATCA | 36509 |
| 2884 TGAGTGGTGTTTCAGATCATCACA | 14542 ACAGGCTTTGCCCTCCTATCT | 25526 CCCTGATGCTCTGAGTGGTGTTT | 36510 |
| 2885 CACCTTCCCCACTCCAAGTTTTG | 14543 TAGCCACCCTTCCTCCACTGCTA | 25527 GATAGAGCACATAACCTGAGCAATTC | 36511 |
| 2886 GGAGCCTCGAATGAACCATGA | 14544 TTGGGCCTGTGAACCTGTGT | 25528 CAGAGAACTGGAGCCCTGAAT | 36512 |
| 2887 GAAGCCCTGCAGAGTCAAGAGA | 14545 GGGTTCCTCCACGCACTTGT | 25529 TCACGCTAGGTGGTGGTGAA | 36513 |
| 2888 GGAAGGGCCTCAACCATCCAAA | 14546 GGTGCCTCTGGGCTCAGTTTT | 25530 AGGACATGGAAGGGCCTCAA | 36514 |
| 2889 TGGCCACCATCTCTGCTGTCA | 14547 CGTGTCCCCAGAGCCCAAT | 25531 CCCATGGCCAGATGAACAGT | 36515 |
| 2890 TCCTGGCACCATGACGTATCT | 14548 TGGCCATTCGCCCTACTGT | 25532 TGGCAGTCCTGCCACCAT | 36516 |
| 2891 ACAGAGCCAGCAAGCCCCATA | 14549 GTGTTAGGTCAAAGGCAGGGTTCT | 25533 GAAGCCTTGGCAGACACAGA | 36517 |
| 2892 CCAGTGCCACCTGGGTATGT | 14550 GTGTAGTGGGTTGGCTTAGGCATT | 25534 CAGTGTCAGGGTGGGACTCA | 36518 |
| 2893 GCTTACCAAGGAACGCGTAGA | 14551 ACCATCCAGTCCGAGTGCTT | 25535 GGAGGGAAGAACCTGCTTGCTTA | 36519 |
| 2894 CGTGTCTCTGGCTTTGTGACT | 14552 GGACGGGCAATGTCCATGT | 25536 ATGTCCCTGTGCCGTGTCTCT | 36520 |
| 2895 CAGCCAGTCACTTCGTTGTCA | 14553 CCGGAATCCCTCAGCAAAGTCT | 25537 CCCTTGGACTTCAGCCAGTCA | 36521 |
| 2896 TCCCTTTGCACTTAACGCTCTAGT | 14554 CCGGAATCCCTCAGCAAAGTCT | 25538 GCCCCTGCTCCTTTGCACTTA | 36522 |
| 2897 CCACCAAGGGGCCTTGACA | 14555 GGCATAGCAGACACTGCCGATT | 25539 CCTAGGGTAGCTGCCACCAA | 36523 |
| 2898 GTTGGGCGGGAAAAGCAAATTC | 14556 CCCCTGCCATCTATCCATTCCTATTC | 25540 GCAAATGAGTGTTGGGCGGGAAA | 36524 |
| 2899 CAAAAAGACCCCTGACCACTCAAG | 14557 ATCTCCTCTGCTGCGTGACAAG | 25541 GCTCACACCCTCTTCACCACAA | 36525 |
| 2900 GTGGTGCTTGTGCGTGTGT | 14558 CTGTACATGTGGCTGAACAGA | 25542 ACAGCCCATCTGTGGTGCTT | 36526 |
| 2901 CAGAGGGCCAGATGTAGGGAACTGT | 14559 TCCAGGACGTGGCACAAAGT | 25543 GGAGGCAGAGGCCAGATGTA | 36527 |
| 2902 TGCCCAGCTGGTTGGAGACT | 14560 CTCTTCCGTCTCCTCCTGCAAAC | 25544 TGTCAGCTGAGGGGATGAGT | 36528 |
| 2903 GTGCCCTGTGCAGACATCACT | 14561 TCCAATCGCCTGTCTGTGTTC | 25545 CATCGACATTGCCTAAAACCTCTTG | 36529 |
| 2904 CCAGAGAGTGGGTCCACAAGGTA | 14562 CCTCACATTGCCATCCAAGCAT | 25546 AGGCCTGCAGGAGAGAGT | 36530 |
| 2905 AAACCCCAAGAGGACCTTGAAC | 14563 GTCCACAGCACAGCCCCAAACACA | 25547 GGCCCAGGGAAGAAGCAACA | 36531 |
| 2906 CCAAAGAACCGAGCCCTTCACT | 14564 CACACACACAGCCCCAAACACA | 25548 CAGACCAGATTACGCCCAAAG | 36532 |
| 2907 TGCGCCAGGAAAGAAGTATGTT | 14565 TTGGCCAAGGGGACCCAAGAA | 25549 GGGCTTTTTGCGCCAGGAAA | 36533 |
| 2908 CCTCAGTGGGGAGAATATGCCTTT | 14566 AGTGTTGGCGTGGAGGTCTCT | 25550 CCGACCTCAGTGGGGAGAA | 36534 |
| 2909 AGCGGAACGCTCACGGAGATA | 14567 CAGGCAGGCTGCACACAAA | 25551 TCGCTGCCACAGAGGGTGAA | 36535 |
| 2910 GCCAGCTGTTCTCGGTTTGGAA | 14568 CAGCGCCACATGCACAGT | 25552 CACCTCTGATGCCAGCTGTTCT | 36536 |
| 2911 TGCGGCGTTGGGTGGTTT | 14569 TGTGCGTGCACTCCGTGAT | 25553 CGCTTAGGCACAGGGATTGA | 36537 |
| 2912 CAGTCACTGAGAATCAGGCAGTGTA | 14570 ACCCTGCCCTGCTGGACTA | 25554 GAGGCAAGAGACAAGTCAGTCA | 36538 |
| 2913 AGTGTGCAGTGCCCGAGAGT | 14571 GGGTCCTCTTGCCATTCGTTCA | 25555 GAACACATGAGCCACAGACAGT | 36539 |
| 2914 GGAGACAACGGCCCTCAAACA | 14572 TCCACTCCCTGCGCCTCACA | 25556 ACGCCCAGGAGGAGACAAC | 36540 |
| 2915 CCAGGCAGGCTGGAGTTTCA | 14573 CTGCGTCCGGGAGTCATGT | 25557 AGGAGAGCTGAGGACCAGACA | 36541 |
| 2916 TGAAGCCCACAGCCATCCAA | 14574 TGCGCGATGCTGCAAGATGT | 25558 ATCTCCTGGTGGCGCTGAA | 36542 |
| 2917 CAGGTGATGGCGCTGAGATTC | 14575 ACATGGAGGCGAGAGTCAGA | 25559 TCCCCAGCCAGCCAGGTGAT | 36543 |
| 2918 CTGGCCTCTGGGGACAGAA | 14576 AGGCCTTCCTGAGGCTTCGAT | 25560 CCCATGCCAACAGGACATCT | 36544 |
| 2919 TCTTGCCTCATCTGCCCTCTGT | 14577 GCCCAGTCCGGAAGGGTTCT | 25561 GGACCGACTCTTGCCTCATCT | 36545 |
| 2920 CCCGCAAGTACTCATGGCTCTTC | 14578 GGTGCACTTGGAGTCACAGACA | 25562 TGGACCCCGCAAGTACTCA | 36546 |
| 2921 CACACACACTGAGGACGCTTTG | 14579 GCCACCACGCCAAGAAAGGAA | 25563 CCCCTGACCACACACACTGA | 36547 |
| 2922 TGTCTTGGCCGATGACACAA | 14580 GGCAACCCAGTGCTGAGGAAT | 25564 GGCCTGCCCTTTGATCTAGTTG | 36548 |

FIG. 36E5

| | | | |
|---|---|---|---|
| 2923 CCCTGACCGCTGATACAAGCAA | 14581 TGCTCGGCGTGTCTGCAA | 25565 CGTGCAGTGAAACCTGGAGTGA | 36549 |
| 2924 TCGGGATGGACAATTCCAAGAAC | 14582 GTGCTTCCCTGCCGGACTAC | 25566 AGGAGGCTTCGGGATGGACAAT | 36550 |
| 2925 CCCTCACACAAGCCACCTGTTT | 14583 AGGGGTCTGGCTGGACATATC | 25567 GCATAACCTCAGTGCCCTCACA | 36551 |
| 2926 AACCCAGGACTGTGAGAGTGA | 14584 GGAGGTCCTTCCTTGCCTCAAT | 25568 TGGGGCTTTATTTGGGAAGTGTAAA | 36552 |
| 2927 TCCACCCCTCTGCGTAACTTTG | 14585 GTGGGCCCTTTATTGACCAGGTT | 25569 CTCTTCCCAGGTCCCTTCTTTC | 36553 |
| 2928 ACGCACCAGCTCCCCTTTCA | 14586 GCGGCCTCAGGAAACCTT | 25570 GCTTTTGCTCTGGCCATGTAAG | 36554 |
| 2929 GGGGCATAGCCCAGGAATGA | 14587 ATGCTCCCCTCCCTGTCCAT | 25571 TTTGGGAACCCGGGCATA | 36555 |
| 2930 GGAGACGGGATGGTGGAGAAT | 14588 GCGAGTCCCATCTGCTCTTC | 25572 GGCCAGCTAATTCCAGCAGACT | 36556 |
| 2931 TCGCTGCCAAGCAGTGGAT | 14589 AGGCTCTGGGCTCCTTGT | 25573 AGACAGAGCAAGGGGCTGAT | 36557 |
| 2932 TGGCTCCCAGAAGTGCTGACT | 14590 GACTTCAGGGCCTCCAACCATT | 25574 GCTCCACAAATGGCTCCCAGAA | 36558 |
| 2933 CTGTCACGCTTTGTCACGCTTTG | 14591 TCCCCTGCACCACTTCTCAGAT | 25575 CGCTGTCTGTCACGCTTTGT | 36559 |
| 2934 TGCCCGCCCATTCCATCAT | 14592 TGGGTGCTGGGTGCACAGT | 25576 AGGGAGTCAGCGGACGTT | 36560 |
| 2935 CGAAAGCCACAGGACGTGCTTA | 14593 GGAACGGCCCTGCCAAAT | 25577 GTGGGTCTGTGTGGAGATGGATAC | 36561 |
| 2936 GCAAGATCAGCACTTCTAGGACGTT | 14594 AGTGAGCGTCCCGTGGTT | 25578 TTGGGAGCAGGGCTGGAA | 36562 |
| 2937 CCCCGAGGGGAATCAGCAT | 14595 GTGGCAAGGACAAGCTGTATCT | 25579 CCCCTCCAAGGGGTGATTGT | 36563 |
| 2938 CGTCCAGCTTCATGCTCAGAGA | 14596 AGCCACCCGTGCTCTCAAC | 25580 GCCACAGCCGTCCAGCTTCAT | 36564 |
| 2939 ATCCTCCCTCCAGCCCATGA | 14597 CCTGTGGCTCCTCTGGACTTTATC | 25581 ACACGACTTCCAGGCCACAT | 36565 |
| 2940 TACCTCCACCGCAGACAGAA | 14598 GGCTTGAGCTTGCAGTCTTG | 25582 TGAGCACGTCAGCGTCTCTAC | 36566 |
| 2941 GGTTTGGCATGGCCTGGAAAGT | 14599 GCTCCCTGAAGGGCAGTGAAG | 25583 CCCAAGGTGGGGAAGAAGGTTTG | 36567 |
| 2942 GCCCATTTCCACCCTAACTGTGT | 14600 GCTCTTGTGCAGAAGGAGACAGA | 25584 GGGTATAAAACTCCCAGAGCCCATTTC | 36568 |
| 2943 TTGTCTGGGGAGGGGAAGTT | 14601 TGCTGGGGCAACCTCGAT | 25585 GGAGGGAAGACTCCTCACTTTGTCT | 36569 |
| 2944 GCCTGGTTCCCCTGACATTCT | 14602 TGCACTGCCCTAGAGCTGCAT | 25586 TTGAAGCGGGGAGGCCTGGTT | 36570 |
| 2945 CCACTAGCGTGGGGTACTGAA | 14603 ACCCCGCCTCACTCGGATGT | 25587 GGTGATTACATCCCCGCCACTA | 36571 |
| 2946 CCATGACCAGAGTCCACCTTTC | 14604 TCCTCTCTCCTCTGTGGAGTTTTA | 25588 CTGCCCCAATCTTCATTTCCTTTC | 36572 |
| 2947 CACTGACATCCGTGTTCCCAAACT | 14605 TCGCACGTCCCTGCTACAAG | 25589 CCAGGGTCTTGTTTCCACTGACA | 36573 |
| 2948 TGCCGTGCATGAGTGCAGAT | 14606 CACAGTGGCAGTTCCGGATGA | 25590 ATTTGGCGTGCCGTGCAT | 36574 |
| 2949 AAAGGGTGGGACGTCTCGAA | 14607 TGACGAATCAGAGAATATGACCTGTAG | 25591 TGCCCATTGGCTTCCCCTAA | 36575 |
| 2950 AAAGGGCCGTGTGGGACACAT | 14608 GCCAGGCTCAGACTCATCATCTTG | 25592 TGAGGAAGGCCCCAAGGAAA | 36576 |
| 2951 CATCAGTGCTCCGTGCTTGTTC | 14609 TGGATGAGGCCCTGTTCTGT | 25593 TGGGCTTCGGGCATCTTCA | 36577 |
| 2952 CCAGCCATTCTATCCTCCTCCAA | 14610 TCCAGCTTCCTCAAGGCAGTCA | 25594 GTTGACTTTGATCACCAGCCATTC | 36578 |
| 2953 TTTGGACGGTGGAGGTGAGT | 14611 CCAGCCAAGAAGCAGCAACA | 25595 ATGCCCCTTGCGTAGGGTTTG | 36579 |
| 2954 CACACTCAGTTTCGGGCACAGT | 14612 CACGGCCTTGCTTTCCTGAGA | 25596 TTAGCAGGAGCCCCACACTCA | 36580 |
| 2955 GCTTCCCAGCACCTCCTCTAAG | 14613 AGGCCCCGGAGGCAAAAGAA | 25597 CCACCTATTGCAGGGAGCTGTT | 36581 |
| 2956 ACCATGGTGGAAACTCCATTCATT | 14614 GAGGACTGTGCCAGGGAAGTA | 25598 GCTGTGTACCATGGTGGAAACT | 36582 |
| 2957 TGGATCTGCCCACACCCTTAGA | 14615 TGCTGGACAGACGCCCAGTT | 25599 GCTGCAGATGAATGTCTCTGGATCT | 36583 |
| 2958 GCCGAAGGACAGGCACACTT | 14616 GTCCTCAGGTCCCAGTGGTAGTA | 25600 GCCAGCGTACACATCCCTGAA | 36584 |
| 2959 GAGACAACCAAACCCTTCCCAAGT | 14617 GTGCTTCCCTTTTGCCCTCTA | 25601 CCCATCTCTTCCCTGAGACAAC | 36585 |
| 2960 TACCTCCGGCCTGACCAATCA | 14618 GGAGAGGGGCGTTGGGAAGTGA | 25602 CAGAGGACATTAAGAAAACTCCCTCTGA | 36586 |
| 2961 GCAGCTCAAGGGTGTTCGGAAAT | 14619 CTGCCAGCACACCTATGTGATA | 25603 GTAACTAATCACAGGGCAGCTCAA | 36587 |
| 2962 TGCCCTGCCCTTGTCAGTCT | 14620 GAAGTTCCCCAGTGCTCACCAA | 25604 CTGCCTGCCTTCTCTGCTTTTC | 36588 |
| 2963 TCCCATGTCCCGATCCGACTTC | 14621 CCTCACCAGCTCCCAACGTTTT | 25605 CTTGTCAGAACTGCTCCCATGT | 36589 |
| 2964 CTGTTACCATCCACTGGACCAA | 14622 TCCACACCGGCCCATCAT | 25606 GGGCCTGAGGAACTGTTACCAT | 36590 |
| 2965 GCCTGTGAGGAGGACTTTTCCAT | 14623 TGAAGCACAGGTGGGAAGAAG | 25607 ATGTGTCCTTGGGCCTGTGA | 36591 |
| 2966 GACTCTGTGTGAGAACAGCACTAT | 14624 AGAGAATGGAAGAGAAGGGACTGT | 25608 TGTGCCAGACTCTGTGTGAGA | 36592 |
| 2967 GTCATGGTGAGTCAAAGACTACGTTA | 14625 AGAGGCTCCACCCGTCTTCTT | 25609 GAGGCTTTGTCATGGTGAGTCAA | 36593 |
| 2968 CGCTGTGAGCCTCCACTGATTT | 14626 TGAACAGATGGCTACGAATGTATGA | 25610 TGCCTGCCATAGGGGAGCATA | 36594 |
| 2969 CACACCAGGTTGTCTCTATTTACACTT | 14627 ACCCTGGTCAAGAGGGAAGTCA | 25611 CCAAACACACCAGGTTGTCTCTA | 36595 |
| 2970 AGCCTGGTGGTAGAGGGAGAAG | 14628 CAGCCTGGCTTGCCCAAAG | 25612 AGCTTCTCAGCCTGGTGGTA | 36596 |
| 2971 GGCAGTATCCAAGGCAGGTGTAG | 14629 TGGCAGGTTCTGGGCTTCATC | 25613 GAAAGGCTGGAGAATCTGGTACA | 36597 |
| 2972 CAGCCACTACCCTGCAACCAT | 14630 AGGGGATGGCCTCTTGAACACA | 25614 TGGGGTCTTCTGCAGCCACTA | 36598 |
| 2973 CCTCATGTACTCCTGGTCTCACA | 14631 TGGAGCTGTTTCTCCTAGTGTCT | 25615 ACTGCCTCACTCCTCATGTACT | 36599 |
| 2974 CAGCCCCAACCTCATTAGTCAGTTA | 14632 GCCTGTCAGCAGGCAGACTT | 25616 AGGGCAGCCCCAACCTCATT | 36600 |
| 2975 CACAGGCAGGTTAGAGACGCTTTC | 14633 CCTTTGGCTGTGTAGGCTTCGAT | 25617 CCAAAAACCCACAGGCAGGTTAG | 36601 |
| 2976 TCAGGCCTCTCTCAGTCGAA | 14634 GGTGGGTCTCCAGGTCACTGAA | 25618 AGGGTGGGACGTGTAGTCA | 36602 |
| 2977 GATCCTCAAAGCCTGTAGGAGAAG | 14635 TGAAGACAGCCTCCCACTCTCT | 25619 GCGAAACGTGGTGATCCTCAAAG | 36603 |
| 2978 GTATCCTGGTTTCAGACACTGAACTT | 14636 GCCCGGGAGCCAACTATTTGCTA | 25620 GGGCTCCAAAACGTATCCTGGTT | 36604 |
| 2979 GCCCTCAGAGAGCCACAAGA | 14637 GCAGGGAGCAGGGAAGGAAGT | 25621 GGAGGTGGGGCAGAATGGAATC | 36605 |
| 2980 TCGGGACCTATCCGCTGCATT | 14638 CTGGGGCAGCTGAGGAATACTT | 25622 CCAAGCTGTCTCGGGACCTAT | 36606 |
| 2981 GCCTGGACTTTTGATTACCCCTTA | 14639 CATGAACCTGCAATTTGGCTGAT | 25623 CCAGTTCCTATGCCTGGACTTTT | 36607 |
| 2982 GTTCCCTCTCTCGGCTGACAATG | 14640 CCAGCCCAGGTTTGCTGAATGT | 25624 CAAGGCCCTGTTCCCTCTCT | 36608 |
| 2983 GAGCTTCACATTCCATGTGGCTTT | 14641 TCAGTCCTGAGCTGGAAATACCTA | 25625 GGGGACTGCAGAGATATGAGCTT | 36609 |
| 2984 TTGAGTCTCCCCATCTCCCTTT | 14642 CCCACACCCATCTTGGGTCTTT | 25626 AGTGAAGTTGGAAACCAAGGTTGA | 36610 |
| 2985 GAGCAAGGCTGATGTCTTCACA | 14643 AAGGCCCAGCAGGGAGGAA | 25627 TGGGCCAGAGCAAGGCTGAT | 36611 |
| 2986 CGCAATGTCGACACACATCCTTT | 14644 GGCATGTTTGTCGTGGGATGT | 25628 TAGAGGCCCAATGCTGACA | 36612 |
| 2987 GGAAATTCTGCAAGGAGGGAGACA | 14645 TCTCAAACTGAGCATTAGCTCCTT | 25629 GTGCTGAAGGCCAAGAGGAAA | 36613 |

FIG. 36E6

| | | | |
|---|---|---|---|
| 2988 CTCGCAAGATAACACACAGAGTAACA | 14646 ACCACAGGACTGGATGGGAAAA | 25630 CCAGCAGCCCTCGCAAGAT | 36614 |
| 2989 CTGGAACCAAAGGGCAAAGAAAG | 14647 GGAGGAATGATGGGGAAGTCTGT | 25631 TCAAGGTGACCTCTGGAACCAA | 36615 |
| 2990 GCTGTCCACGAAGAGCCACAT | 14648 CCCTGTGGCGAGATCCACAT | 25632 AGCCAGGGCTGTCCACGAA | 36616 |
| 2991 CACCGCTAGCCACAGAGGTTT | 14649 GGATCCTTGGGGTGTCGTTTCA | 25633 GGGCACAAGCAATACTTAGGCAGAA | 36617 |
| 2992 CCCACCCTGCACATGGGTTT | 14650 GCTCCTGTTGTTACTGGGTAGGTT | 25634 TTGCGGAGAGGGGCCTTCA | 36618 |
| 2993 AAGGAGCCCAGTGACCCTGAT | 14651 CCTCTCCTCTTTGTGGTCCTTCAAC | 25635 GCTGGGAGGGCTGAGTATGATGTA | 36619 |
| 2994 ACTGGACTGTGATGGTGCTAAG | 14652 CAGTGTGATAGGTTTCCGTGAACT | 25636 GGGGTGGCATGGGAATATTGGGAAAC | 36620 |
| 2995 TGCTTGGGTATAAAGGGAGAGAGA | 14653 TCAGCCCCTTCACCCAACTAA | 25637 GGTGGAGTGGTAGATGTTCTTGCTT | 36621 |
| 2996 GATAATGTCAAAGCCGGTAGTGATTG | 14654 GGTGACCACCCCTGAATAACCAT | 25638 GCTGTGCTCAGCCAGATGTGAT | 36622 |
| 2997 TGAGGGAGCCAGGGACTAAGA | 14655 AGCTCTTTCAGGTACAAGAGTGAAA | 25639 GGACTCCCTCAAGCAGGAAGTTG | 36623 |
| 2998 TCACAGCAGGCCTTGGACCAT | 14656 AGCAGCAGCCTCTTGCTAGT | 25640 GCACAAGTGCTGTTCTCAAAATCACA | 36624 |
| 2999 GCCACCTACTTGCAGGTTGAA | 14657 GCCCCATCAGCGATGTGGAATA | 25641 GCTCTGCTTCTTGCCACCTACT | 36625 |
| 3000 TGGTCACATACACGACTGTGTT | 14658 CTCTGAAACCTGGGGAAATGCAA | 25642 GAGCGCAATGTCTCCCTGTATG | 36626 |
| 3001 ACCCACCCAAGCCATGTCCTCTT | 14659 CTGCCAGTTTTGTTGCCCTTTT | 25643 CTGGGATTTCCAACCCACCAA | 36627 |
| 3002 GGATTGAGGCCAGGCAGACTA | 14660 CAGGTCAATGGACGGTTAGGTACA | 25644 CTGGTGGCCAATGGGGATAACT | 36628 |
| 3003 CCCAGGGCTACCTCGGATTTC | 14661 CAAAGGCAGAGACTTCCCTGATG | 25645 GTCCCTCACTTTTCTAAGCCTCTGT | 36629 |
| 3004 GCGTGTTAGAAGGTAACGCATACT | 14662 ACCTCCTCCTTCCCGATTAAACT | 25646 GCGTGGCGTGTTAGAAGGTA | 36630 |
| 3005 GAGCCGGGAAAGTTTTGTCCAAT | 14663 GGAGACCGCAGCTCCAGTTA | 25647 TTGCCTGGAGCCGGGAAAGTT | 36631 |
| 3006 GTGATGTTCTGGCTCCCTCTTTG | 14664 GGTCTCGGGAAGCCAACAAT | 25648 GCTTCCTCTCTTTCATGTGATGTTCT | 36632 |
| 3007 GGCGTAGAATGCAGCAGACAT | 14665 AGGCCAGCAGCCAGAAGTTT | 25649 GAGTTTTGTGTGATAGAGGCGTAGA | 36633 |
| 3008 CTCAGTGCCCTTCCACATCAGT | 14666 CCCCTAGAAACAGACCCACTAATC | 25650 GGCTAGTGCCAGGCTCATATCTCA | 36634 |
| 3009 GTGGATGGCTTCCTAATTCCAAGT | 14667 TGACTTCCACGGTACACATCTGA | 25651 GATGTTACAAGTGGATGGCTTCCTA | 36635 |
| 3010 GAGTTCAGAGGGCATGGGTTT | 14668 ACCGCTGCAAATAGGCACTAC | 25652 TAGCTGCTGGCTGTGAGTTC | 36636 |
| 3011 TCTGGCTCCAGCACTCACTA | 14669 CCTAGGAGAATGGCACTGGCTTA | 25653 GGTCTAGGTAGTGTGAGGTTCAGT | 36637 |
| 3012 CCAGATTGTACCCTCAATTCCTCTCA | 14670 GTATGGTAGTCACGCAACACAAAA | 25654 TCACGTTCTTTCCTTCCAGATTGT | 36638 |
| 3013 TCACCTCTCTCTCCTCCACCATTC | 14671 ACACGGAGGGCATCGTGTTG | 25655 CTGAAAGGGGCACATCCCATCA | 36639 |
| 3014 CAGGCCACGTCGTCACACT | 14672 CCCTGCTCTCCCTGTCCCATA | 25656 GCACAAACACCCCACAGGAT | 36640 |
| 3015 CTCACACATCGCCGGGAAAAAG | 14673 GTGCAGGTGACATACCAAGCTGTT | 25657 AGGCATTCCGAGGCTCACA | 36641 |
| 3016 GCCAGCCATAACACCTCACA | 14674 GTGTGGCCCAAGGGTGTT | 25658 GCCCAATGCCTGGGATATTAAAAAG | 36642 |
| 3017 AAAGGCCCTGGGGTGAGGAA | 14675 CTGCTCTGCCCACACAAACA | 25659 CGGGAGCAGCAAGTGCAAA | 36643 |
| 3018 TGTCCCCATGGGACCTTGA | 14676 CAGGAACCTGAGGCATGGAATC | 25660 TGTCCAGCTCAGCCACTTGT | 36644 |
| 3019 GTCCTACCCAATGACTGACTGATAC | 14677 GTGCATGGAAGCTGGGCTTT | 25661 GCAGGTGTCCTACCCAATGACT | 36645 |
| 3020 GAGGCTCAAGCGTAGAGAGAGA | 14678 CCCAACTGCTCCCCTTGCTT | 25662 TCTGGAAGGATCAGAGGCTCAA | 36646 |
| 3021 AGAGAGGAGCACTGGACACA | 14679 ACCTCTTGGTGGAAGTGGACAT | 25663 GCTTGCGGCAGCAGAACAA | 36647 |
| 3022 GCTGCTGGCAGTGCTCTCT | 14680 AGGTGAGAGCCAGCTGGAAA | 25664 TTGAGGCCTGTTGGGTGCTT | 36648 |
| 3023 AGCCGTCACTGGTGTGTCA | 14681 GACTTTGAGATCGCTGACTGATTCT | 25665 GAAGTTGCAAAAGCCGTCACT | 36649 |
| 3024 CCCGCCACCACATCTTGCTAAA | 14682 GGCAAAACCCTGGCTCTACT | 25666 TAGGTGCCCGCCACCACAT | 36650 |
| 3025 GACAGAGTGAGTACGACATGGAAAC | 14683 AGCCCCTGCTCCCAAGGTA | 25667 AGGCACTGAGACAGAGTGAGT | 36651 |
| 3026 GTGCAGCAAGGCTGTGATGAGT | 14684 TGAAGCCACTGAAGGTAGCTTTT | 25668 TGTTAACCCCGTGCAGCAA | 36652 |
| 3027 GGCCAGATGCTGTGTAACCTT | 14685 TCAGGTGCCAGCTCCAGAAA | 25669 CTGCAGAGGTTCGGCATGAA | 36653 |
| 3028 GTGTCTCTGTAAATCAGCCCTTCA | 14686 TCTTGGGATCCTGAACTGTCTTAATC | 25670 CCGGGGTCACATGTGCTTAAGTGT | 36654 |
| 3029 CTGCTCCCCAGCTTACCTTTTG | 14687 CAGTATCCTCACCTTGGTCTTAGACTTT | 25671 ACGCGCCCAGGTGATGTTG | 36655 |
| 3030 TGGCCCCTCCTACAACCAAAAC | 14688 CCAAATTGACCCACTAGGTGTTGT | 25672 CTGCATCTGGCCCCTCCTA | 36656 |
| 3031 GCTTTGGGCTGGTGACTTCT | 14689 TCCACTGGAAGTGGCAGAAAAT | 25673 GCCTGGATGGACTTCAAACTTGCTT | 36657 |
| 3032 GAACTTGAAGGCACCTCTAGCTTA | 14690 AGGGCCAGGTAGGCCCTCAT | 25674 GGGAAAATGAGCCCTGTGAACTTG | 36658 |
| 3033 TGGGAAAGCCCTTCACCAGTCA | 14691 GGCAGATAGCCTGCCCCAAA | 25675 CAGACTGGCTTTGTCTGGGAAA | 36659 |
| 3034 GCCACTTTCCAGCAACGTATC | 14692 CATTTTACTGGGGAAGAAATGGAGACT | 25676 CTTGGGAGTTGGAGCCACTTTC | 36660 |
| 3035 CACTTGCTTTTGCATCCAACGATTAC | 14693 CCCAATGCCTGGCTCCTAATTC | 25677 GGAGGATTTCCACTTGCTTTTGCAT | 36661 |
| 3036 GGATTCCAAGACTCAGCTTCAGGAAA | 14694 TACAGCGACTGCTGCCAGGTAT | 25678 GGCATAGAAGGATTCCAAGACTCA | 36662 |
| 3037 GCAGGCACCAACACCTCACAT | 14695 GCTGGACAGTGTTGAAAGCCATAG | 25679 TGACGCATGCCTGGGAAAAG | 36663 |
| 3038 GCTGACATTTAGTCAGCCCTGTTC | 14696 ACCTCCTCCTGCCACAGGATT | 25680 AGGGCTGTTCTTGACACACAA | 36664 |
| 3039 CACAAGCACAGATAGTTGGGCTGGAT | 14697 CAGGGAAAGTGACACACTCCAGAA | 25681 CTGCTTCCTCCCACAAGACAGA | 36665 |
| 3040 CTCCCCAAATGAAGCTGACTGTAG | 14698 GCTGGGATTGCCTTCTTGTTTCA | 25682 AGCCATCCAGGCTCCCCAAAT | 36666 |
| 3041 ACATCTCCAAGGCGTTTCTGT | 14699 CGATAGACAGATCCCCACTTTACATC | 25683 CCTCCATGGGCTGTTTCACATC | 36667 |
| 3042 GGAAGGGGCAATGGCACTTAG | 14700 GCAGAAACTGTCAGACTCCTACTTC | 25684 TGCAGGGGAAGGGGCAAT | 36668 |
| 3043 AGGGGTTACGGTGTGGTTCA | 14701 GTGTTGCAAAACCAACCCACAGA | 25685 CCACCTTTGCATAGTTCAGTAGGGGTTA | 36669 |
| 3044 ACCTCCTGCTCACCTGTCAGT | 14702 GCCTGGGCTAGACACACACT | 25686 CCCATCCTTAGCCTCATCGATAC | 36670 |
| 3045 GTCTAGAAGGGCAAAGTACTTGAGA | 14703 GCTGGCTGCTGTTACTGAGA | 25687 GGAATGCCATTTGGGAGGTGTCT | 36671 |
| 3046 AGACCTGCTGGGCGTGTAGT | 14704 TCATAGGGCTTTGCATTCAGTGAT | 25688 GTTCCTGAGTCGCACCTTGA | 36672 |
| 3047 GCTTGTCCAGGTGGAGCTATGT | 14705 CACAGGGGTCACACTTCGATCT | 25689 GAGGGTTGGGAGAAACAGCTT | 36673 |
| 3048 GCGGGGAGGATGCAAGACT | 14706 CCCTCTGTCTCAGCGTTTCCTA | 25690 GGAAGATCCGCCCCTCTGA | 36674 |
| 3049 GAAGACTCACATTGACTCAGGAACT | 14707 GGTTGGGTTCCTTGCTCTCTCT | 25691 ACAGAGTGGATGAAGACTCACATTG | 36675 |
| 3050 AGCACCCCTCCATCCACCTT | 14708 GATGTTAGGTTGGGTTGCAGACA | 25692 AGAACAGAAGGGCCCCTGAAAG | 36676 |
| 3051 TCCCACCTTTCCTGGGTTCAGT | 14709 AGTGCCCTTTGAGGCAGGAT | 25693 AGCACCGCTCCCACCTTTC | 36677 |
| 3052 CGTGCCCTGCCATCTGTTCT | 14710 AGCCCCACATCCTGCGTAAG | 25694 GCTTCACTCCCCAGGAGAAATGAAATG | 36678 |

FIG. 36E7

| | | | |
|---|---|---|---|
| 3053 AGCCTGATCTGGTGGACAAAG | 14711 TTCCGCACCACGTCCACAAC | 25695 GCAGGAATCTTGACGAAGCCTGATCT | 36679 |
| 3054 CACAAACCCAGTGTTTTAGGAGCATGA | 14712 TCCGACAGGACGCACACA | 25696 GTCCCTTCACAAACCCAGTGTTTTA | 36680 |
| 3055 CCCTCCATTCCCAGCCATGA | 14713 CCGGAGAGACAGGGTGTGATG | 25697 TCCCTACCCACCCCTCCATTC | 36681 |
| 3056 GTATCCCCTATCAGCCACCAGAT | 14714 TGGAGGGCCTCTGGTCACTTC | 25698 ACCCCAGCTTGTATCCCCTATC | 36682 |
| 3057 GGGAATCACCACACTTGTGTCT | 14715 GCAGAGATTAGTGCCACCATCAAG | 25699 GAATGGGGATGTGGTGGGAATC | 36683 |
| 3058 CCAGTCATCTCCAAAAGGTCTGATTC | 14716 AGTGACTGTGCATTGTGGGAAA | 25700 TGCCAGTTTAGACGCAGTGT | 36684 |
| 3059 GCACACATCCACATTCGTTCTTG | 14717 CAAATCCAGACCAATTGAGCAAAGA | 25701 AGCAAAGCTTTAAGAGCACACATC | 36685 |
| 3060 GTGATGTGCGTTTTGGTTCCTT | 14718 GGGAGGAAGGAGGGAAAGAGATTTG | 25702 GGCAGGTGAGAACGTTCAGT | 36686 |
| 3061 GGGGCATGATTCCACCTGTAAC | 14719 GCATAGCTGGGCCTATTCTCT | 25703 GTGTCCTGCCCTGAGGTTTG | 36687 |
| 3062 TGACTCACAGGTCACCAGTCT | 14720 GCGGGATGGAGTGAGAGTGTTT | 25704 TCAGATCCGGCTGACTCACA | 36688 |
| 3063 AGACCCCTGGTGCCTCAGAT | 14721 GGCACAGCAGCTCCAGAAT | 25705 GCCCCTCATCCCCACCTTCA | 36689 |
| 3064 CTCCTCCGCCCTCATGTGAA | 14722 TTCCCACCGCCGACTTCCAA | 25706 CTGAAACCCTGCAACGAGACT | 36690 |
| 3065 AGGTCTGCTCCAGCCTCATC | 14723 CCAAGTAGCAGGGCTGGCTAAA | 25707 CACTTATCAGCTGGGCCTCACA | 36691 |
| 3066 CCCAGCTAAGCACATGCACAAT | 14724 AGCCCAGGCTGACTGGTTTG | 25708 CTCAGCTTAAAGCCCCAGCTAAG | 36692 |
| 3067 TGAAAGCGGATCCCGGCTAGA | 14725 AAGCTGGGGTGGACTCCGTTA | 25709 GCTGCTAGTTGGCTCCTGAAA | 36693 |
| 3068 CGGCCAGGGAGAAGACAGGATA | 14726 AGGCAGGCTGGCTGCAAA | 25710 CCGCAGGGAACAATGAAGGTT | 36694 |
| 3069 GAGTCTTCGTTTGCACCTCTGT | 14727 GGACAGCAACCGTTCAGAGACT | 25711 TGTGGGTGGAGTCTTCGTTTG | 36695 |
| 3070 CAGCCATAAGCCAAGGGACACA | 14728 TGGTGGTGGCTGGCACAGTA | 25712 AGACTGGAGTAACACAGCCATAAG | 36696 |
| 3071 CCCTCCCTTTTCACCCTGGAT | 14729 AGCCATCGTGGGGTCTCTTAC | 25713 AGTCAGAGGCTCCCTCCCTTTT | 36697 |
| 3072 GTGGTTTGTGTAATCTCGCTCCAA | 14730 GTCTTTCCATTTGCCTGGCATT | 25714 AGACACAGTGCACACCACTTC | 36698 |
| 3073 CAACTTGCCAGGGGCAACAAC | 14731 AGCTCCGCCTCTTAACCCTAA | 25715 GCTTAGAGACGCTGAGCAACTT | 36699 |
| 3074 GCAGCTAGGAGTAGTGACCAAGAAG | 14732 CAGTGGCATTGCAGGGCTTT | 25716 AGCCGTGCAGCTAGGAGTAGT | 36700 |
| 3075 CAACCCCTCTAGCCATGTAGTCT | 14733 AGGAAAAGGCCATCCCAGGAA | 25717 TCGCCTTTGCCAACCCCTCTA | 36701 |
| 3076 CTGAGGTCAATTCCGATTCCCACATC | 14734 TGGAGGGAAGAGGTGTGTGT | 25718 GTGCCTGCATCTGAGGTCAA | 36702 |
| 3077 AATTGATAGCAGGGGTGAATCAAGA | 14735 GGGGCCACAGCAAAGCAT | 25719 CTGTGGCAGCTGCAGGTTTT | 36703 |
| 3078 GGGTTTGGTGACAATGGCTCTTTC | 14736 ACCTTCCTGTGCACCCACAA | 25720 CTGGCTGGGTTTGGTGACAA | 36704 |
| 3079 GACTTGATCTTGGGTGCTTTCTTC | 14737 CAGAGATGACCTCAGAGCCTTTTG | 25721 GCCGGCCCTGACTTTGATCTT | 36705 |
| 3080 GCGATGGAGTAAATTAAGGCACAA | 14738 GCACAGGCACTGGGCTAAAC | 25722 CCACCTCCTATGGCGATGGAGTAA | 36706 |
| 3081 ATCCACCCAGGGGTCAAGAGTAG | 14739 TTGGTGGCCTGCAAGATG | 25723 CTCCTAGTTGGACCCTGGGTAA | 36707 |
| 3082 AGCCCATCTCAGGCATCAGT | 14740 ACTGCCTGGCTCAGTGACA | 25724 GGACATGTTGCAGCCCATCTCA | 36708 |
| 3083 GACAGTGACGGCATAACCCTGAA | 14741 GGGAGGGCAGCAATAATAACCTCTGA | 25725 GGTGCTGTGCATGAAGACAGTGA | 36709 |
| 3084 CAGGCACTTTCCTCTCTGTGTTTT | 14742 CAGATCCACAAACCTAGGGAGTGTT | 25726 TCCAGCCATCAGGCACTTTC | 36710 |
| 3085 TCACACCAGACCCCTAAGGAA | 14743 AGGGTGTATGTGTGTCTGACAAG | 25727 GCTCCCTTGGAGTCTGCATCTT | 36711 |
| 3086 ACACAGGTGTAGCCAGTGTTTG | 14744 CACTGGGTAGGGGAGCGATACT | 25728 TGGCATAAGCCTGGCACACA | 36712 |
| 3087 GTGGACTTCAGAGCACAGCAT | 14745 GACTATGAAAATCTGCCGCTGGAT | 25729 GCTTGCAGCTTTGCCTGTCA | 36713 |
| 3088 CCCTTCCCTCCTGGTTCTTCA | 14746 TGGACTGACCACGTCCAGGAT | 25730 GGTGGTGTTGGCTTGCTCTTC | 36714 |
| 3089 GACTGCTGATCTGGCCTCCAAA | 14747 TCCTCTGCGCCCATCTGAA | 25731 TGGAGCCCTGACTGCTGATCT | 36715 |
| 3090 GCCTAGACAGTTGCTCAGTGT | 14748 CTCGGGGAACCATGGGCTAA | 25732 TCAGCAGGGCCTAGCAGTT | 36716 |
| 3091 CACACCTTGGTGCTCGGTATG | 14749 TTTGCCCTGAGAACTGAGAGTTT | 25733 GATGTGCCAGCCACACCTT | 36717 |
| 3092 GCCCATCAGGTGCTTGAAAC | 14750 CCCCGGAAGCAGCACATGAGATAA | 25734 CCCAGGTTGGCTCCACATTCT | 36718 |
| 3093 TCCTCCCTTGAATATCCTCAACTGT | 14751 CTGCCTGAGGGTAGCTTTGGTA | 25735 GCTGTCAACTTCCTCCCTTGAA | 36719 |
| 3094 AAGGGGACCTGGTGGCTTTA | 14752 CATGTCCTAGCACAGGTCTCTCT | 25736 TGGGATGATGGATTCATGGGTTATTG | 36720 |
| 3095 CCTGCGACAGTTCCGTCACTT | 14753 AGTGCCGAGACCTGGAAGTT | 25737 ATCTCCGCCCTGCGACAGTT | 36721 |
| 3096 GCTCACACGGGCATGACCTAAT | 14754 CGGACGGCTCGGGTACTTT | 25738 AGCCCTTTCCTGGCTCACA | 36722 |
| 3097 TTCAGGGCATGAGCGCCTTA | 14755 GGGGCTCCCAGGAGACATCA | 25739 GTGCCATGAGCAGACTTGGTTTC | 36723 |
| 3098 GAGACAATCCCTTGAGTGTCTGAT | 14756 TGTCTGAAGTTTCCTACCCATTTGT | 25740 TGTCCTCAGAGACAATCCCTTGA | 36724 |
| 3099 GGTCCGCAGAGAGAAGGAAAC | 14757 AGTGAGTCACCACGACTTCTGA | 25741 ATAGGCACAGGTCCGCAGAGA | 36725 |
| 3100 TTGTTCAAGAACTTGCCCTGGTA | 14758 GCACGGCCGAGCTCATTCA | 25742 GTCACTTCCCATGGACTTACATTTTTG | 36726 |
| 3101 CCTCAGTGTTCTCAGGGCATCT | 14759 ACTCCCGGCTGGTGCTCACA | 25743 CCCTTGTGTGCTCCTCAGTGT | 36727 |
| 3102 ACCCACAGCCCATAGGACAGA | 14760 TCACCCAGCTAGGAAGGATTTG | 25744 TCTGGGTGGAGAGTGGAGATG | 36728 |
| 3103 TGGTCCCAAGAGGCTTTTGTT | 14761 GGGTTTCTCCAGGCGGTAAAG | 25745 TGAGGCATGTGGTCCCAAGA | 36729 |
| 3104 GCGGAACGGCCTGTGAAGT | 14762 GGCGAGTTCCACTCATAGCAA | 25746 ACCCACTGCTGAGCCTGTTTC | 36730 |
| 3105 GCCATTTCATACACCGTTGTCTTT | 14763 CGCTGGCCTTGTGCTTTAGA | 25747 GCCTTTTCAGTTTTGTGCCATTTC | 36731 |
| 3106 GAGTTTGCGGGGCTGTTTCTAC | 14764 TTGGGCTGTGCGCATTCACT | 25748 ATCGGTGGCCGCTTGAGTTT | 36732 |
| 3107 AGGAGCGCATGCCTGTATTC | 14765 GGCCCCATGGCATGACTGT | 25749 AGGGTCCATCTGCAGGAGTT | 36733 |
| 3108 TGCAGAGGGATGGAGGACTATG | 14766 GGTGGGTGTGTGCGTGTA | 25750 ATGCCCCTTCCGACTGTTG | 36734 |
| 3109 CTGTATGTTCTCGGGCCTCAGT | 14767 GGCAGATTCTATCCCCATGTCACT | 25751 CAATGGCACATGCTGGCTGTA | 36735 |
| 3110 CTCCGGAAACGCTGCAGAT | 14768 CAGCCACTGTTATGTCAGCAGGAA | 25752 TTCTTCCCAGCTCCGGAAAC | 36736 |
| 3111 CCTCTGGTTGGGATGAGGGTTTG | 14769 AAGGCTGTGCGCTGGTTTG | 25753 GGAACACTGTTGACCTCTGGTT | 36737 |
| 3112 TGGTCTGAAAACCTGGTGATTC | 14770 TGCACCGGGCACAAATGA | 25754 GCCTGATGGCAACCAACACTT | 36738 |
| 3113 TTGCCGGCTGACGTCTTAG | 14771 GTCAGTTCTGCTTCACGGGTTTC | 25755 AGCCAACCCAAGCGTCTTT | 36739 |
| 3114 GCTGGCATCACCTCAACAGT | 14772 AGATGACATCAAGGTGGCTAGTTC | 25756 TGGGTCTCAGGCTGGCATCA | 36740 |
| 3115 GGCTTTGGCCTGAGACTGTTG | 14773 CGGACAGCATAGACCTGTTGAGT | 25757 AGAGCGAGCCCAGGCTTTG | 36741 |
| 3116 GCTAAGAATTCAGCAAGTAGGACAACA | 14774 AATGGGACCAGAGGGTCTAAGAA | 25758 GCACCACTGTGTGACAGAAGCTA | 36742 |
| 3117 CACCCAGACAGCAGCTGAA | 14775 CGGGTAAGAACTGGGTGAAGATAAG | 25759 AAGCTCCTAGCCACCCAGACA | 36743 |

FIG. 36E8

| | | | |
|---|---|---|---|
| 3118 CCCAAGCAATCCTCCCATCTCA | 14776 CCAGTGCCTACAGTCCCAGCTA | 25760 TCCTCCCAGGCCCAAGCAAT | 36744 |
| 3119 GAGGGAGAAGGGAACATGAACTCTA | 14777 TCGGGAAGTAGCAGGAACTGA | 25761 CGATCAGTGAGGGAGAAGGGAACA | 36745 |
| 3120 GGTTGCCCTCCACTGTCTGTT | 14778 CACTGTGAGGGGAGCGTACA | 25762 GCTCTTGCCCTTCCGCTTCAAT | 36746 |
| 3121 CAGCCTTACCTGCCCTGTACT | 14779 TCTCTGAGGTGGGTGCTGGAAA | 25763 TGTACGCTCCCCTCACAGT | 36747 |
| 3122 CAGTGGATAAAGTGGCCCATGT | 14780 GGAGGACTCTATGCATCTGGGGTTA | 25764 AGGCCGTCACAGTCAGTGGAT | 36748 |
| 3123 TGGCCCACACCTCCATCA | 14781 TGAAAGCCCTGGCCCAATGA | 25765 CTGCCAGGCAAGCTTTTCAGA | 36749 |
| 3124 GGGGAAGTTGCTGTGTTTCTGT | 14782 AACCCATCTCAGCTTCCTTGTTAAT | 25766 GGCAGCAGCTGGGGAAGTT | 36750 |
| 3125 GCTACCGACAACGGCAACAAC | 14783 GGCACATCCGCAATCAGTGCAT | 25767 CACCCGGCTACAGTTACTAATGCTAT | 36751 |
| 3126 CGATTTGAGCCCCGCTTCT | 14784 AGTGCCTGCCTGGCGAAT | 25768 CCTAGGAAGTGCTGCTTCGAT | 36752 |
| 3127 CCTCGGCACGTAGGTGGTTT | 14785 GAAGGGTGTAGGTAAAAGCCTAGTTG | 25769 TCGTGCCCTCGGTCTCTTG | 36753 |
| 3128 GCAAAGGTTGAACAGACCTGGAT | 14786 TGCAGCAGGAAGTGGCAAA | 25770 CCCCTCCTTACCTGCAAAGGTT | 36754 |
| 3129 TTCGATCCGACCGGGACAAG | 14787 AGTGCTTCACATCGAGGAAGATG | 25771 GGCACGTTTGATTTCAGGTTCGAT | 36755 |
| 3130 AGGGCACTCGTGCTTTTGA | 14788 AGGGGAAGCTGCCGAGTTC | 25772 CCTTCGGGGCTGGGCTTTA | 36756 |
| 3131 TCATCCTGGAGGGTGTAGAGATG | 14789 CCAGGGAACCCCAGAATCATCA | 25773 CCCCTCCTCCCGATGTTCA | 36757 |
| 3132 TGCACTCGGCACCTGTCT | 14790 TGCAAAGACAAAGGTAAGTGTGTTG | 25774 AGCACCGAGAGGCAGGTTTG | 36758 |
| 3133 GCAACTTGTGATGCCTTCTTTGA | 14791 GGGTGTGTGCACTCTACGTTTCT | 25775 ACTGGTGTGAGCAACTTGTGAT | 36759 |
| 3134 GCACCACGGGAACTGGTGAAT | 14792 TGGGCGGTGACCTGGCTTT | 25776 GGCCATGCTGGGAGTGTTTG | 36760 |
| 3135 ATAAGGCGGTAGGCAGGACTCA | 14793 TGCCTGGAGAGCTGCTGTCAT | 25777 TGTGCAGAGGTGCTGTGGAA | 36761 |
| 3136 TGTCCGCTAGGCCCTCTGT | 14794 CAGGCCCTGTGGGTCTGTTG | 25778 AAGGCCACCCTGGGGTGTAG | 36762 |
| 3137 TCAACCACGACGAACCCAGAGA | 14795 TGCCGTGGTGTGGGGATCT | 25779 CCGTAGACGTCCGAGGTAATCATC | 36763 |
| 3138 CATTTCCACCGTGGTCCCTGTT | 14796 TTTCCCCATCACACTTTCGTTCT | 25780 CTGCTCGCTGGCATTT | 36764 |
| 3139 GTGCTGTGACTATCGTGTGAGT | 14797 GGCTGTGGGACTTGTTACAGTGA | 25781 TGTCAGCTGTAATGTGCTGTGA | 36765 |
| 3140 CAGATTGTAACCCCACCCCAGAA | 14798 GCTTGCCAGCTCCACATCCAA | 25782 CTGGGCATATGCTTTGAACAGATTG | 36766 |
| 3141 AAACTCCAGAGTGACCCTTAAACTT | 14799 TCCGCCCACAGGCCTCTTT | 25783 GGCTGACTTTCTGAGCCCCTAAG | 36767 |
| 3142 CCACAGGGCGAATGCAAAGT | 14800 GCCGGGCAGAGAGTAGAGGAT | 25784 CACAAGAGAAGAGCCCATGCAAATC | 36768 |
| 3143 GCTCAAGAATCTGCCAGGTGTGA | 14801 GGGAGCTGCAGAGACGAGTTTT | 25785 GGGGAGAGGAAAGCCATCTTCA | 36769 |
| 3144 GAGTGGAGCCAACTTTCCTTACCAT | 14802 GGCATCGTAAAGGCTGCCAGTAG | 25786 CACCAGAGTGGAGCCAACTT | 36770 |
| 3145 GCACCAATCCACGCTGAACA | 14803 ACTGGCACAGCTGGTAGACT | 25787 GCCTGTGGCTAGGCTTAAATAACT | 36771 |
| 3146 AACCCGCGTTCTTGCTGTGTTA | 14804 CCCTCAACCGTTTCCTTAAGTGT | 25788 CTGCCGGAACCGCTTCTT | 36772 |
| 3147 CCAAGGTCCTAAACTGACCTGAGACT | 14805 TAGGAGCATGGACCGCAGGAA | 25789 CTGCTGTGACAGGTTCTCACCAA | 36773 |
| 3148 CACACTGCCACGCTCTTGA | 14806 GGCTGAAGGGTCCCCACAAA | 25790 GGGCTTGTCTTCAGTTCCTCACACT | 36774 |
| 3149 ACCCAGGTCTTCAGCAGCATTC | 14807 TGCCACCATCTTGCCCTTGT | 25791 CGCTCAGAACCCAGGTCTTCA | 36775 |
| 3150 AGGACAGAACCATCGAGAGGTAA | 14808 GTTGGGCGAACTGTACTCCAT | 25792 TGAGCCCAGGAGAGAACCAT | 36776 |
| 3151 GCCAAGACTCACGCTCTCCTT | 14809 CTGCCACAACAGGGACAAGA | 25793 CAAACCAGCGCCAAGACTCA | 36777 |
| 3152 TCCTATCAGCGTCCCCTTCA | 14810 AGTAAAACAGGCAGGCAACAGA | 25794 CTGCTTACGGACGTGGTTGT | 36778 |
| 3153 CTTGTGGCCTGGTTTTGGTTAATG | 14811 GTTGAGCCCTTGTTATGTGTGTAGA | 25795 GTCTCTACCTTGTGGCCTGGTT | 36779 |
| 3154 CCTGGGAGTCTGGCGTCCTT | 14812 AGGGTAGGCAGAGGTGCTTCA | 25796 ACCAGGAGCCTGGGAGTCT | 36780 |
| 3155 GCACGTTACTAAGGGCATGTGTTC | 14813 CGTGTGACCAGGCTGCAA | 25797 GGAGGAGCTGCACGTTACTAAG | 36781 |
| 3156 GCTGCTCTTCTGCAGAGTTGA | 14814 GGGATGACGTCGGTCACCAT | 25798 GCTGTGACACTGCTGCTCTTCT | 36782 |
| 3157 CCTTGGCAGCTTAGTGTATGTCAGT | 14815 GCACCACATGGCAGTGGAACAT | 25799 GCTGGGTGGCTCTCTGGAA | 36783 |
| 3158 TGAACCCACGTAAAGGGACATTAG | 14816 CCGTGGCACCCTTGAAGAGA | 25800 TCACGGCAGTCACGGAACAT | 36784 |
| 3159 ATGGGCACTGCTCCACTCT | 14817 TGGCACTGGCAGGCATCA | 25801 TCTGTTTGAACGCACTGTTGATTG | 36785 |
| 3160 ATGGGCCCTGGGACTGATGT | 14818 AGGGGACGTGGGCTCAGACA | 25802 GGCCTTGGCTTTCAAGGTGTTG | 36786 |
| 3161 AGATTGGGCATGATACCGCTTT | 14819 CACCAAGTCCTGCTTGTGTTTTAG | 25803 GCCTAGGTGTAGATTGGGCATGA | 36787 |
| 3162 CAGAGCTTGTTCTCGGGCAAA | 14820 CGCCATCCCTGCTCAGCTT | 25804 AACGCCGTGGCCAGAACA | 36788 |
| 3163 GCCAGAGGAAACTCCGCTTCTA | 14821 TCCGGGCCTGACCTCATCA | 25805 TGCACCCGCCAGAGGAAAC | 36789 |
| 3164 CCATCCCCTGGTGAAGGAAAATC | 14822 GGAGTCTGCCCCCAGCTTT | 25806 TCTGGGGCCCTGCCTCTTT | 36790 |
| 3165 GGTTCCCATGAGCAGGAGGTAGT | 14823 GGCTCTGCCTTCACATTTCTGT | 25807 GAACAGGCTGGTTCCCATGA | 36791 |
| 3166 CGCTTTCAGCTGCCCAGGAAAT | 14824 GTGGAGCAACATCCCAGCCATA | 25808 CCATGTTCCCCTTGACCCTGAA | 36792 |
| 3167 GCACTAACCCATCAGCACATCT | 14825 TCCACCCGGCCAGAGACAA | 25809 GCACCTTTCCCCAGCACTAA | 36793 |
| 3168 CAGACTCCAAAGACGTGGTTGTGTA | 14826 TGGGCCCTGTGGTCTTAGTGA | 25810 TGTGTGGCCAGACTCCAAAG | 36794 |
| 3169 GGAGCCCGTGGGTGATGT | 14827 GGCCCCTTTGCCTCTTAGGAT | 25811 GGAACCGGAGTGGTGTTTGA | 36795 |
| 3170 TGTCCCGCAGCACACCTT | 14828 TGGATGGCCCACTGCAGGAT | 25812 GAGGTTCTCACCGTCACTCTGT | 36796 |
| 3171 CCTTCCAGGAGCTTCGAGAACAAC | 14829 TGGTGGGCGAGGAGCTTGTA | 25813 TGCATGGTGTGACCCGAATC | 36797 |
| 3172 GGGCTCCGACACTGCTGTAAAT | 14830 AGGAGCCCCGTACCTCCAT | 25814 TTCAGCCTGGGCTCCGACACT | 36798 |
| 3173 TGCGTGATCGGCCTGAAGAA | 14831 AGCTCAGTGACGGGGCTGAA | 25815 AGACTCGGCCTGCGTGAT | 36799 |
| 3174 GTTCAGTAATGTCAGGGCAAACAGA | 14832 GCCAGAGAACGTCTCAGCTT | 25816 ACTTTGGGTCTTGCTAAAGTTCAGT | 36800 |
| 3175 TGAGCACGTAGCGGTGCATT | 14833 CGTCCTGCCGGGGAAAACTA | 25817 ACTGCGCCTGAGCACGTA | 36801 |
| 3176 GCAAAGCATGTCAGTGTGGTTCA | 14834 TGTGGTGAGGTGGGAGTCAA | 25818 GGGTGGGAATGAGCAAAGCATGT | 36802 |
| 3177 GACTAGAAAATTGCCGTGGGTCTCA | 14835 TGGACACACAACACCCAACA | 25819 CCCCTGGGCTACGAGTATATGTGA | 36803 |
| 3178 CAGATCAGCTGGAGGGAGCATT | 14836 GGGTAGGCATTGTTCCACACTCT | 25820 TGTGGAGCAGCCCAGATCA | 36804 |
| 3179 ATCTCCAGCACCTGCACTCA | 14837 GGTCAAGTCATCAGGTGGAGTCA | 25821 GGGCTATGATTAGGAGAGCCTATCT | 36805 |
| 3180 GTGCTGTTGCAAAGAGTCGAGAA | 14838 GGAAAACGTATCACCTTTCCCAGAT | 25822 TCCGCAAGCAAGTGCTGTT | 36806 |
| 3181 GGTTGAAAGATGGAGCCCTCTGA | 14839 AGTAGGCTTTGCAGAAGTGAAGT | 25823 AGGCCAGGGAGTGGTTGAAAGA | 36807 |
| 3182 GCTACTGGGGAAGATTGCTTGA | 14840 CACGGCTCACTTGTTGACTTTG | 25824 GCACCTGTGCCCAGCTACT | 36808 |

FIG. 36E9

| | | | |
|---|---|---|---|
| 3183 GCCAGACGAGTCATCTACCCTTGT | 14841 TGCCTTGGATGATGAGTTGAGAAG | 25825 CTCTTTCAAGCCAGACGAGTCA | 36809 |
| 3184 CAGTCACTATTACTGTACCAGGAGTGAT | 14842 GGCTGTTTGCGCAGGTCTGA | 25826 GCTGATGTGTGCACAGTCACTATT | 36810 |
| 3185 CACCCAAACATTGGCTTTTCTTCCAA | 14843 GACGTCCCTGCCATTCCCAATCT | 25827 CCACGGATCCTCACCCAAACAT | 36811 |
| 3186 GAGGCACTGGTTTTGGAAAAACAACA | 14844 ACCCACCCAGCGACAGGTT | 25828 ACAAAAGGATGAGGCACTGGTT | 36812 |
| 3187 CATGGTCCCCACCCACAAG | 14845 GACTGATGAGTCTGGGTTCACATC | 25829 AGGGTGCAGGGCTCACAGTAA | 36813 |
| 3188 GAGGGAGAATACAGTCCATGTTTGT | 14846 GGCTGCCAACCACCACTAGA | 25830 GCGGCTCTGAGGGAGAATACA | 36814 |
| 3189 AGGGCAGGGAAACTGGTGAGGTA | 14847 CACCTCTCAACACTGGTCTTTCT | 25831 TTGTTGGAGGAGGGAGGGAAAC | 36815 |
| 3190 GGCAAAGTGGAGAGATCCAGAACA | 14848 AGAGATCTGGGCCAGCCAAAG | 25832 GCAGGTTCAGGCAAAGTGGAGAGA | 36816 |
| 3191 CTGAGAGGAGAAACTGATGCTTCTT | 14849 TAGGCACTGCAGCCCTTTCA | 25833 GAGAAGCCCACTGTCTCTCTGA | 36817 |
| 3192 GGTAACCACCAGTGGCCATTCT | 14850 TTGCCACGCAAGGCTACTT | 25834 GAAGGAAGACTTAAACTGGTTGGTAAC | 36818 |
| 3193 TCTGAGGGGCTGGGAACTGA | 14851 ATGGCTGGCTGCCCAGGTAA | 25835 TGTGGTCTCAGCTTGGTCTGA | 36819 |
| 3194 CCAAGTGGTCCCATTTCCCCTTA | 14852 CTCTGCTGGTAGGGGTGATTGAT | 25836 ACATACTCTTCCTTCCCTCCAAGT | 36820 |
| 3195 GGTGTTGCTGGAAAGGTAGGAT | 14853 GGTTGTCAAATCCCAAGTCCAGTCT | 25837 AGATGAAGTTAGGTGTTGCTGGAA | 36821 |
| 3196 AGGAGGGTCACCTTTGTGTCT | 14854 GCCTTTCAAATCCAGTGGTGACAAAC | 25838 CCCACCAATCACCATAGCCAGTA | 36822 |
| 3197 CCAGAAACCGTGAGTCCTGTCA | 14855 GGACCCAGCCTACATCACATTC | 25839 GGACATGGAACTGTGACCCAGAAAC | 36823 |
| 3198 GAACCGCATAGACCAGTCTACCTA | 14856 TTGGGGACACTGTGGAGCAA | 25840 CCCCACAAAGAACCGCATAGA | 36824 |
| 3199 TGGCATCAACTCCCTTTCTTCAA | 14857 CCTACACAAGGAGGGAAGAGTGA | 25841 GCAAACACATGTTGGCATCAACT | 36825 |
| 3200 TTGTCCCTGCCTGAAGGACTCA | 14858 GAATTCCCAGGTTGAGGAAACCTA | 25842 CTCACCCCGAGACCCTTGT | 36826 |
| 3201 GGAGCAATGTCTACAAGGATGAGATG | 14859 AAGCCCCAGCCCACTGGAT | 25843 GAGGGAAATCAAGGAGCAATGTCT | 36827 |
| 3202 GGCACACAGTCATGGTAGAATAAACTT | 14860 GTCTACAGCACCTTTCCACACA | 25844 TTGGATGGCACACAGTCATGGTA | 36828 |
| 3203 CAGTGACCAAGTGGGAGAGAAG | 14861 TCCACCCAAGGTGCCTTCTTA | 25845 CATGGCACACAGTGACCAAGT | 36829 |
| 3204 CACAAAATTCCGGGAGATGAACTGA | 14862 GCCTTCACAGCCAACACTGA | 25846 GCCCGGGAGCTATGACACAAAT | 36830 |
| 3205 CTGCAGCAGAGGCTTGCAAGT | 14863 TCCTGCTAATCTGGCTTTCGTT | 25847 GGCAAAACTTTTCCTCAACCCTCTTAG | 36831 |
| 3206 GACAGGACTTGCACAGAGCATGA | 14864 CCCACAGGAACTGTCCATCCAATC | 25848 ACACCAACAGGGACAGGACTTG | 36832 |
| 3207 GATGACAGACACGCAGGAAGA | 14865 CCTGTCCCCAGGACATTGAAGT | 25849 ATGGTCAACGTGATGACAGACA | 36833 |
| 3208 ATATCCGCCCCATCTCCTCAGT | 14866 CCCAAAGAAAGCCCGTGTGGTT | 25850 TGTTTGTAACCCCTCCCTCTCT | 36834 |
| 3209 CAAACCCAATGCTACACTCCACTT | 14867 CCACCACCACGATGGGAAAGGTACT | 25851 CCTGTTTGAACAAACCCAATGCTA | 36835 |
| 3210 GGGCCTGCCTCCAAGAGTTA | 14868 ATGTCCCCTAGGCAGGCAGAT | 25852 CAGGCCCTGGGGAATACAGA | 36836 |
| 3211 GTCGGCAGTTCTGGGCATGA | 14869 CTCTGCCCTGCAGACACTGAA | 25853 TGGGAATACGGTCGGCAGTTC | 36837 |
| 3212 CTCACAACCCAGAAGCCCTTGA | 14870 TTTCCCACGGCTGCTCACT | 25854 CACCTATGCTTCCCCTCACAAC | 36838 |
| 3213 GCGCCTTCCTTCCTCCGTTT | 14871 CAGTACAGAAAGTCCTGTGGGAACTA | 25855 TGTCCCTGCGCCTTCCTT | 36839 |
| 3214 TGCTGGCCAGACCCTGCAT | 14872 CAGGGCTCGTAGCCTTGTTCTA | 25856 GCCACAGTTGACTCTGCACTCCTT | 36840 |
| 3215 GCTTTGCAGACCAGCAAGGAA | 14873 AGGGCAGATTGCTGACTTTTTGA | 25857 CCAGCCCATTTTGAGATAGAGCTTTG | 36841 |
| 3216 GGCCCATCTTGGGGTTCAGTT | 14874 GCTCCACACTGCCGCAACA | 25858 AACCCCTTGACGGCCCATCTT | 36842 |
| 3217 CCAAGGGCAGGCAGTGTTTTG | 14875 ACAGCCACCCTTGGCAAAC | 25859 CCAAAGGGTCGCTACACCAA | 36843 |
| 3218 CCATCGTGGAATTTTTGTCAATCT | 14876 ACAACATTGACGGCTTTGGTATG | 25860 CCAGATGGAAAAGCCATCGTGGAA | 36844 |
| 3219 GGAGAACTGGACGGTTGTGAAG | 14877 GCCATGGTCCCTCCCAAGTTAC | 25861 ACGAGGCCCAGCTGAACAA | 36845 |
| 3220 CCTGTTGAAGCCACTAGACCAA | 14878 AGACTGACCACGCCGGAAAA | 25862 CCTCAGCTTCCCAGATACCTGTT | 36846 |
| 3221 GTGTGATCTGGTGGCTTCACA | 14879 CCACTGCACCTGGCCTGTTTTT | 25863 CCAGGACAGGCATTGAGTGTGA | 36847 |
| 3222 AGTTCCCTGGGTGGAGGAACAA | 14880 GCCTCTGGTTCCCCTTTCTGT | 25864 TCCCTCAGATGCCTGCTGTTAC | 36848 |
| 3223 GTCCCAAAGCAGCCATAGACA | 14881 GGAACACAGCCATGCCCATT | 25865 CCTGCTCGACTCTGCTATTGT | 36849 |
| 3224 GGTGCAGTTGAATGTGGCCTTA | 14882 GCTGCCCAGCGTTCAATATC | 25866 AGAAATCAATGGGGTGCAGTTGA | 36850 |
| 3225 CCTCCTGCCACCACGTGAA | 14883 CGGAAGGCATAGGGTAAGCACTGA | 25867 GGCACTTCCCCATCACTCTTTCT | 36851 |
| 3226 GTGAGCAAGAGACCCTGACTGA | 14884 CAGGGATCAAGCTGTGGCTTAG | 25868 GGGTGGCCTGAGCTAAGAGT | 36852 |
| 3227 CACTGCACCATGCTCTTCATGT | 14885 AGGGAGGCAGTAGTAGGGTTTGA | 25869 AGTCACCCCACTGCACCAT | 36853 |
| 3228 GATGGCCGGAAGCAGAAGT | 14886 AAGGGCTTTCCCCGCTTTTG | 25870 GGCAGAAGGGGAAGCAAACA | 36854 |
| 3229 TCAACCTCCCGGGCTAACATGA | 14887 TCCCCGCTACCCAGGAGTCTAA | 25871 TGGGTTGCTGCTACTCCCATGGAATC | 36855 |
| 3230 CATGGAATCACTCAGTGTCATAGTCA | 14888 GGTAATTTCTGGGCTGACAAGGTT | 25872 TTGACTGCTACTCCCATGGAATC | 36856 |
| 3231 TGGACACACAGGTGGAAGATG | 14889 CCACAGGGCATTGCAGGTTAC | 25873 CTGAGAGCCTTAAACTGGACACACA | 36857 |
| 3232 ACTCAGTGGGTTCTGGATGTGA | 14890 CCCCTGCCCAGTTTCCAAAT | 25874 AGGAACTTCCCTCTCCTTTACTCA | 36858 |
| 3233 CCACCTAGAAACCCACGACAAA | 14891 GCAACTTTGACTCACCTCACTGACAA | 25875 TGGGACACCTAGACCACCTAGA | 36859 |
| 3234 CTCACAAAGGGCTACAGGGCATT | 14892 CGATGAGGACACTTCCTCTTTCTGA | 25876 ACCAGGTCCCAGACCTCACA | 36860 |
| 3235 GGATAGGCAACTCTCAGGGCAAAT | 14893 GGGTCCTGCAGACAAACCTT | 25877 GCACACAAAATGAGGATAGGCAACT | 36861 |
| 3236 CTGGCCGATGGGGTTCATC | 14894 CTCCCAACTGAGATTTGCGATATAATCTTC | 25878 CACTTCCCAGTTACCCCTCAGTTC | 36862 |
| 3237 CTGGGCTCAAACAATACTTCTACCTTAG | 14895 CACCTGTGGTCCCAGCAACT | 25879 CCTCAACCTTCTGGGCTCAAAC | 36863 |
| 3238 GAGGGACTAAGCACAGCAATACAAAG | 14896 CCACCTCCAGGCCTAAGAAATC | 25880 AGAGGTAGGCACAGGGACTA | 36864 |
| 3239 ACACCCAACAGCCCCTGATAGA | 14897 ACTTCCTCCCTGGTCCTGATGT | 25881 GGCCTTAGGGACACCCAACA | 36865 |
| 3240 CCCTGATCTTGCCTAACCCTTCAGA | 14898 CACCCATGCTCCTTCCATCAGA | 25882 CACACATGCCCTGATCTTGCCTAA | 36866 |
| 3241 GCCAAGATCCACTGTTAGACCAAGA | 14899 GCTGAAAGCTGTGGTTTGGTTTTG | 25883 CACATTAGGCCAAGATCCACTGT | 36867 |
| 3242 GGAAAGCTCTCTGAGCTGAAAATG | 14900 AGCCCCAGTTCCCCACAACTAA | 25884 GTTGATCATCATGCAGGTGGGAAA | 36868 |
| 3243 ATGTGATGGCTTTGGACCAGAT | 14901 TGCTGTTGGAACTGGAAAGAGTT | 25885 GCCCTTTTCAGCTGTAATGTGATG | 36869 |
| 3244 GGAGACAGCTAGGGTGTGGACAT | 14902 CCATCCCCGCTCCAACTCA | 25886 GGACGTGAAGAGAAGCGGTTT | 36870 |
| 3245 GTCCACCTGACTTGCATTCTTTCTCT | 14903 CCCTCTGGAAGCTTGTGTCTAGTT | 25887 CCCACATGTCCACCTGACTTGCAT | 36871 |
| 3246 CCCTCCCAACTCTGAAGTTTGT | 14904 TGTATCTGCGGCTGAATTGAGAA | 25888 AACCAGACCCTCCCAACTCT | 36872 |
| 3247 GCTGTGTCAACCCTCAAAGTTCAGA | 14905 GGTTTGGTCTGTGGCTGCATAG | 25889 AGGCGAAGAGCTGTGTCAAC | 36873 |

FIG. 36E10

| | | | |
|---|---|---|---|
| 3248 TGACTACAGCTCACTGCTCTTG | 14906 CAGTTAAAGTCCGAGGAGGTGATG | 25890 TGGGCTGACCACTGACTACA | 36874 |
| 3249 GTCATCGGAAGTTAAGCCGCATCT | 14907 GCAACTGAGCATCGGAGACT | 25891 CCGAAGTCGTGTCATCGGAAGT | 36875 |
| 3250 GCAATGTAGGAGTGGATGGCTTT | 14908 CCTTCAGCAACTGTAGCTCCTCTAC | 25892 GCTGGATTAGAGTAGCGGCAATG | 36876 |
| 3251 GGGTTTCAACAACTCAAGTGCAA | 14909 CGGTTGCCTCTCTCTTTACTGAT | 25893 TCCGTCTCAGGAGGGTTTCA | 36877 |
| 3252 CTGGAAAATCACCTAATTCAAGCCCAAATC | 14910 GGTGCGAGGAGGGGTTTGT | 25894 CTGCCTCCTTCGATCTTCTGGAAA | 36878 |
| 3253 CCAAGCATATCATTTACTCCCCATTC | 14911 GAAGTTCCCCGTTGCACAGA | 25895 GTCCCCAGCCAAACTTTCCAA | 36879 |
| 3254 CTGGCAAGGGTTGGAGACACAT | 14912 GCTTGCCAGCCAACCTGTTA | 25896 CAGGTAGTTTGTCGAGAGCAAGTCA | 36880 |
| 3255 TGGGGACTTGTGGTGCCTTTTC | 14913 CCAGTTGGTCCATGGGCAGTTA | 25897 ACAGACCAGAGTGGGGACTTGT | 36881 |
| 3256 CGGGAGATTAAGCGCCAGTTAC | 14914 GGGTGGGCCATTAAGACAGTTC | 25898 TCCTCCAGTTTCCACGGGAGAT | 36882 |
| 3257 GCATAGCTGGTCACACACTCT | 14915 GGAGGAGAGAAGCCTTGGGATTTG | 25899 GAGTCTCTTGAGGCACTTAGCAT | 36883 |
| 3258 GGCTCCATCCTCAGGCTTCA | 14916 CCAGGAAGCTCAATATGGAAGTGA | 25900 GGACGTTCAAACCCTGATGAAAG | 36884 |
| 3259 CGAGGTGAGACGCTATCTATGCAA | 14917 GCCGTGGCTGTCCAAATGTT | 25901 ACAATGCTCCCCGAGGTGAGA | 36885 |
| 3260 CGCTCCTGCAGGTCTCTGT | 14918 TGAGTTCTGTCAGTCCGTGAAG | 25902 ACTGATGGAGGTGGCCTGAA | 36886 |
| 3261 CAGGCTATGACATCAAGGCTTTCT | 14919 AACACCATCGTCCGTCATGATT | 25903 CAGCTAAATCCAACAGGCTATGACA | 36887 |
| 3262 GCCTCAATGGGAGCTTCTCAAC | 14920 CCCACATCCAGGATACTTGGCTTTT | 25904 GCCAAGAAAGGTCGCCTCAATG | 36888 |
| 3263 GAGGACCAGGGAGTGGAATGAAGT | 14921 TCCGACCCTTCTCCCACATT | 25905 GCCATCACTGTATCCTCTCCATCACT | 36889 |
| 3264 CTGCCTGGAATGCTCTTTCTCTAGATTT | 14922 GTCTGCGTGGAGGGAGAGA | 25906 GGGTCCCTCTGCCTGGAATG | 36890 |
| 3265 CAGTGTCAGGAAATGTGCCTTGT | 14923 TCCCGTCTCCCATCACACAT | 25907 GCCCCTGCAGTGTCAGGAAAT | 36891 |
| 3266 GGATGGCTGATGCTTCCGATT | 14924 GGTTACATTGCCGGTGATCAAG | 25908 GGAACAAAACCATGGATGGCTGAT | 36892 |
| 3267 CGCGTGCCTTACATTGGTGTCA | 14925 CCGCTTGGCTCTCATTCTCT | 25909 GCGAAACGCGTGCCTTACA | 36893 |
| 3268 TCGGCTTGACCAACTACAAATTCT | 14926 GAGCCTGGGGAGAGGATCA | 25910 CCACACTCGGCTTGACCAACT | 36894 |
| 3269 TCGCAGTGCCTGGTTCTCTGA | 14927 GTATGTGAAGATGGTTGCTTGGAATC | 25911 GCCCTGCCTAACCACATGTTC | 36895 |
| 3270 AGTTGCTCTCCCAGCCAAGA | 14928 CCCAAAGCACTAGAGACTGGGTCAT | 25912 CTCCCTTAAGGAAACCCACAGTTG | 36896 |
| 3271 GAGGACTGACAGGTTCCTGCTT | 14929 AGGCCTGGGTTGCCTTGTAAC | 25913 CTTGACTTGCTGAGGACTGACA | 36897 |
| 3272 CCGCAGAGACAATGTAAGATGTTC | 14930 GGCCAAGCAAGGTGGAATCT | 25914 GGGAAGGTCCGCAGAGACAAT | 36898 |
| 3273 AGCCACACTGCCTCAGCAAA | 14931 TGTGGACAGCAGCGTCTCTAAG | 25915 GACATGGAAAAGGCTGGAATGTAG | 36899 |
| 3274 CCTCAAACCTCCCTGTGGCTAA | 14932 GGTCATGAACATGGAAGGAACAAGATT | 25916 TGCTGATCCACATACCTCCTCAA | 36900 |
| 3275 CATGACCCTGCTCACACCTT | 14933 CTGAAGTCCAACAGGCATCTCA | 25917 CTTCATTGAATCTCCAGTGGGAACA | 36901 |
| 3276 TCCCAGTGTTCCCTCACTCA | 14934 GACTTCCTTTCTACCTTGTTGCTGAT | 25918 TCCTGGTCTTCTCCCAGTGTT | 36902 |
| 3277 CCCCAAACCCTTTCTGGTGTT | 14935 CACCATGAAGTTCAGTCCATAGTCA | 25919 CCAAAATAGCTCCCCAAACCCTTT | 36903 |
| 3278 GCCCAAATCCAGGGACAACA | 14936 CCCACCGTCCTGCATACTCA | 25920 AGCCCAGGACCTGCCCAAA | 36904 |
| 3279 GCCGGCTGGTTCCATCACT | 14937 ACGTAAGTGAATGAGGGGAGAACT | 25921 TTGCCCTTGCTGGTGCTGAA | 36905 |
| 3280 GAGCTGGGTTCAAACCAAAAGT | 14938 TCACTGCACCATTTTCCCCAAT | 25922 CACTGACTGGAGCTGGGTTCAA | 36906 |
| 3281 GTGCATTCTCCATCATGGCATTGAAA | 14939 TCCTCAGGGCCTTGGGAAACAT | 25923 ACGAGCCAGAGACATCCTTAAAAA | 36907 |
| 3282 GCTTGGCCTCTTTCTGAACCTACTA | 14940 AGCCTGCCTCACATTATCCTTTC | 25924 CTCCAACTGCTTGGCCTCTT | 36908 |
| 3283 GCTTCCCAGCATGAACCCTTT | 14941 GGCAGGGAGGTCCTGACTGAA | 25925 ACTTCTTTGAGCTTCCCAGCAT | 36909 |
| 3284 CCTTCCCTGAGAATAGCACCTGTT | 14942 CTGGGACAGGACCAAATCCAACTAC | 25926 AGAAGAGATGTCCTTCCCTGAGAAT | 36910 |
| 3285 ACACTCGTAACAGCATCTTTCAGA | 14943 GCTAACTCTGACAGGCTAAGTGCTA | 25927 GTCGAATTGACAGACACTCGTAAC | 36911 |
| 3286 TCTCTGGCCCTCAGTCCTTTGT | 14944 ACTGGAAACCCATGAAGACTCCTA | 25928 GGAATCTACACCACTGCCTCTCT | 36912 |
| 3287 CAGCCACATGAGTCCTTTCCAGAT | 14945 GCCAGATGGTGCTTGGTTCA | 25929 CACCACACTACAGCCACATGAGT | 36913 |
| 3288 TCTTGCCAGGTAATAGCCTCAAC | 14946 GGGCAATGCCTGAGAAAATGGTA | 25930 GTCTCGAGGAGAATAGCATGTCTTG | 36914 |
| 3289 ACCAGGGAGACTAAGCAAACACTTTTG | 14947 TCCAACTGGCCTTTTTGGAACA | 25931 CTGTGTAAACTATACCGGGAGACTAAG | 36915 |
| 3290 CATCCCTTCCCTACTTCTCCATTC | 14948 TCAGAGGCATGTTACCCTCTCT | 25932 CAGCTACTTCATCCCCTTCCCTACT | 36916 |
| 3291 CCCGTCCAGTTGGTGCTCAT | 14949 GATGGCACAGAGAGTGCTGAGA | 25933 CAGCAAGCCCGTCCAGTT | 36917 |
| 3292 GCCTCAAAACCAGGGAGGATGACA | 14950 GGGCCTTTTGGCCACAGACTAA | 25934 GCTCAGCCCAAAGCCTCAAAAC | 36918 |
| 3293 GGCAAATAAACTCACTTGCAGGTAT | 14951 AGGTTCTGTCCCATACGGTTTTG | 25935 GCTGCCATTCAAGAACAGCAAT | 36919 |
| 3294 GCAACGGGAACTTCCACTCACT | 14952 CGCTCAGCAGCAGCCGTGTAACTA | 25936 GAGATGGAGGTTATGCATGGATTCT | 36920 |
| 3295 AGGAACCAGTAGGGCTATCACA | 14953 AGCTGCAGGTTGCAGTTCA | 25937 GCCATCACCATGCGATGAGGAAAG | 36921 |
| 3296 GGCATGCAAGGAGAGAGGAAA | 14954 ACGCATCCTTAGTACCTTATGCAA | 25938 CAGACAGGAATGGGCATGCAA | 36922 |
| 3297 ACCCACCCTGCCTGTTATGT | 14955 GTAAGGTACGGTCAGTAGTGTAGAAG | 25939 TTAGCGATCCCAGTTCACCTAAC | 36923 |
| 3298 CCTTAACTTCCTGCAGAGCTTCAAT | 14956 TCAGAGGCCCTTGGCTGATCT | 25940 GCAGCTGAAATCTGCCACCTTAACT | 36924 |
| 3299 GTGGGCTCCAAAGTTCCCTTTAC | 14957 TCCTTCTGCCTGAGAAAAGCAA | 25941 TGCAGGACAGTGGGCTCCAAA | 36925 |
| 3300 CTCGACATGGCCCTAGGTAATGA | 14958 AGAGCCCTAGGGAGCTCATGGTA | 25942 GCACAGGAATGCATGAAGCGAAAC | 36926 |
| 3301 GATTTCTTTCCTGAGTGAGGTCCAA | 14959 TCACTGATCCAGACCCCAAGA | 25943 GGACTTGCCCTGATTTCTTTCCTGAGT | 36927 |
| 3302 GGGGATCTTTCGCCACAAGGAA | 14960 TGCCAGTCCAACCAGCATAG | 25944 GTCTCTATCTCAGTCTAAGGGGATCT | 36928 |
| 3303 CCTTCAACGCAAAGTGCACAAC | 14961 CCCAGTGGGCAGAACTTTGA | 25945 CACACATCTGGTCATTTCTCCTTCAAC | 36929 |
| 3304 GCCGATAGTCCCAGCTGTTT | 14962 GGGGCTCAAGTGATCCTCCCATCT | 25946 TCGTGGTGCATGCCGATAGT | 36930 |
| 3305 TGGTTTAGCAAGCAGACAGCAT | 14963 TGCCCTAGAGCAAAGGGTATATTTC | 25947 CAGCTGCAAGGTGCATGGTT | 36931 |
| 3306 AGCGTTGGTAAGAGCCATTGATT | 14964 GTTCCAGGCAACAGGAGTGA | 25948 GGAACCTGCAGCGTTGGTAAGA | 36932 |
| 3307 AGGTGGGCTGGGGTCATCT | 14965 TCTGCTGCTCCCTGCTCCATT | 25949 GGTGTGTGTGCTGTGCTGAT | 36933 |
| 3308 TCAGCAGGCACTGGCGAATC | 14966 GGGCACTTTGCCCGTGTAATTCT | 25950 GGATCCTGTGAAGAGGCCAAAT | 36934 |
| 3309 GGTTCTGAGGTTCTATCCAAATGTCTTC | 14967 GCCACTAGCCTCCATGTCAAG | 25951 CCTCTCTGGGCATTATGGTTCTGA | 36935 |
| 3310 CTCACAGGGGATGGTGCGAATG | 14968 CTGTGGGCACAGGAATCATCT | 25952 GGCTGTGTGTCCGCTGTGTA | 36936 |
| 3311 TCAGGTGTAGCGGGCAGTTAGT | 14969 AGGACAGGAGGCAGGTTCAAGT | 25953 CCGTGGCTGTCTGAGATACACT | 36937 |
| 3312 CACCTTTCCCAAGTGGCCTTT | 14970 CCTCTGTGTGTTGTGCTTGGAA | 25954 CGTCAAGTTCAAGTCTCACCTTTG | 36938 |

FIG. 36F1

| | | | |
|---|---|---|---|
| 3313 TTCCCACGGAGAGGAGAACACA | 14971 GCCAAGCTCCGTGCTGGTAA | 25955 TGCTGTCTGCCCACAGACTT | 36939 |
| 3314 ATGGCTGCTGCTGCCCTAGA | 14972 CAAACCGAAGCAGACATAGTGAAG | 25956 GCGCTGCTGTCTCTGGAAAT | 36940 |
| 3315 CTGTCGGAAAACAAAGAGCATCTGA | 14973 GCAAGATTGTGTCTGGAGGTTCA | 25957 GACAGAGTTCCTGTCGGAAAACAAAG | 36941 |
| 3316 TCTCAAAGACGACCAAGTGATTCTT | 14974 CGGTGAGGCTTTGGAGAGTTTTG | 25958 CATCGCAGCGAGCTCTCAA | 36942 |
| 3317 CCTCCTGAATTCTGAGGCCTTT | 14975 TCCTGCCTTGGGACATGGAA | 25959 CCAAGTTCGCACACCTCCTGAA | 36943 |
| 3318 GGAACAATGCCCAGCCACACT | 14976 ACAGCGGGGCATTCACAGA | 25960 CACTCTCCAGCATCTTAAGGAACAA | 36944 |
| 3319 AGGCTTGGTTCAGTGGCTCTA | 14977 GATGGAGAGCATCTGGGTCCTT | 25961 GGGAAGCTTCAGGCTTGGTTCA | 36945 |
| 3320 ACTCCGCTGCTGAGGACTA | 14978 TGGGTCCACACTGGTGGAATGA | 25962 GCCATCCAGAACCATTCCTGTCA | 36946 |
| 3321 GAACTGAAGATGCACCCACACTA | 14979 TCTTGGGGTGGATTGGGACTT | 25963 TTGGAGAGCAGTTTGAGCATCT | 36947 |
| 3322 GGACCACATGCCTGGTTAGTCA | 14980 ACAGTCAAGCAAGGGGTGTTATG | 25964 CGTGTAGGCTGGGACCACAT | 36948 |
| 3323 GCCACCAGAGCTTGACACTGTT | 14981 CTGCCCACTGTCACTACTGCAT | 25965 GGAAATGGCCACCAGAGCTT | 36949 |
| 3324 GAGAAGTAGGGGCATGTGTGTGA | 14982 CAGGATGGAGTCACACCGATAACTT | 25966 AGAGGAAGAGGGTGGAGAAGTAG | 36950 |
| 3325 GACCAGAGCAGATTTGGATGAGA | 14983 CCAGCCACCACAGTCCATCA | 25967 GCCGGAAAATGACCAGAGCAGAT | 36951 |
| 3326 GGAAAAGCTACAGCCTACCCCAAA | 14984 CCTTCCGGAGGCAAAGGAAACA | 25968 CTGGGCAACCGTCAGGATTATG | 36952 |
| 3327 TGAACACCAACAGTAAGAGGACAA | 14985 GTCTTGACAAGTGGCTCGCAGTT | 25969 CAAACCAAAGTGAACACCAACAGT | 36953 |
| 3328 ACGGATTACCTGTGTGCCATT | 14986 GCATTGCCCCGTAATACCTATCTTG | 25970 TCACAGTGTGCCACGGATTAC | 36954 |
| 3329 AGGGTGGGCGACCAGTTTG | 14987 GGCTTTGCATGTTGGTGGGATACT | 25971 CCTTGCACAGAGCGGAAAGGAT | 36955 |
| 3330 GGACTTCAGGGAGCTTCTACTCA | 14988 CATGTAATGCCTGCTCCCTTTG | 25972 TCTGCTTCCAGTGGGGACTT | 36956 |
| 3331 CTTCCAACACAGGGAATCAAAGTTCA | 14989 GATTTGCTTGGCCCTGGTAAGT | 25973 CCTCACTTCCAACACAGGGAAT | 36957 |
| 3332 CACCACGCTAGTTGGTGATAGAAC | 14990 GGAGCTGAATGCTGCCTGGAT | 25974 CCTGAGGTCACCACGCTAGTTG | 36958 |
| 3333 GCCTTGCTGTCCTCCAAACT | 14991 GGTGGTACTGATGCTTTGGTCTGA | 25975 CCGTCACCCAACCCTCAAAAGT | 36959 |
| 3334 GATGCCACTGTCATTCCAGACA | 14992 CCCTGTAGCTTTGGGCTCCTT | 25976 ACCAGCACCTAGATGCCACTGT | 36960 |
| 3335 AACGTCTCGCCACTCCCTGTCT | 14993 CCCCATGGTCTCAGGCTCAAG | 25977 TGCATGATCCAGGCGTCAAC | 36961 |
| 3336 GTGGTGCTGGATGGGAAGGAA | 14994 CGCGGACACCCTTGGAACA | 25978 GACTTAGGGAAGTGGTGCTGGAT | 36962 |
| 3337 CAAGACACCCATGCCCTCACTT | 14995 GAGCCAGTCCAATGGTCTCCTT | 25979 CCCCAGGTCTGTAGCAAGACA | 36963 |
| 3338 GCTTCAGCAAGTCATCCTGATCT | 14996 CAGCACCGACAGCAACGAAA | 25980 GCCTCCACTGAGCTTCAGCAA | 36964 |
| 3339 CCTCGAGGAACTTCGCCTTT | 14997 CGGTTCTGAAACAGGGAGTCTT | 25981 AGCCGCTCCCTTCCTTTTC | 36965 |
| 3340 TCAACCTCTCAGGCTCTAGTGAT | 14998 TGCTGTGGTCCCAGCTACTT | 25982 ACTGCAGCCTCAACCTCTCA | 36966 |
| 3341 TCCGCTGCACTCAAAACGAA | 14999 TGTCAGCAGAAAATGTACAGTGCTA | 25983 CCAGAGTCAGCAGTAGGAAGGAGTTC | 36967 |
| 3342 CCACTCACAGAAGTGCCACTGTTTC | 15000 TGGCCACCTGTCCATCTCCAA | 25984 GCCTTTAGCTCTCCACTCACAGA | 36968 |
| 3343 GCACCCAAAATGGACATCAACA | 15001 GCCTCTGGCCAGCCTTCAAAAT | 25985 GACTCGGTTGCACCCAAAATG | 36969 |
| 3344 GGCCAGCTCTTCACTGCAT | 15002 GGGCACAGAAACTCACTGTTCAA | 25986 GCAAGACACAGGCACTCTGATG | 36970 |
| 3345 GCACTAACACGTAGCCTGAGTAATG | 15003 TGAGCCTGGTCCTCAGACAAGT | 25987 TCCTAGGATCTGCACTAACACGTA | 36971 |
| 3346 TGGTGTGGTTGCGGGAGAAG | 15004 CAATGAGCTTCCCGTCCCACTT | 25988 GGGGAAGGAATTCAGGGAGAGACA | 36972 |
| 3347 CCATCGTGCTAGGCAGGTAGT | 15005 CCAGGCCAGGGCTGTTAGGATA | 25989 GGCTTGAGGCCATCGTGCTA | 36973 |
| 3348 CCTCTTTACCTTCCAGCTCCTTGCAT | 15006 GAGCCCAGTAAGAAGTGGAGACA | 25990 CCCTGTGGATCTACCCCTCTTT | 36974 |
| 3349 GGTGGCGAAGACCACAGTAAAG | 15007 CAGAGCCGAAGAAGAGTGAAGTT | 25991 AAGGGGCATGGTGGCGAAGA | 36975 |
| 3350 GGAACTTCAGCTCCTGGAGCAA | 15008 GGTGGCAAAGCAGATTCATTTTTCTCCTAA | 25992 CTCCCCACTAAGGATGAGGAACT | 36976 |
| 3351 TCCCTGCAGGTGAAATCTTGTT | 15009 ACCATGAGGAAGAATTGGCCTTT | 25993 GGCTGGCTAACAATGGGTTATCTCT | 36977 |
| 3352 GGGACATTTGACCAGAGACAGAA | 15010 GCATAGCATCCTGCTCCAGTT | 25994 AGAGAGGCAGAGGGACATTTGA | 36978 |
| 3353 TCTCCACCTACCCCTTTCTGTAG | 15011 GGACTAGGGAGCCATGTGGAAGT | 25995 CCATTCGCAGTAATTCTCCACCTA | 36979 |
| 3354 TCTGGCAGGGCTGGAGTAGA | 15012 TCCAGTCTCATTTTGCACTGTTCT | 25996 GCATTGAGAAACTGAAGCACATCT | 36980 |
| 3355 CCCAGCAGCAATGTGGAACA | 15013 GCTTCCCTGGTTGGTAATACTCTGT | 25997 CAGCTTAATTCTCCCAGCAGCAA | 36981 |
| 3356 TCTTTCCGCTCTCCCTTCTCT | 15014 GTAGCGGTTGCTGCTTGATG | 25998 CCAGGCAAGTGACCCTGTGTTA | 36982 |
| 3357 CCAAGACACGGAAACTCCTCAT | 15015 CCAACGTAGGTCTGGACTGATG | 25999 GTGCAATCGTGCTTTCCAAGACA | 36983 |
| 3358 GGATCACTTGACCACAGGAGGTT | 15016 TGATGCGAACATGGCTCACT | 26000 GGTGTGGTGGGAGGATCACTTG | 36984 |
| 3359 GATCTAGCTCCTGCCTACTTCATGT | 15017 CTGGGGCAGAGCAAGTGGAAAA | 26001 TCCTCTAAGGAGTGGCATGATCTA | 36985 |
| 3360 CTGTGTCCTACTGAACGTTGTACTGA | 15018 GGCTCCTAACCACTAAGAACACA | 26002 TGCAAGTCTGTGTCCTACTGAAC | 36986 |
| 3361 GCATCACTGCCTTCCAACTCA | 15019 GGGAGGGACAAGAACTGTGAGA | 26003 CCCTTTGCTCAGCCATGCATCA | 36987 |
| 3362 GGAAAAACAACCCGGGGAACA | 15020 GTTTGAGATGGTGCTACTGACTTAAC | 26004 GGCATTGATCACAAGTGAGACTGGAA | 36988 |
| 3363 TTCCTGGTATGACCCTGAACTTG | 15021 TGCTCCCAGAGTGCTCACA | 26005 CCTGACATGGAAGGGTTTCCTGGTA | 36989 |
| 3364 CCTGGGACATAGGGAGCACAT | 15022 CCCAAGGAACACAGACCCTAGT | 26006 CGCTAATGAATTGCCTGGGACATA | 36990 |
| 3365 CGGTTGAGAGGTTATATCTTAGGCCTGTTA | 15023 GCCCCGGCTGAAAGCAACCAT | 26007 CCCTACAGAACGGTTGAGAGGTT | 36991 |
| 3366 TGTGGCTGGGATGGAGATCA | 15024 CTTTTCTGCATGTGGCTTCCAA | 26008 GTCCTCCTTATTCCTTTCTGCTCTTG | 36992 |
| 3367 TCAGCCACACATTAACCCAACT | 15025 AGAGACCGACTGGGAGGATACA | 26009 TGGCAGTTTTCAGCCACACA | 36993 |
| 3368 TAAGGCGGTACAGGGGTGCTT | 15026 GAGCTGCTAGACAGTGCTCCTCTTTC | 26010 TGGGTGCATAAGGCGGTACA | 36994 |
| 3369 GCAGTTTAGCCTCTGGGTTGAAG | 15027 CACGCTCCAGCAACAAGAAG | 26011 GTCACTGGGAACGAGTGGTTCAA | 36995 |
| 3370 GAATACGCCAGGTCTTGTCAGT | 15028 GACTGGTTTCATCTCACCTGTGT | 26012 GCTCTCAGCATTTTCCAGGCATT | 36996 |
| 3371 CCCATGAAGGTTCTTGGCTTTG | 15029 CACCACTGACTCACCCTTGAAT | 26013 GTGGAGCTTAACCCATGAAGGTT | 36997 |
| 3372 CACCCTTGGATGCTGGTAGTGT | 15030 CCCCTCGGGTCTCAAGGATTT | 26014 CCACAAGTTGGACACCCTTGGAT | 36998 |
| 3373 GGTTGGGATTGTTTTGTCGGCTATTT | 15031 TCGAGCCAGGAAGGCAAGT | 26015 CTCTGCCTGGTTGGGATTGT | 36999 |
| 3374 GCAGACCTGTGTTTGAGACCTA | 15032 CTCAAAGCCATATCGGGAGCAT | 26016 ACTGTTTTCAGCAGACCTGTGT | 37000 |
| 3375 TCTTGGTGAGGTCCTGCAATTT | 15033 AGCTCTGGGTTGACCGTGGAA | 26017 GCCTGGATGTCTGCCATGATCT | 37001 |
| 3376 GGAAGCATCTGTCATCCTAGTAGTT | 15034 CACTGCCAACCAAGATCCTTATGT | 26018 CCTCCCATGTTGGAGGAAGCAT | 37002 |
| 3377 CGATACAGCTGTTGTCTCCAGAA | 15035 CTGATCCATAGGCCAAGTGACAA | 26019 GGGGATCAATAAGCCATCGATACA | 37003 |

FIG. 36F2

| | | | |
|---|---|---|---|
| 3378 GCCTCCACTTTGTGCAGTGT | 15036 GCTGTGGTCACGCTGTGAAA | 26020 CCTTGGTTGTGCCTCCACTT | 37004 |
| 3379 TGGAGGTGAGGGCAAGTTCA | 15037 TCACAGGCTTGGGAATGTCAAT | 26021 CCCTTGTCTAACCAGTGATACTGAA | 37005 |
| 3380 TGGAAAGGCTGGCTGTCTATG | 15038 CCCACTTTTGACCCTGGCCTTA | 26022 TTCTTCTGCAGACACAAATGGAAAG | 37006 |
| 3381 CAGTCCATCTTCTGTGCTGCTA | 15039 GGCCTGAGCAGGTGTTTTAGTA | 26023 TCCCTCGCCAGTCCATCTTCT | 37007 |
| 3382 CCCCTCCCCTATAAACCTTAGGAA | 15040 CTTGCCAAGCTGGCATCTAAGT | 26024 AGTCCCACCCCTCCCCTATAAA | 37008 |
| 3383 CTGCTCCAGGAAGCTGCTGAAT | 15041 CAGTGACTGCCCAATGTGGTA | 26025 TGCCAAGTCTGCTCCAGGAA | 37009 |
| 3384 CCTTGCGTGCTGGCTGTAGA | 15042 GCACTGGTCAACCTAGGAGTGCTAA | 26026 GTGCTCTGAAAGTGTGGGTCTTCT | 37010 |
| 3385 CTCAGGGACTAGAAGCACCAGGTA | 15043 TCAGCAGCCTCCCACACT | 26027 CCTTGAAAACACTCAGGGACTAGAAG | 37011 |
| 3386 GCAGGGTCTTCTTTTTCCCTCACA | 15044 GCACCTGCATCCAGCGATAAG | 26028 CCCCATGTAGCAGGGTCTTCTT | 37012 |
| 3387 GAGGTGCAGATCCACACTGTT | 15045 CAAGATGTTCCAAGGTAGAAGAGAGA | 26029 TTTTCCATTGAGAGAGGTGCAGAT | 37013 |
| 3388 GCCATCCTTTGCTGTCAGTGT | 15046 GGTAAGTTTGCTCCCCTACTCACT | 26030 GATTTTCAGCCAGCCATCCTTTG | 37014 |
| 3389 GCCATTTACCACCCAAACTGGAT | 15047 GAGGCTCTGGAAGACCATTCCTT | 26031 GGATGCAGCAAAAGTATGCCATT | 37015 |
| 3390 CAGGAACCACAGAGCCCCAAAT | 15048 GGTCCCTGAGCCAGGGCTAT | 26032 TGGAGACAGCAGGAACCACAGA | 37016 |
| 3391 CTGTTGTGACCTGATTCTCATGTATTC | 15049 GGGCTTTGGACCTTCAGCAT | 26033 GAGCCTGTTGTGACCTGATTCT | 37017 |
| 3392 GCAAGGAGTACCAGCTCAAGGTA | 15050 AGGATGGGGCTCGGAAAAAC | 26034 ACGATTCTGGAGGCAAGGAGTA | 37018 |
| 3393 GTCTCCATCAACCTCACTTGTTTAC | 15051 CCGTGCCCGGCATATTATTTTAGT | 26035 CGGCTATCTCTGTCTCCATCAAC | 37019 |
| 3394 GGTAGCCTCTTTCACTCATTGTGGTA | 15052 CCTCTCTGTGGAGGGGATTCT | 26036 CCCACATGGTAGCCTCTTTCACT | 37020 |
| 3395 GTGTTTTGCTGTTCTCCAGCAT | 15053 GGTTGCTTCTGCACCTGGAT | 26037 GGAGCAGGGTGTTTGCTGTT | 37021 |
| 3396 GTGGGAGAAAAGTAGCAGTGGAT | 15054 GCCTTTAGTTTGGGCCAGAAGAACT | 26038 GGGCTTGGGTGTGGGAGAAAGTA | 37022 |
| 3397 CAGAGCAGGTTTGATGATCCCGTTT | 15055 CGGCCTTGGCTCCTGTAGTTT | 26039 AGAAGAGCAGACGAGGTTTGATG | 37023 |
| 3398 TGGAAGACGCCTCCTCACT | 15056 CCATGATCCCTGTAAACAGCTCAGA | 26040 CCTCATCAAGCCCCATAGCCTCAT | 37024 |
| 3399 TGGCTGCCTTCTCCCTTCAT | 15057 CACACACTGAGACTGAGGAAAGA | 26041 CTGAGGCTTAACTCTTTGACTCGAATATG | 37025 |
| 3400 TGTACTGACCGAGGCTGTGA | 15058 CGACCAAGGGCCTTCAAGGAA | 26042 GAGGATGGAACCTGTGAAAACCTA | 37026 |
| 3401 TGCTTGCATTGCCAGAACTACT | 15059 TGACACAAACTGAGAACAACCAATC | 26043 ACTCTTGGCTTGCTTGCATTG | 37027 |
| 3402 TGGCCAAGTGGTCCTGCTTCT | 15060 TGTGCCTGCCAGCCAAGTT | 26044 CTGCTAGAGCTTCTGGCCAAGT | 37028 |
| 3403 ACCTGCCTAAGGCCACACT | 15061 GACCTTCGCTCTATTCCCTCTCAA | 26045 ACAAAGATGATGTCACCTGCCTAA | 37029 |
| 3404 GCAGCCTTTGGCCTCTTCTA | 15062 GTCAATTTGCTCTGGGAGATGGAA | 26046 GGTTATGTCAATGAGAGCAGCCTTTG | 37030 |
| 3405 CGGCAAGCCTTTAGCCCAAT | 15063 AACCAGCGAGGCACCCATT | 26047 CACTTAGCCGTGCAGGAACAAC | 37031 |
| 3406 GGCTCTCGTGCCCATTTCTTC | 15064 TGCCTCCTTGGCCAGTTG | 26048 GGGCAGGACTTGCATCAGGAA | 37032 |
| 3407 GCAGACTCAAGGTCACACTATTTCTCTT | 15065 GGGCAGGAGGAGGCAGGGAGTTA | 26049 AATATGCAACTCCAAGGTCACACT | 37033 |
| 3408 ATCCGGGACCCAGGTGAAAAAG | 15066 GCAGCTCTACAGAGAGGCAGACA | 26050 GGAGATCCCACCCAGTGAGGAAA | 37034 |
| 3409 TCACATGCCCATTGTGGGTTAG | 15067 TTCCAAAGCCATAACAACGAGTAAC | 26051 TGCTCACATCACATGCCCATT | 37035 |
| 3410 CCTCCAGCCACCAAATTGTTGTT | 15068 GTCTTCCAGAGCATTCATCGTTCA | 26052 GCCTTCCTCCAGCCACCAA | 37036 |
| 3411 GGACAGACAGGCAGGGAGAAAA | 15069 GTCCTCCTGTGGTTCCAGACTTC | 26053 GCCAAAGTCCACGGACAGACA | 37037 |
| 3412 CACACATCCCTTCCTCAAGGACAT | 15070 GATGTGCTGGGAGTCAGCTT | 26054 CTTGCAGCCCCTTACACACA | 37038 |
| 3413 CACAGACAGTGTGGAAGGCATCTA | 15071 AGCTGGACCAGGCCATTCA | 26055 GGACTGATTGGCAAAGACCTCACA | 37039 |
| 3414 CGAGCTCGGGATGGGGTTT | 15072 TGGCCCTTCCTTGCCCTTA | 26056 CCAGCCACAGTCATTCAGAGCAT | 37040 |
| 3415 GCTGATGCTTAGTGTTTGGACAAC | 15073 AGTTGGTCCTCTGCAATCTGCAT | 26057 GGCTCTCAGCTGATGCTTAGT | 37041 |
| 3416 GCCCTCTGCAAAACCAGTGA | 15074 CCATTCTTGGCCTATGTCTGCTCTTTAG | 26058 TGGATTACATTTGCCCTCTGCAA | 37042 |
| 3417 AGGTTCCTGTGTATCAGAATTGCTT | 15075 GATAGGGCCCAGAGGGGTATC | 26059 GGCCCAAGGTTCCTGTGTATCA | 37043 |
| 3418 AAGCCCACCCTTTCCCAACT | 15076 GTGCACAGGTGGGCATTATTAAG | 26060 CCAGACTGATGATCCTGGATGAAG | 37044 |
| 3419 GGTTGTCTGGAGTCAGTATGAGACA | 15077 GGGCATGTGAAACATCACTTGTT | 26061 CAGGTTTCCACCAGAAGGTTGTCT | 37045 |
| 3420 GGGATAGTCATTGTGCCCTGTT | 15078 CCAAGCCAAGCTTTCAAGACACA | 26062 CCTTTTGCTCACAGGGATAGTCA | 37046 |
| 3421 CACCAAATGGCTCATCCACAGA | 15079 GCTAGGCCACAGGAGTCACAGAT | 26063 GGGGAAAACAATGACCCACCAA | 37047 |
| 3422 CAGTAGGAGGGCAAAGTCACAGAA | 15080 GCCCCTGCGTCTTGGAGTT | 26064 GGGGATACAGTAGGAGGGCAAA | 37048 |
| 3423 GGAGAGGCAAGAGTCAAAGCTCAAA | 15081 CTTTCACCCAGCACCACGTA | 26065 CACACCAAGTGGAGAGGCAAGA | 37049 |
| 3424 CCTTCACGTTGCACGGGTATT | 15082 CGGCTCGGAACCTGTTTATTTAC | 26066 GGGGAACCTCCTCTTATTTCCTTCA | 37050 |
| 3425 TCAGAAGGTCTCTGTGCCATGA | 15083 TGCTGGATGAGGGTGCCTTTTG | 26067 CCCAGCCTTCTAGCAAAAGCAAAT | 37051 |
| 3426 ACCAGCCAGTCCCAGGTTTTC | 15084 CAAGCGCTCGGGATAAGTGAACAA | 26068 GGAGCAGGTGATAGCTCTTAAACA | 37052 |
| 3427 CCTGGGTAGTGCCTTTGCCCATTA | 15085 TGCATCTCCCTACCTGGCATGA | 26069 CTGTCACTGCACCTGTCAAAAC | 37053 |
| 3428 AAGGCCCCACCATCCTTCAGT | 15086 AGCAGCCAAGGGCTTCTGAT | 26070 TCCTATCCTCCTTGTTTCTGCTAAAG | 37054 |
| 3429 GGCTCATCTCAGCCCATGTTC | 15087 GGCTCCCCAAGCACTAGACA | 26071 ATGAGGCTTCACTGGCTCATC | 37055 |
| 3430 TTCACAGACCAGCCTCCAGGAA | 15088 AGTGGGGCTGATTCCAACAAG | 26072 TGCCCTGCATCCTCCTTCACA | 37056 |
| 3431 GCATTCTCCAGGGCATTTGACTTAG | 15089 TCAGCAGCAGGCCATGAAC | 26073 AACGCCAGAGCACTGCATTC | 37057 |
| 3432 CCACCTTGTCTACCACAGAGTTC | 15090 AGTTAGGAGTAGGCCGGTGTCT | 26074 GAGCAGAAATCTTCCACCTTGTCTAC | 37058 |
| 3433 CACAGTCTTACTAGGGTTCAACAGGAT | 15091 GCCCTGGGCCGAACATTT | 26075 CCCTGCCTCACAGTCTTACT | 37059 |
| 3434 CGCACTTCCTCCCTTTTAGGTT | 15092 GGGAACGTGTTCTGCCATTCTGAT | 26076 ACATGGAGCGTTCGCACTTC | 37060 |
| 3435 GCCTCATATCCAGAGACCAGAGA | 15093 AAGACAGAAAGTCCGTTGGAACT | 26077 CCAAGCCCTCCTGCCTCATATC | 37061 |
| 3436 AGGCAAAGGAGCCTCCAACA | 15094 GCCTTCAGCCCCAGGAATGAAAT | 26078 GCATTAGCTCGGTTTCTAGGCAAAG | 37062 |
| 3437 GGGTGACAACGTGTGCTGGAAT | 15095 GGGCTCTGCCCTTTCAGCTA | 26079 GTGTTCTGAGTTTGGGTGACAAC | 37063 |
| 3438 GCACATAGCCCTCAAGGTCACA | 15096 TGCAGCAAGAACTGCCACAT | 26080 CCCCACAGCAACTCTGCACATA | 37064 |
| 3439 GAACTTTTTGGCCTCTGACTGTCT | 15097 CCTGGGAACAGTGATACTTGCAT | 26081 CCCTAGATTTTGTGACCCAGTGAAC | 37065 |
| 3440 TGCTGGTTCACGGTGTCCAA | 15098 AAGGGAACATGGGCGTGATT | 26082 ACAGCCGGTGCTGGTTCA | 37066 |
| 3441 CCAGCCGGTCTGTACATAGGATCT | 15099 AGAATCGGAGACTCACTGGTTGA | 26083 AGAAGCCAGCCGGTCTGTA | 37067 |
| 3442 AGCAGGGAGAGAGACTGATTCAT | 15100 TTATGACACACCTCCGTGTGATT | 26084 CCACTGCAGGCACGTTGTAGA | 37068 |

FIG. 36F3

| | | | |
|---|---|---|---|
| 3443 CCCCAAGTGGTCCTACTGAAATC | 15101 GGCCTGCCTTTCCACTCAAT | 26085 TTCAAACTTCAGCTCCCCAAGT | 37069 |
| 3444 GTGGTGAGGGGACCATGGAA | 15102 GCAAGCCATCCACCCTCACTAA | 26086 CCTCTGGGGCCAGAAAGAACA | 37070 |
| 3445 GCTCATTCCTTCAGCTGGTGT | 15103 ACCTGACCCCTCAGCTTCA | 26087 GGTGAATCCAGCTCATTCCTTCA | 37071 |
| 3446 GGCAAGGAATCTGAAAACAGGACTA | 15104 ACGTTGTCCCTACACTGACATTT | 26088 GGAAGAGCTTAGGGCAAGGAATC | 37072 |
| 3447 AGGTCGTCGGCTTTGACTGT | 15105 CCACACACGCTGTGCAGAAAG | 26089 CAAGTCCCTTCCACCTGGAGTA | 37073 |
| 3448 GCCTGCCGTGGGTCATTGT | 15106 GGAGATTCGGGTGTCTGATGCCTAA | 26090 AGGTTACGCACATGAAGAGCAT | 37074 |
| 3449 TGGGGTTTCGGGATGGTCAAAC | 15107 ACCTCAGGTGTCCCGTGTT | 26091 AGGGATTCCCACACTGGGGTTT | 37075 |
| 3450 CAGGGTTTGGCTCTTGCCTTCA | 15108 GGCCCCAGGTCTCTCAGCTT | 26092 GCAGCCCAAGTCTCAGGGTTT | 37076 |
| 3451 TGGATGTGCGATAAGTCCATGTT | 15109 TGAGTAAGTGGGTCTTTCCTTAGGTT | 26093 TGACATCAATGTGGATGTGCGATA | 37077 |
| 3452 GCGTCCAAATGACCTTGAATTTGT | 15110 CAGCAGCTCCCAGTGACTTC | 26094 GCACAAGGCTAGCGTCCAAATG | 37078 |
| 3453 GCCAATGTGGCAGCATACCATCT | 15111 CCCCTGCCATGACCTCTCCATT | 26095 TGCTGTAAACTTCAGGCCAATGT | 37079 |
| 3454 GGTGCAAACTGCGGCAAATC | 15112 CACGTCCCCACCCTTCTTGTATG | 26096 ACAGGCCTGGGTGCAAACT | 37080 |
| 3455 GGAAATGGTCCCTGTCGTGCAT | 15113 TTTGGGTGCTGGACCCCTTTG | 26097 AAGGGTGGGGACGTGTGTTT | 37081 |
| 3456 ACACAGTCCAGTGGCTCCATGT | 15114 CCAGATGGACTGGTGAGGATTTC | 26098 TCAGCCCTTGCACAACACA | 37082 |
| 3457 AGGCCCAAGGGCTGCTAAAC | 15115 CCTTGTATCAGAGCCTCTCAGTATCT | 26099 GATCCAGGCTGGGACTGAAATC | 37083 |
| 3458 GGATGCGAGACTTGCTGGTTCTCA | 15116 CACCACAAAACTACACCGCTTGA | 26100 GTGATCATCTCGGGATGGAGACTTG | 37084 |
| 3459 CCCACATCCAGGACCTACCATCT | 15117 TGGGCCAAGGGGCAAAAACT | 26101 GCTCCATATCCTTCCACCTCAGA | 37085 |
| 3460 GGAGTTCGCGTGGACTCACAA | 15118 AGCAGCCCCAAACCTCACT | 26102 AGTCTACACTCAAGAGGGGAGTTC | 37086 |
| 3461 CTGTGGTAGCAATGGGAAGACTGA | 15119 GACTTAGAGGCCCTTGGGTGTAAC | 26103 CGAAGCATGTCTCTGTGGTAGCAA | 37087 |
| 3462 CTTGCATTCCTGGGCCTTCAGTT | 15120 CACCACACCTGGCAGACATT | 26104 AGGTGGGTGCACTTGCATT | 37088 |
| 3463 ACACTCAGGCACCCAACAGT | 15121 AAAGGGCAGGCAGCTGAGGTA | 26105 ACCAGGCTTCCAGACACTCA | 37089 |
| 3464 GTACTCCCGTGGCCTTCAGAAC | 15122 AGTGGCTGGCCTGCATGT | 26106 ACTCCGACAGCCAGTGGTACT | 37090 |
| 3465 ACTGGCCCAGCAGGCACATC | 15123 GGGAAAAAGTCCCCAAACCTGTTC | 26107 TCTGTCACTGGGAACCTTGACT | 37091 |
| 3466 GTGCGCTTTGCAGGGATTTG | 15124 CAGGTGTGGCCTGTGTGAGT | 26108 GCAGCTGAGAGTGCGCTTTG | 37092 |
| 3467 TGAGCTGGTGCCAGAGGTTTG | 15125 GACAACTCCCTGCTTGGAGTAAC | 26109 GCAGCTGAGGGTGATGTGTGA | 37093 |
| 3468 TGGGGCCCACAGCCTTGAA | 15126 CCTGGGTGGTCTGGAGAGGAA | 26110 CATGAAGGTGCCTGCTGTGT | 37094 |
| 3469 GGGAAGTGACTGGCCCAATGT | 15127 ATGACCCACCTCTGGCACCTA | 26111 ACACTCAGGCTCAGGGAAGTGA | 37095 |
| 3470 TCAAGGGAGGCTGGGAGACAAA | 15128 ACACACCCCAGGTCACTTCAGA | 26112 CCCCAACAGGGCTGACTGT | 37096 |
| 3471 TACCTGCACAGCTCCGGACA | 15129 TCCCACATAGAGCGGCATCA | 26113 TGGCCCTGGGTACCAACCATTT | 37097 |
| 3472 GCAGGGACTGTGGGAAGTTTG | 15130 CTGCCTGACAGCCATTCATTCCTT | 26114 TAAGGCCACCAGCGGAAAGT | 37098 |
| 3473 GTCAGGTGAAAGGCGGGATT | 15131 AGCTTGCCCTGGGGCTTTG | 26115 GAGATGGGGTCCCATAGCTTGA | 37099 |
| 3474 CCACACAGACCCTGAAGACACA | 15132 TGTGGGCATTTGGGCACCTT | 26116 TCCACAGGGCCCACACAGA | 37100 |
| 3475 GGGTGCTCTTTCTGGACTGAGTTTC | 15133 CAGGGTGTGGGGCATTGTGA | 26117 ATGCAGGCTGGGTGCTCTTT | 37101 |
| 3476 GCTGGATGGAGAGAGATGAGAGTAA | 15134 CGGGGAGTGTGGGATGGAA | 26118 AGCCTGCTGGATGGAGAGAGA | 37102 |
| 3477 AACATAATCCGCTTGCCTAGAACT | 15135 AGCACGCAGGAGGCCAAGA | 26119 GTCTGGTAATAGGAGGAAGTGTAACAT | 37103 |
| 3478 CTGGTCACTGGCACACTTCT | 15136 AGCACTAACCGCCAGTGATG | 26120 CCCTTCCAGCCTGGTCACT | 37104 |
| 3479 CACTGTCACAGAGAGTTGGGTCATAC | 15137 ATTGATCCCCTCTCCCACCAT | 26121 GAGAAGACTAAAATACCCTTTCCACTGTCA | 37105 |
| 3480 GGCTTTCCAGGTTCCCAAGAA | 15138 CTTCCTTGACGGGTCCCTTTC | 26122 CTGTGATCTCCCTGTTGGCTTTC | 37106 |
| 3481 GCTGAGGTGCTTCTTCTCCAT | 15139 CCCCTGCCAGGTGTTGAATTT | 26123 CCTCTGAAAACTGCTGAGGTGCTT | 37107 |
| 3482 GAGGGAAGCAAACAGCCCTTGA | 15140 CACTGAGGCTGTCAGGATGTT | 26124 TGGCCAGAGGGAAGCAAAG | 37108 |
| 3483 AAGCCCTGCCCCTTCAGA | 15141 GGGGAAGAGTGAGGAGACTGA | 26125 GACAGCCCTTCCTGCATAAGAA | 37109 |
| 3484 GTTCCAGGAGACCATACCTTCCTT | 15142 AGAGGGGCACCTGTTGGAAGA | 26126 CAGGAAAAGTTCCAGGAGACCAT | 37110 |
| 3485 GGCCTGCTGAGTAGCTGCAAT | 15143 CAACAATGGCAAGGCCTGATG | 26127 GTCGCCTTATGTCTCCTTCAAACT | 37111 |
| 3486 TGGCTCACACTGGACCTGAT | 15144 GGGGTGGAATGCACACAAGGTT | 26128 GTCAGTATCTCTGTGGCTCACACT | 37112 |
| 3487 CAGGCTGCAAGTTGGCTTCA | 15145 CTGGATCTAGAAGGCAGAGATACATGA | 26129 CTTGGCTCCAGGCTGCAA | 37113 |
| 3488 TCGAGTTGGGAGGGTGAGTT | 15146 CCTCAGCTGCTCCTGTGGTCTAA | 26130 CCACAGGTGTTTCCAAGTAGGATCTCA | 37114 |
| 3489 CTGCAAGCTCACCGCATTTTC | 15147 GCACACAAAGGCCCCAAGA | 26131 TCTCTGCCTGTGTCTGCAA | 37115 |
| 3490 ATGGCCACACCCTGGCATTT | 15148 AGGAGCAGCCTCCAGCCAATA | 26132 CCCATTGGCAGAATTTAGTCTCA | 37116 |
| 3491 GTGAGGAAAGCAGGCACTCACT | 15149 GCAGCACCTGAGAGAAGACACT | 26133 ACAGGGGTGGAAGTGAGGAAAG | 37117 |
| 3492 GCTTAGTGGCCTCATTGCTGTAT | 15150 CAACCAGGACCACAGACCTTCA | 26134 TCACATTTGGCCAGTGCTTAGT | 37118 |
| 3493 GTCTGTGATCCCTCGCGTTTCA | 15151 CGAATTGGCTGCAGCATGGTT | 26135 TGTGCTGCCTCAGTCTGTGA | 37119 |
| 3494 CCACCTCGAAAGAGGGTACAGA | 15152 TCACTGCTGCCACCTGCATA | 26136 TGCACTTGAGCCACCTCGAA | 37120 |
| 3495 AGAGCAAAGGCTCTGGCATT | 15153 ACTGGGACTGGAGCCCAGATT | 26137 GGGGCAGCTGGGATGAAATAGA | 37121 |
| 3496 GATTGGAGGGACTGAGACCAGAGA | 15154 TGAAAGAACCTCCCAACAGGTTT | 26138 GTGTAATGAATGGATTGGAGGGACTGA | 37122 |
| 3497 TGGATGGGACACGACCTTGA | 15155 CAACCCACCTCCTCCCATCT | 26139 GGCACCTTCCATCTACGGTTGGAT | 37123 |
| 3498 AGTCTGACATTGACAGGGGATACA | 15156 TGGTTAGGCCTGGCTCTGTCT | 26140 CCTTCAGCCTACCTTGCAGTCT | 37124 |
| 3499 CCAGGGACCAGTAGGAAGCAAT | 15157 GCCAGAATACTCACCCCAGACTGA | 26141 GCTCTCTTCTATTACCAGGGACCAGTA | 37125 |
| 3500 GAAAGCAACCACGTTGTGTTCA | 15158 CCTAGTATGTGTTGGCACTGACACT | 26142 CCCCATGCGCTGTAAGCATCA | 37126 |
| 3501 CAAATGGCTCTGCCCAGCTCTA | 15159 GGCTAAGCCAGATGCTGTTAAGTAG | 26143 CACCTACCCTCTTCCCATGCAA | 37127 |
| 3502 CACGTCAGCATAGCGCTTTTAACT | 15160 AGTGCCACTGTGTGCAGGTA | 26144 CACAACACCTCACGTCAGCATAG | 37128 |
| 3503 GGCAATGTGGCCATCAGGTTTG | 15161 ACCAGGCACAAGGACTCATCA | 26145 TTGGCAGGAAACTTCTAGGCAAT | 37129 |
| 3504 GTTAGAAGGGGAAGGGGTCCAA | 15162 CCACCTACATTGCCTAATTTGAGGAT | 26146 GAGACTAAGGAGGAAGACAGTTAGAAG | 37130 |
| 3505 CACATGGAGGCATAGTTACCAGGAA | 15163 TGCAGCCAGCACTGCAAA | 26147 CACTCCATTACACATGGAGGCATAGT | 37131 |
| 3506 CGCCCTAGCTTCACAGAGCTT | 15164 CGGAGCATGTTAGGTGATGTGCTT | 26148 TCTTAGGTACCGCCCTAGCTT | 37132 |
| 3507 TGGACTGTCCCAGACCTTGAAT | 15165 CATCTTGGCCTTTGCTCTCTGA | 26149 CCCACATACTCCCAAATGGACTGT | 37133 |

FIG. 36F4

| | | | |
|---|---|---|---|
| 3508 CAAGTCTGTGAACTACTGGTTCGTT | 15166 CCCCTAGGGCTGGAGAGACA | 26150 TCCCAGGGGCTTCAAGTCTGT | 37134 |
| 3509 CAATAGCACCGATAAGGCAACCTA | 15167 GCCTCTGGGTGGAAGCAAT | 26151 GTGACTGGTTCAATAGCACCGATA | 37135 |
| 3510 CCCAATTTGGTCTCTCCAACAGT | 15168 AAGGCCGGTGCTGGCTACT | 26152 CAGATCCAGGGAGCATCCCAAT | 37136 |
| 3511 CCTCGTCTCTCTCTGACAGGTA | 15169 GCTCCCTGCCCTCTCTAGT | 26153 GGAATTGCCTCCCTCGTCTCT | 37137 |
| 3512 AGAGACTGAGGCAGGGCCATAA | 15170 CCACCCAGCTCTCGGTGAATG | 26154 CAGTAGCCCATGGGGAAACAAG | 37138 |
| 3513 GGTCCGGATAGTAAATAGAGATGAGTAACA | 15171 TGAGCTCCTTGAGGGCAAAG | 26155 TGCAGGTCCGGATAGTAAATAGAGA | 37139 |
| 3514 GCACAACTGTTTGCACTATCCTT | 15172 GAGGCAACAGCGACTGGAAT | 26156 GAGCAGAATGCAACGCACAACT | 37140 |
| 3515 GCTTACTAAAGAGCCCTTGGGAAT | 15173 TGCCTGGCTACCGCTGAT | 26157 CCTGCCAGCATTCACCACAA | 37141 |
| 3516 TGAGGCCAGCACCTCTCGTAAT | 15174 ACCGAGCTGCTTTTCTTCCAA | 26158 AGCAGCCAGCAGCCACTGA | 37142 |
| 3517 GGGTGATCCGGGAGTGCTAATAAC | 15175 AACCCGGAGGGGAGGAGAA | 26159 AACAGGCCAGTGAGGGTGAT | 37143 |
| 3518 GGGTGAGGGACAAGGACAGAAGA | 15176 TCCCCTTAGGCTCCTGCGTTT | 26160 TGGTGCAAGGGTGAGGGACAA | 37144 |
| 3519 GTCCCTAAAGCTTTCCGCCAACA | 15177 AGAAAGGAGAGGCCCCTGAA | 26161 CTCCAATCCCTCCTAGTCCCTAA | 37145 |
| 3520 GGGGTGGGGAGAGGCAAGTA | 15178 GGTGAGGTGTGAGAGGGACAGA | 26162 GTGGTAACTTGACATAAGCCACTTG | 37146 |
| 3521 GCAGAGCCCAGAATCATTCGTCTA | 15179 GGCCTCTTGCCCAGCCAAT | 26163 TGCCTTGCAGAGCCCAGAAT | 37147 |
| 3522 CAGGTGACGTTTTCAGTTTGGAGACA | 15180 GGCCAGTGCTGCCTTTACTGA | 26164 GCAGAGCCCAGGTGACGTTTTCA | 37148 |
| 3523 CCATGCCCACCTCTAAGAGACA | 15181 CCCATCCTGCCTGCACAGAA | 26165 GCAGTTGAGGTCAAGGACACCAT | 37149 |
| 3524 GTACACAGGGCACCAGGTCAT | 15182 CAGGGCGCCCCTTCTCTATG | 26166 GGAGCCGAAGCAACTGGTACA | 37150 |
| 3525 GTGTGCAAAAGGAGGGTGAAAGTGA | 15183 CCCTCAGCTCTGGCATCTTG | 26167 GTGTGGAGGGAGAAGTGTGCAA | 37151 |
| 3526 GCTGATCTCAGTGGCTCAAACT | 15184 TCACAGTGGCGAGGCTTGAA | 26168 ACCAGCCTTAGCCAGATAGGAA | 37152 |
| 3527 GGTGGGCAAGTAATTTACAGGGGAAA | 15185 CCCAGGGGCCAGGTAATTAACAT | 26169 TGACACTTGGTGGGCAAGTAATTT | 37153 |
| 3528 CAGAGCTCAGTGCTAGACATGGAT | 15186 TGGGCAGCAGAGCACTCAAA | 26170 GAATGAAGCAGAGCTCAGTGCTA | 37154 |
| 3529 TTGGGACATGGGACAGCTCCTA | 15187 GGACAGCTCCAGGGAACAAGAAA | 26171 ATCAGCTCCTCCCCACTGTTG | 37155 |
| 3530 CTGCACCAGTTCAAGGCAAGTCT | 15188 TTCTCCGGGCAGCAATTACAT | 26172 TGCAATTTTCACTGCACCAGTTC | 37156 |
| 3531 GCCCCATAGATCCAAAGCATAGTGTAA | 15189 TGGGCTATGCCCTTCAGTTTG | 26173 GGGTCTGCCCCATAGATCCAAAG | 37157 |
| 3532 GGTTGGGTTGAGAAGTGCCTCAGA | 15190 TGCCCAGTTCCCAGCACACT | 26174 CTGCTTTAAGAGGTGGGTTGAGA | 37158 |
| 3533 CCCCGAAGGATCTCGTTAAAACA | 15191 GCTGGACCCAGACCCTCTGA | 26175 CTCTCACTGTAAAATGCCTGTGAATC | 37159 |
| 3534 CCAACTGGCATTCCTGCCTCTA | 15192 CGAAGGTGTCTGGGCTGCAA | 26176 CTTCATTACCTCCCAACTGGCATT | 37160 |
| 3535 GGCGATCATCTTTAACTACTCCTTCT | 15193 TGACGATGAGTGGTGGTAGGTT | 26177 GACAGGCACTTGGCGATCAT | 37161 |
| 3536 CAGAATGGGTGGGGCAAGACA | 15194 CAAGCACTTCCTCACCTGGAT | 26178 GGACTTCCCCATACCAGGATCT | 37162 |
| 3537 AGGGAGCCTCAAGTGCATCA | 15195 TGGGCCAAAGGCCCCAAGA | 26179 CCAATGATGGCGCTCAGCTTTT | 37163 |
| 3538 AAGCTCTTTCCACTTCAGGATCTTT | 15196 AACATTTCAGCCAGAGGGAACA | 26180 CAGGCCAAGCTCTTTCCACTTC | 37164 |
| 3539 TCCCCAGAAGTGGTAACAGGTA | 15197 CCAGCCTGGGAGGCTACAGA | 26181 GGGTCTGTAAGATTTTCCCCAGAAGT | 37165 |
| 3540 AGCTAGCAGGGCTGATGCAA | 15198 CGCGAGGAGTACAAAATAGGGGAGTT | 26182 CTGAGCTAGGATTCAAGGCAGCTA | 37166 |
| 3541 GTCTCACCTTTTCCACCCTTGAATG | 15199 GGCAAATGGAAGGGGTCACA | 26183 ACCTGGACTGAGTCTCACCTT | 37167 |
| 3542 CAGACCACAGAGCCCGAAGT | 15200 CCAAGGTGTAGCTAACTTTTCCTGTAG | 26184 AAGACCACCCAGACCACAGA | 37168 |
| 3543 TGCAGTAGTTGAGGTGAATGGTTT | 15201 TGACATCCTCCTGAGTTGCTGCTA | 26185 GTGGCAGGTTGAATGCAGTAGTTG | 37169 |
| 3544 GAGGAAAAGCAGCCAGACATACA | 15202 ACGGAGGTGGGAGCAGGTT | 26186 CACAGCTGCTGCTTTGAGGAA | 37170 |
| 3545 GTGGAAGATGGACTGGCCTTGT | 15203 CACATCCACACCCTCATCTAAAC | 26187 GGGGTGTGTAGAACCTGTGAA | 37171 |
| 3546 GAACCCAATCTGTCTACCTTGTCA | 15204 TCACTCCGCCACTAGGAGTTG | 26188 GGCCTCTAAGAACCCAATCTGTCT | 37172 |
| 3547 ACAAGGCGCCCAAGTGATCT | 15205 CCGTGGGAAGGGATTGTCATC | 26189 CCATCAGAGAGTGGAGGTCACAAG | 37173 |
| 3548 CGTTCAGTTGCCATCTGCTGTTC | 15206 CCTGGCAATGGCAAGGAAGA | 26190 ACCCAGGAACCGTTCAGTTG | 37174 |
| 3549 CACCCAGCCATCCCTGAGTTC | 15207 GCATCCACAGAATCCGTTCACT | 26191 GAGGATAATGCCTCATCCCTTATTTCA | 37175 |
| 3550 GGGTGCCCACTCAGGGTTATTC | 15208 ACAGAGCAGGAGCTGAGCAT | 26192 GGTAGAAGGGTGCCCACTCA | 37176 |
| 3551 ATGTGGCCCAGAACCCACAA | 15209 CCAGCTCAGCCATTCACGCATA | 26193 CTGTGGAGGCTTTGGAGCAA | 37177 |
| 3552 CGATCCCACTTTGAGGTGAACTTGA | 15210 CCTTTCCCTCTCCCCTTCTCA | 26194 CCTGGCCGATCCCACTTTGA | 37178 |
| 3553 CCTGGTTGTCTCTGTCCCAAGTCA | 15211 CCTGACAGACACCTCCCATACCTT | 26195 TGGGCCTATCCTGGTTGTCTCT | 37179 |
| 3554 CCCTTGCAGGGATCCAGATG | 15212 GTGCCACACCCTCATCTAAAC | 26196 GAAGTGGCAGACAGTTAGAAGT | 37180 |
| 3555 GGCTACCTCCAACCATCATCTTG | 15213 GGTATCAGCTAGGAGGCTGTGA | 26197 GTGACAGTCTTTGGCTACCTCCAA | 37181 |
| 3556 ACATAGGTGGTAGCCAGGAAGT | 15214 GGCACTGGGACTCGTCAAAAC | 26198 GACCTAGTGCCTTCAGTGAACA | 37182 |
| 3557 AAAGAAGTCTGACCATGCCTTGA | 15215 GCGGTTCTGCAGCATGACAA | 26199 GGGAAGTGGATCAGGTTTCCAT | 37183 |
| 3558 CCCAGGCCAGCTTGTTCTCT | 15216 TGGCCCAGCCGCAGTCTAA | 26200 GGAACAGCAGATCAGAGAAGGTT | 37184 |
| 3559 GTGTAAGGGTGAGTCTTTCAGCAA | 15217 TCCAGTGAACGACTCTGTGGTA | 26201 AGTGCTTGGCCCTACAGTTG | 37185 |
| 3560 CCAAAACAGGCAGCCACAAGA | 15218 CAGCTAATGTGGGAGGAATTTCTAGACT | 26202 CCTGCATCTTTGAGGGTAGCCAAA | 37186 |
| 3561 CCCTTTCATCTCCCCAGCCATT | 15219 AGACTGAGCTGTGGGACCTTCT | 26203 TCCTTTGCTGTTTCCCTTTCATCT | 37187 |
| 3562 ATTCCTTCCCTCCTGGGGTCTA | 15220 TGGGATGGGGCCCTAGCAA | 26204 GAGCAGGGATCTCAGGCTCTTT | 37188 |
| 3563 GAGCCCAAGTTCTTCACTTGGAAA | 15221 ACCCTGAGAGAAGCTGCTACAATG | 26205 GCCTCACTGAGCCCAAGTTTCT | 37189 |
| 3564 GGGCCATCAGTGAGCTTTCTTC | 15222 GCCTCTCTCGGGCTCTTGACT | 26206 AGTGCCAGGGCCATCAGT | 37190 |
| 3565 GGATCTCCACTGTTGCCTAGAATG | 15223 AGAGCACATCCCACCTGAAGA | 26207 AGCCCTGGATCTCCACTGTTG | 37191 |
| 3566 GGTGGTTCTGTGGGTTTCTGT | 15224 AGAGCCTGCTCTGTTCTCTGT | 26208 ATTGCTATCACATAGGTGGTTCTGT | 37192 |
| 3567 GGGGTACTTTCAGCTCTCTCTAGT | 15225 TAGGGCCCTTGGACCTGCAT | 26209 CTCTCAGTTAGTGATTAAGGGGTACTTTC | 37193 |
| 3568 AGCAGCAGCGGAAGCACAT | 15226 AATGCCGAGCTGGACTGGTT | 26210 AGTACCTGGGGACTTGACTGAA | 37194 |
| 3569 AGGAACACAGAGGAGGAGCAA | 15227 ACCTGGATGTCCTGAAACTCAAC | 26211 AGGTTGCCAGGCCCTGAGT | 37195 |
| 3570 GTAACCACTCCCTGGCTACTTCT | 15228 AGTGCCAGCTCAGCCCTAAGA | 26212 CTCACCCAAGGCTTGCTGTAAC | 37196 |
| 3571 GGACTGCAGAAAATGTTACAGGTCTT | 15229 GTTCGTTTGCGGAAATGCAAAA | 26213 GAAGGAATTTAGAGGGACTGCAGAA | 37197 |
| 3572 CTTCTCATTGGAATCTTGGCTCCTT | 15230 CAGGGCTGGAGAGACAAACTT | 26214 CACAGTCTTCCATCTCTCACTTCTCA | 37198 |

FIG. 36F5

| | | | |
|---|---|---|---|
| 3573 AGGCATCCTGGAAGCAATCAAG | 15231 CTGTTAACCGCTTCTCCTCCTT | 26215 CAGAAAAGCAAGGCATCCTGGAA | 37199 |
| 3574 GGCCAGTGTGTCAAAAGAAGACTA | 15232 CCCTACCCAGTCTCACTGCTCAA | 26216 GTCAGAAAGAAGGCCAGTGTGTCA | 37200 |
| 3575 GCCTACGAGGTACAGCTCAGGATA | 15233 TGCACAGGCCTGTCACATAC | 26217 GCTTCCCATTGCCTACGAGGTACA | 37201 |
| 3576 CTCTTCAAGTTGGAAGGGATGAGA | 15234 ACCTCACCTGGAGGGACAAG | 26218 CTCGCCAGGAATTTAGCCTCTTC | 37202 |
| 3577 GCTACAGTGGCAGAGTCGAGTAG | 15235 GCTATGCAGGCCAAACAGGCTAT | 26219 GTGGCTGCTCTTGGGCTACAGT | 37203 |
| 3578 GAGGAAAGCAGAGCGAAGAGTGA | 15236 GGTACCTAGGGTGCAAGGCAAAG | 26220 GCGGAATTTCTCATTCCATTTGAGGAAAG | 37204 |
| 3579 GGTGGAAGAGGCAGACACCAT | 15237 GCAAGGGAAAGCGGCTGACT | 26221 GACCAAGTTCTTGGGGTGGAAGA | 37205 |
| 3580 ACGGTCCATCGCTTGCATCT | 15238 GGGAGAGGCGTGAAGGAATTGA | 26222 CTTTGTGTCTACCACGGTCCAT | 37206 |
| 3581 AGAAGCATCTGAAGTGCCTTGTT | 15239 AGATGGATCACAGGAGGCGTAA | 26223 TCATGTGTACCAGAAGCATCTGAAG | 37207 |
| 3582 CGGGCCAGGGAAAGAAAAGATG | 15240 CCCAGGAGTGGGAGGGAATTTT | 26224 TTACTCAGCGGGCCAGGGAAA | 37208 |
| 3583 TCCACAGGGCCTGGTACAT | 15241 TCCACCCATTCAACAAGGGTTT | 26225 GAGGGTGGCACCATGTTTGT | 37209 |
| 3584 CCTCACCCAGATCCAGCACCTA | 15242 CGTGAGGAACATTGGCCATTCAGA | 26226 TCGCACACCTCACCCAGAT | 37210 |
| 3585 CCACAGGTGGTTCAGATAGACTCTACA | 15243 GTGATCTGGGCCCTTCACTTC | 26227 GGGATCCACAGGTGGTTCAGAT | 37211 |
| 3586 TGGAGGAATTCCACTGCTTCATT | 15244 CCTGACCTGTGCGAAGAGATTAATTG | 26228 TCCTATAAATCCTGGGATGGAGGAA | 37212 |
| 3587 TGGGAAGGCAGAGGCAGTTCT | 15245 CCACTTTGTTAGGCCTGGGATCCTT | 26229 GCCCACACAAGGTCAGCATT | 37213 |
| 3588 CACTTCAGGGATCAGCCAATTCA | 15246 CTTGTGCTGAGAGACCTGGTT | 26230 CCACTCACCACTTCAGGGATCA | 37214 |
| 3589 CCTGATAGGTAGCAGACAAGTACTAA | 15247 GTCCCTGTCTGGCGTGTTTT | 26231 GGAGCTCTCATCCTGGATAGGTA | 37215 |
| 3590 AGGGAGGCAGAGGAAGCAAAG | 15248 ACCCCACCCTGACTCCAGAAG | 26232 CCTCTCCTTACGTTGGCTTGAAC | 37216 |
| 3591 CCCCTCCCCTGTGCTTACA | 15249 AGCGGAGGTCTGCTTGTCT | 26233 ATCTGGGCAGAGCCAGAAGT | 37217 |
| 3592 CCAAAGCTGTTCCGGTTCTTG | 15250 GGAGTAAGAATGGACAGCAAGAAGAT | 26234 AGGCAGTGTCCCAAAGCTGTTC | 37218 |
| 3593 ATGCTTCTTGCCTACCTTGTCTT | 15251 GAAACATCGTGGGACTCTTGTCA | 26235 GGACCTAGACACTGAATGCTTCTTG | 37219 |
| 3594 TGAGGTGGGCCAAGTTCAGA | 15252 GGTGGAAGGGACGCTTGAGA | 26236 TGGTCCTTGCTGCCTTCTTC | 37220 |
| 3595 GACTGGGGATTAGCTATGGTGTCTA | 15253 CCCTCTAAGCTAACACGGCAAT | 26237 GGGTTTTCGCGACTGGGGATT | 37221 |
| 3596 TGGTGGGAGGGATCCGCATA | 15254 AGCACCTGGCACTTCTAAATACA | 26238 ACTGTGCTGATCCCTCCCTTA | 37222 |
| 3597 GTTGCCTCAAAGCCACACTTG | 15255 CCTAGGACAGAACCTCTCCCATA | 26239 CAATTGGACTTGTGTTGCCTCAAA | 37223 |
| 3598 CCCTGAGGTTCATTGAGCACTTT | 15256 TCTGGCCCGGCATACTCAA | 26240 CCGGCCTTTCCCTGAGGTTCATT | 37224 |
| 3599 GGTGACAAACCCAGCCCAACA | 15257 GGCCAAGCAGTTAGGGAATGA | 26241 TGAAAGAGGTCCTGGTGACAAAC | 37225 |
| 3600 ACGTACATCTAAGCCAGTGTGTAAG | 15258 GCCTCCAGCAATACCTCCTTGT | 26242 CAGTGTTCAATTCAAGCACGTACATC | 37226 |
| 3601 GCAGCCACACAAGGAGTCTT | 15259 TGACAGTTTGGGGCCAATAAGTT | 26243 CCATGCAAACTGCTAATCCTTCCAA | 37227 |
| 3602 CCACGCCTCTAAACACTACCTTGT | 15260 ATCCCCAGCCCTTCAACCAT | 26244 CCAGGACAACCACGCGTCTAAA | 37228 |
| 3603 GGGTGGAACAGGAATACCAAGAA | 15261 TCAGTAGCTGAGCTCAAAATGCTT | 26245 GCCAAAAGCTGAGGGTGGAA | 37229 |
| 3604 AGAACTGGAGTTGGGGCACTA | 15262 TGGCAGGGTCTCCCTTGAT | 26246 GGATCCAACTTTTCCCATGCTAGA | 37230 |
| 3605 CACAAATAAGCACAGCGGGGAAT | 15263 CAGAAAGGCAGCAATTTGGACAT | 26247 GATCAACCTGCATTGTCCTGTCA | 37231 |
| 3606 ACGCGCCTCCAGCTACATTT | 15264 TTGTGTCCGCGCCTTGTA | 26248 TCTTTCCCGGGCACAGAAC | 37232 |
| 3607 CCAAAACAGCTGGCTACCCTATTC | 15265 CCAGCCTCCCTGAGCCCTAAT | 26249 GGGAATTGTCTCTTGACTCCAAAAC | 37233 |
| 3608 ACCCCAAGTAGCCACCATTG | 15266 GGCCTTGGGTCCAAAGCAAAGA | 26250 TGGCTGCCCACCCCAAGTA | 37234 |
| 3609 AGAGCAGGAGTCTCTGATGCAA | 15267 GGGTTCTTCTGCTCAACGGATTG | 26251 TGAAGCACTAGAGCAGGAGTCT | 37235 |
| 3610 CAGGCGAAAGGCTCACAGGTTA | 15268 GACCTTGCCCTGCTTCCAAAT | 26252 GCAAAGGGCAGGCGAAA | 37236 |
| 3611 GGGCTTAGCAGCTCTTGGTTTTG | 15269 CTCGGGTGCATGCTATTTGTCT | 26253 GCACTTTTCTATTGGTTGGTGGGCTTAG | 37237 |
| 3612 CCCTTTAGCCTTGGCACTGT | 15270 TGAAGTGGAGGGAGCTGATAGT | 26254 CGCCGGGCCTACACATCTTAAA | 37238 |
| 3613 GGGAAGATGATGGTGCAGGAA | 15271 GCAATTGTGTAGGTGGAGACAGA | 26255 GGAGGGTGATTCTGGGAAGATG | 37239 |
| 3614 TCCTCACAGAGCCTATCTGCAT | 15272 AAGGGCCACCTCTCCTTGGAA | 26256 CAAAACCCAGATTCTTTCCTCACAGA | 37240 |
| 3615 TGAAGGTCCCTTCCAGCCATT | 15273 CACCATGCTCCACAGATCCTT | 26257 GGGAAGGTTAGACCAAATGATGATGA | 37241 |
| 3616 TCTCACAGCTGGCCTGGTA | 15274 GCCATTCTGTGTGGCTCCAA | 26258 CGATCCTCTAGGCTTGAGTTCTCT | 37242 |
| 3617 GGAGGCGGTGAAGCATTCTA | 15275 GTCAGGTAAAAGGCTGAGACTTAATTG | 26259 CCCCGTTGGTATGATGAGAAACTGT | 37243 |
| 3618 CCTCTACAACTGCACTGATCACA | 15276 GTCCTGCTGCAAGAACCAGCTT | 26260 GGTGCAGGGCTTTCTGAATGT | 37244 |
| 3619 CCATGCACGATTTCTATCGTCAAG | 15277 CGTGGTTAGCCTTGACCTCTGTTTC | 26261 GCATTTCTATTCTATGCACGATTTC | 37245 |
| 3620 GGGTGGCAATAGCCCTTGGAT | 15278 GTCACCCACCTACACTGGCAAA | 26262 GCCTTTGTCAATGGGTGGCAATAG | 37246 |
| 3621 CGCAATGATAGCCATGGGAAGA | 15279 TCTCTCCTTTCCTCAAGCTGAATG | 26263 TGTGGGCCGCAATGATAG | 37247 |
| 3622 AAAGTCCCCGAAGGCAGGTA | 15280 CCCTGGAAGGTCCTAGGTTGCTTT | 26264 CCGGACAAAGCCACTGATGAAGA | 37248 |
| 3623 GGTCTTGCTGGGTACTATCACCAT | 15281 CCATGCAGTTCGGCCATGAT | 26265 GTATGCTCCAGTCGAGGTCTTG | 37249 |
| 3624 CCGCACTTGAAGTATGAGGCTGAA | 15282 TTGAAAGCATGGACCTCGTAAGT | 26266 CCCTGGACCGCACTTGAAGTAT | 37250 |
| 3625 ACAGGGCATTGCTTCAGCTTAG | 15283 GGTCTCCAAAAGTGGTCACTCA | 26267 ATTTCCCTAGGATACAGGGCATTG | 37251 |
| 3626 TGGTCCAGCCCCTTTCAGACT | 15284 GGCCCCTATATGGCCCATTGAA | 26268 CCTGAAATGTGGGCTGACACAGT | 37252 |
| 3627 GTCAGCTAACAACTGACGGTGTCT | 15285 ACCGCCGCCTAGACTAAAAG | 26269 AAGGGCTCTCAGGTTCCAGTTG | 37253 |
| 3628 GAAGAAGGCCTCATCACAGTCA | 15286 GCCTCTTGCCTGCTCACCAT | 26270 CCCCACAGAGCCATGTGAAGAAG | 37254 |
| 3629 CCCCAGGAAACGGAGAAACA | 15287 CTGGGTGCCCCTACATTCATTTG | 26271 TGAATAAATTCCCTTCCCCAGGAAAC | 37255 |
| 3630 TGGAGTGTGACTGGAAAACAATTCA | 15288 CACACCACTGTCCTGGTCATC | 26272 GGTGGAGAAGTGGAGTGTGACT | 37256 |
| 3631 GCAGGAGCGGGAAGAGTTA | 15289 GGCAGAAGCCAGAACAGTCA | 26273 GCTCTAGGCTACAGGTTCCATATC | 37257 |
| 3632 ACAAGGAAGGGAAGACAGCCTAT | 15290 CCAGTGGGAGTTAGCCTGATG | 26274 GGGGTGGAAACGTGAGACAAGGAA | 37258 |
| 3633 CAAGCTGGTAGCAAGCCCTGAT | 15291 TGGAGGTGGCCTTGACCTTTGA | 26275 GAGCCCATAAAGATAGCTCAAGCTGGTA | 37259 |
| 3634 GTTAGCAAGCAGCCAGGTTCT | 15292 AGAAGCCACGCCATGGATAAA | 26276 GGCATCCTGCAGAAGGGAAGTT | 37260 |
| 3635 TCCCCATTGGGTTACATGGGTTA | 15293 GGGCATACAGAAGCACCAATCA | 26277 GCCATGACTCCCCATTGGGTTA | 37261 |
| 3636 CTTGAACTGGTCCCATTGTCTAGT | 15294 CTTGAGGACGGCAAATGCTGTAT | 26278 AGGGCCCTGTCTCTTGAACT | 37262 |
| 3637 ACATGGGCACTTTTACCTCACA | 15295 CCTGGGCTAGTACAGAACACATC | 26279 ATGTGGGAGCCGTCCAGTTCT | 37263 |

FIG. 36F6

| | | | |
|---|---|---|---|
| 3638 GGCCACAAGCATGTCTGTCTT | 15296 GAATCTCGGGGCTCTTCTGTCT | 26280 CAGGATCACTACTGGGCCACAA | 37264 |
| 3639 TGCGGCTAATGTGGCTCAGA | 15297 CCCCTGGAAGAAGTTTGGGGCTAT | 26281 ATTTGACTTACAGTGCGGCTAATG | 37265 |
| 3640 TCTGGGTTTCAACTACAGCCAAA | 15298 ATCTTCCTGGTGTTTCACTCCTTT | 26282 CTTTCTGGATGTCTGGGTTTCAACT | 37266 |
| 3641 GTGTCTGATGGAACCTGCCCAATC | 15299 CAATCAACCTAGTTCAGGAGTACAGT | 26283 CAGGAGTGGGTGTCTGATGGAA | 37267 |
| 3642 CACATCCGTGTAAGTTAGCTGCTTT | 15300 TTCTGGCCTCACAAGCAAAGT | 26284 GGAATATAGGGCACATCCGTGTAAG | 37268 |
| 3643 GTGGTGCTCCAGAGCTTGAACT | 15301 CCTGATCGCTGGCTGTCAGAT | 26285 CTGGGTTGAGCTTGGGGTTAGA | 37269 |
| 3644 CACCATGCATAACCACAGGGCAATA | 15302 TGGGGCCAGCATTTGGTGTT | 26286 GATAGCGTGCACCATGCATAAC | 37270 |
| 3645 CCACACAGGCCCCATTACTTCCTA | 15303 GTACCTTTATCCCCAGTGGTCTTCA | 26287 CACTCATTGCCCTCCACTGT | 37271 |
| 3646 GGTCAAGGCCTATTACCCATGCTT | 15304 AGCCCTGTGAGCCTCAGATTC | 26288 CAGCCCTATTGGTCAAGGCCTATT | 37272 |
| 3647 TCTCATGTAAGAGAGGCTGGATCT | 15305 GTGTGCCCATATTAGGTCCTTGA | 26289 CCTGCCATCCTACCTGAATCATTCTCA | 37273 |
| 3648 GTGGCCTCCTTTCTGCTTGT | 15306 GACTATGCCACCTGCTTGCTGTA | 26290 TGGTGACTCAGTGGCCTCCTT | 37274 |
| 3649 TTAGGAATGGCTGTGTGTGGTT | 15307 CAGGGCATCATGATCAGTTTGGAA | 26291 GCGGCAACTAAGCTCAATTAGGAA | 37275 |
| 3650 GCGGTGAAACCCGTGTTCTCTT | 15308 CAGGACACACGTAAAGCCACAGA | 26292 TCATGGTGTTTGCGGTGAAAC | 37276 |
| 3651 TCCCACCTACCTGCTGTTCTTG | 15309 CATGCCAGAACCATTCTCGTCTT | 26293 GCCTGAGGTCACATCCCACCTA | 37277 |
| 3652 GGTTTGACCCCTCTTGCTTGTTTG | 15310 GGCCAGCAACTGGGTCTCTA | 26294 CCAGAGCCCTTCAGCAAGAAA | 37278 |
| 3653 AAAGAGTTGCATCCTCAGGGTTT | 15311 TCAGGATATCTGCTCCCTTCCAT | 26295 CCGCAGCATCAAAGAGTTGCAT | 37279 |
| 3654 TGGCACGGCAGCTCAGTT | 15312 CCATCTGCTGTAGCGAATATGTGAAG | 26296 CACACACGGCTTGTGGAAATAG | 37280 |
| 3655 CAAGCTGGCCCTGTGACTGA | 15313 CATACCTAAGCAATTTGGCTGCAA | 26297 TGTGCACTTCCTGGCTCATTT | 37281 |
| 3656 TGGCCCTGAAGAAAGAGAAATGAT | 15314 CCAGCTCAGAGGACCAGCTA | 26298 AGCTGTCTGGCCCTGAAGAAAG | 37282 |
| 3657 GCAGGACTACAGGGATGATGTAATAA | 15315 TTGGCTGGGGCGAGGGTAT | 26299 ACTGGGGAAGCAGGACTACA | 37283 |
| 3658 GGCTGACGGCAAGACATGAAG | 15316 TCATGGTTCCTTCTGGGGAAATG | 26300 GGTGGAAGAAGCTCTTGGTGATGATG | 37284 |
| 3659 CTTGATGCTCCTGGCATTGTTCT | 15317 CTTCCATGTCCAACAGATCTGACA | 26301 CATCCCACTGGTACAGTCAAGTTC | 37285 |
| 3660 CACGTGCTAGATGTGAAGGCAAGT | 15318 CAGCAAGGCCATGTGTCAAC | 26302 GGGTAGAACTCCACGTGCTAGATG | 37286 |
| 3661 TTAGCCCGGCTGGCCTAGTT | 15319 GCAGTGACAGGACCGCATGA | 26303 ACAGGGGTGGGCTTGCTTA | 37287 |
| 3662 AGCCAGCCCCTTTGTTCCTT | 15320 CAGTAGTACCACCCTAACCACCTTTG | 26304 TGCTGGAGGTGCCAGCATA | 37288 |
| 3663 AAACCCTGTACAGAGACTGCAAA | 15321 CTCAATGGGGTGATTGGCCTCATA | 26305 CTGACCATAGGACAGAAACCCTGTA | 37289 |
| 3664 GGGAGTGGGACTTGCAACCAA | 15322 CTTTGTCCAGCCCCAACACT | 26306 GCATGGCATAGTGGGGACATTG | 37290 |
| 3665 GCTTAACGCCAGGTCAGAAGATG | 15323 GTTGACCCAAACCAATCAGATACTTCA | 26307 GGACTGGCTCAAAGCAGCTTAAC | 37291 |
| 3666 TGCTGGTAATCCTGGGAGGTT | 15324 GGGTTGGTGTCTATTCCTGTCAAG | 26308 TCAAGTGAGACTGATCGTGGTAATC | 37292 |
| 3667 TCCTCCTGGCCAAGCTCTTTAG | 15325 CACCTCTCTGAGTTGCACTTTCT | 26309 AGCTGGCAAGCCTCGTAGA | 37293 |
| 3668 TCCAGGGAGGGAAGTGTTCA | 15326 AGTTCGCCAACCTCCAAACA | 26310 ATAAGCGGAGGCCCTGACTTC | 37294 |
| 3669 GACCCAGGGTGCCTGGTAAA | 15327 GCCTCACGTCTTTTAGCTCTGT | 26311 GCTGGGACGTACCTAAGTGGATGA | 37295 |
| 3670 ATTCCCGCCGGCAGACCAAA | 15328 CCGCATCCAGCGACCAAAGT | 26312 ACCCACCCTATACACCGCATTC | 37296 |
| 3671 CTCCAACTTCATTTCCCACTGTTTTC | 15329 GTGTGGCAGCAGCAGAGTAAGT | 26313 TCTGGCTCCCGGTAACATCT | 37297 |
| 3672 GCCTGCACTTTTTCCTCTTCTCCTCTA | 15330 TCACTGCCTCTCCCTCAACT | 26314 AAACCAGGCCTGCACTTTTTC | 37298 |
| 3673 CAGGGTGAGGATGTCCAGCTA | 15331 CCACAAAGCGGGCTGAAAA | 26315 ACCTGTAGCCAGGGTGAGGAT | 37299 |
| 3674 CACTGTGCTTTTCCTGATCGCATCT | 15332 AAACGGCAGGAGGCTCTGTCA | 26316 GGAGGATAACTGCCACTGTGCTT | 37300 |
| 3675 GCCCCTTTGCACCACTATAAGAGGAT | 15333 TGAGACTGGGAGGCAGCAA | 26317 CTTGCCCCTTTGCACCACTA | 37301 |
| 3676 GTTCTTCCCCTGGACCCAAAGT | 15334 GTTTCGGTTGAGTAGAGTTACCTGAT | 26318 AGCCCCAAACTCCCCAGAAA | 37302 |
| 3677 GTGCAAGGCTGGCTTCAGTTC | 15335 GGCATGGGTGTGTAGCTGTTTG | 26319 AAGGCAAGGGAAAGGTGCAA | 37303 |
| 3678 GGGCTTTGTCTCAGCTTCCTT | 15336 CGTTCATCAACCAGCGGAGTCT | 26320 GCCTGACCTTGGGCTTTGTCT | 37304 |
| 3679 AGACGGCCCAGAGTTCTGATAG | 15337 CCAACACTTGGCACTGAACTGA | 26321 TGGAGCAGCTGCCAGTTAGA | 37305 |
| 3680 TCCCACTGAAGCTGAAACGTATG | 15338 TTCTGCTGCCTGGGAACTTG | 26322 GGGAACAGAGGATCCCACTGAAG | 37306 |
| 3681 AATCATCTCCCCATTCGGCATT | 15339 CAACCTCCTTGGCTTTGACAGA | 26323 CCAGTTCCCAGGGTAGAATCATCT | 37307 |
| 3682 CTGAATGGCCTGAAGTCAGAAAAC | 15340 TGCACACTGATTGTCACCATTCT | 26324 AGTAGCCCTGAATGGCCTGAAG | 37308 |
| 3683 AGGCAAGACCTCACCTGTTG | 15341 TTCAGGCTCCCCTGGTACCATAC | 26325 CCAGGAGCTGAAGACACTAAGATG | 37309 |
| 3684 CCAGCATCACGGGTGTGTGA | 15342 AGCCCAGGGTCCTGTGTCA | 26326 GGTGAGACACCTGGGATAGCACAA | 37310 |
| 3685 GATAGTGGTGCTATTCACTGCCTAT | 15343 CTTCTCCATGCTCACTCTGCATT | 26327 GGTGCCTGTTAGATAGTGGTGCTA | 37311 |
| 3686 GACCACATGGTCTGCTGCTT | 15344 AGGCAATTTAAAGTTGGAGCCAGTA | 26328 CCTTGGCTGTGATTACAAGACCACAT | 37312 |
| 3687 AAGATCCCAGGCCCACACTCA | 15345 GGACCTGAACGGGGACTCTTTTG | 26329 GGCAGGGCTTGGCCTTAAAGAT | 37313 |
| 3688 GTCAATAAGCGTGAAACGTGGTAAC | 15346 CAGCTACCCCACAGCGAACTA | 26330 AGCTGTCTTAGTCAATAAGCGTGAA | 37314 |
| 3689 GTTCCCCAGACCACCTTCTACCTA | 15347 CAAGTAGCTGGACTAGGCTGCAT | 26331 TGGAAGGCCCCTGCTGTTC | 37315 |
| 3690 ACCTCTAGACACACTGCCTATCT | 15348 AAGCACAGTGGTCATGGTTGA | 26332 GCTGAAATGAAGTGACTCTACCTCTA | 37316 |
| 3691 CCTGCTTCTCACAAAGCAAGCTA | 15349 CCTGCCTATGTTACCCTTTCCAT | 26333 AGCTTTTCCCTGCTTCTCACAA | 37317 |
| 3692 CGGCTGCTGTCCTGCTTTG | 15350 GCACCAGAGAATTAATCAGATCGTTTG | 26334 TCCAATCAATAGGTTGCCAGTGT | 37318 |
| 3693 TGGCCATTCCAGGCAGGTAA | 15351 GACAGGACAACTCCTTGGCCATTC | 26335 GGAAAGACAACTCCTTGGCCATTC | 37319 |
| 3694 TGAAAGGTTGAAGCTGCACAGA | 15352 GTGGCGGTCACTGCTTAACT | 26336 GTGGGAGTACAGTGAAAGGTTGAAG | 37320 |
| 3695 TCCACCGACTCCGCGGCTAT | 15353 GGCCTGGCCAAGGGTAGGAT | 26337 GGAGACCAGATGGCGGGAAAAA | 37321 |
| 3696 CCTTCCTGCCTCTTTGCCTTT | 15354 GGCCAGTCCAGTCCAAGGGAATA | 26338 CCTTACTCCTGAGAAGTGCTTCTTTC | 37322 |
| 3697 ACTACTGTGCCCTTACCCCAAT | 15355 TCTTGGGCTATGCAGCAACTT | 26339 AGTGTTGCGAGCTGACAATTTAC | 37323 |
| 3698 CTATCCTTCCATCGCCACGTT | 15356 CACATGCCCCACTTCAGGAT | 26340 GCAGGCCTGACTAAATTCTCAACTA | 37324 |
| 3699 GTGGGTTACCTCTCAAAGCTAAGT | 15357 CAGTGTTCCCAGAGGCAACTTC | 26341 TCCAACAGTGGGTTACCTCTCA | 37325 |
| 3700 TGGCTGGAGTGGCAGCCTTA | 15358 GGACAAGAGAAGTATGCCAAAGATG | 26342 CCAGGTTCAACACTCTGGATCTGT | 37326 |
| 3701 CGCCCTGGAAACTCACAGCTT | 15359 CCTAGAGATTACGGGCAGTCCAAA | 26343 CATTAACATTAGCGCCCTGGAAAC | 37327 |
| 3702 GCATGGCAGGGACTGGATTGAT | 15360 AGCGCCTTGACTCCTCTTCA | 26344 CGGCCTGTCACACACATCAGATAG | 37328 |

FIG. 36F7

| | | | |
|---|---|---|---|
| 3703 GATGCCTCCCCTCTCTTCCTAGAT | 15361 ATTGGCCATTGCCAGGCACAGA | 26345 ACACAAGGTTGGGGCAGGAT | 37329 |
| 3704 AGAAAGGGCAAGGTGGTTTTGT | 15362 AGGCCCTCAGCGAACCTT | 26346 GGTCTGGGAGAATTAGGAGTAGTAGA | 37330 |
| 3705 CTGTTGATACCTTGAGGTGCTGGAA | 15363 TGCTCCAACCCCTGATCAAC | 26347 GCTGTTTCGCAGCCATCACTGTT | 37331 |
| 3706 GGTCTTGGGACACGAGCCAAT | 15364 ACCCTGACTACAACTGCACTGA | 26348 AAGGAGGGTGCGGGGTCTT | 37332 |
| 3707 CAGCGGCAAAACACCCTCTT | 15365 GGCCTGGGAAAAGGAGCAAGAT | 26349 CAGCCGTCAGCGGCAAAA | 37333 |
| 3708 GGCCTCGAAGGCATCACCTA | 15366 GTCGTCCTCTATGTGGAGAATGAGA | 26350 TGCCTTGCTGGGCCTCGAA | 37334 |
| 3709 GGGAGAAGCTATGAGCTGAGTGT | 15367 ACCCAGGATGAGTGCAGAGA | 26351 ACCCCTTTCTAGGGAGAAGCTATG | 37335 |
| 3710 TGTCCCACACGCTGCATATC | 15368 CCCCTCAAACAGACCACACATA | 26352 TCCATTCTTTCCCCACTGATTTGA | 37336 |
| 3711 TCTGCAACTACAGTGATGTGAAA | 15369 AGGGAGCCCTTTGGCTTCTACA | 26353 CACAGACAGGATCTGGCAACTAC | 37337 |
| 3712 CAGTGAAACCTTCTAAGCCCCTTTG | 15370 GGCCAGTTTCTGGTCTTCCTT | 26354 GTCATTGCCTTACAGTGAAACCTCT | 37338 |
| 3713 TCCACCTTCCTGTCCGAAGT | 15371 CTTCCTGGGGCAGCTAGTGT | 26355 GCCCCTTACACCACTTTCCACCTT | 37339 |
| 3714 TAGCCTGGGTCAGGGATGAAG | 15372 GTTCCAGTGACCCATCTTGCTATG | 26356 GGTGATTGGTGGTTGCACTCTA | 37340 |
| 3715 TGCTGGGCAACCAAGCTCAT | 15373 TAGCCTTCCCGAGCTGAAGA | 26357 GCCGATACGTAGGCGGAGCTT | 37341 |
| 3716 ACGCCTCACCCTACAAGCCATA | 15374 GGGACGGAAGTGGCCTGAGA | 26358 TGGGGTGCTTCTCTCTGGAT | 37342 |
| 3717 CAGCCTGTTTCAGGGTGACA | 15375 CTCCCTGAGGCTGGCCTTTC | 26359 GAGAGGGAAACTGGTGACAATACAGAT | 37343 |
| 3718 GGTACGGAAGTCGGCCTAAATCT | 15376 GGAGCACCCAGCTTCAGTGTT | 26360 GGGTGGATCCCTCCAGGATGTAA | 37344 |
| 3719 CGCCAGTCAAAACAGCCGTTAG | 15377 AACGAGGAAGGCCGGTGATT | 26361 TCCGGCTACGCCAGTCAAAA | 37345 |
| 3720 TCGTCTCCTCCCCGCTCTGT | 15378 TGATGACGGTGATGGCAGACA | 26362 ACCCGTGGCAACCCCTTTC | 37346 |
| 3721 CTGTAGTCCAGGCTGTGGATGA | 15379 TCCGCAGGTACTTCATAGAGGAT | 26363 TTGCCCTGGTCGCTGTAGT | 37347 |
| 3722 ATGGGTCCATGGGAGGGACTT | 15380 CCACCTGATGCATTCCCACTCA | 26364 AAGGGGACTTGGCCCACAGAT | 37348 |
| 3723 GCTTCTCGCCAAGTCATCT | 15381 TGAGGGATCTTGCACAGTAACTTC | 26365 CCTGTGACCACCCTGCTTCT | 37349 |
| 3724 CTTCTGAGGGTGTGGAAGCAAA | 15382 AGGTGCTAGGCACTCCTCACA | 26366 TGTGCCGGCTCTCCTCTTCT | 37350 |
| 3725 CCACTGACCCCAATAAGCCCAAT | 15383 GCACCAGGCTCTTCAGGGTTT | 26367 CCTTCCTACCACTGACCCCAAT | 37351 |
| 3726 GAGCGTCTGCAAAACACATCTTG | 15384 GCAGGCCAAATTGAGGACTATGGTT | 26368 CTCCTGGAGCTCTGCAAAA | 37352 |
| 3727 GGTGAAGGTAGTTGGGGTGAAG | 15385 CTTCTCTTCCCTATTTCGTCTTCGTT | 26369 TGAACCTTTTTGGGTGAAGGTAGT | 37353 |
| 3728 GGAGAACTGGGGATGCTTTT | 15386 GGTGGGAGTAATGGCAGTCTGA | 26370 GTGCAGAATAGGCAAGGAGAACT | 37354 |
| 3729 TGGAGACTGGTCAGCACCAT | 15387 GCAGAGAGGACACTCACCCATCT | 26371 GGAGAACTTCACCCATGTCCCACATT | 37355 |
| 3730 AGGAATTGAACATTGCTGGGTTTC | 15388 TGGGTCCTTGCCTAGTTGAGA | 26372 GGGCTCCAATCAAGGAATTGAACA | 37356 |
| 3731 TCAGAGGGAAGGCTCCATGTT | 15389 TTCCGCGGACAGTGCAGAT | 26373 GACAGGTTGGCCTGAGTTTCAGA | 37357 |
| 3732 TCTCTGCAGGACTGGCGTTTAG | 15390 CACAGCTCCTGCTCCACCATAG | 26374 GTCCCTGTCATTTACACGTGTTCTCT | 37358 |
| 3733 ACTGGCTGTGACTGGTGGTA | 15391 AAACGAGTCGAGGCCAGTCA | 26375 CCTGTGTTGGCCGACTTTGA | 37359 |
| 3734 CACAGGACTCATACCTGGGAAAC | 15392 CGTGAGGTCATGTTTGAGCTGTA | 26376 CTGGAAACAGACCCTGCTCACA | 37360 |
| 3735 TTCCCCACATCAGGAGGTGTTC | 15393 TGAGGTGCTGGCTGGGATGT | 26377 TTTCTCTCCGCTCTCTCCTTTTC | 37361 |
| 3736 CATCAGCTTATGTGAAGCTGGTACT | 15394 GCCAGGCTCACGCACATAATCA | 26378 CCACCGTCCGCATCAGCTT | 37362 |
| 3737 GGTGAAGGCCAATCTCCTGTTG | 15395 GGGGTGGTATCCATCTTTCACTGT | 26379 GGGAAGAAGGGTGAAGGCCAAT | 37363 |
| 3738 AGGGCTGCAACTGCCAAGAA | 15396 TTAGCCGAGTCCTTAGCATCATC | 26380 GGGAGGGTGCCATTCATTCCAT | 37364 |
| 3739 GTGCACCTCAGAGGATTGGCTTA | 15397 TGGAGGTCCCAGGGCTCTAA | 26381 GGAGAGGGAGGAAGATGGAGTTTC | 37365 |
| 3740 GAGGCAGTGGGCTTGAGATAC | 15398 CCTGTGATTACTGCAGCAGGTGTT | 26382 CTGGTACGGCATTGGTCTCTGA | 37366 |
| 3741 GCTACAGGGCGTGTGGCATCA | 15399 TGTTGGGCCCCTCAACATCA | 26383 GGTAATCGACAGCAACATGCTACA | 37367 |
| 3742 GCACAGCCGTGGGAGGATAAGGTAT | 15400 CCCCAACTTAGGCTCGAAGTACCAT | 26384 GGCGGCACCGCATTCTTATAG | 37368 |
| 3743 TAAGGGCAGCCTCTCCGTGGTT | 15401 GCCCAGACCAGAAATTCCAAGATG | 26385 TTTGGGGAAGGAAGGCCCTAAG | 37369 |
| 3744 AGGGGTTTCCGGAAGACTTTG | 15402 AGGTCGTGGAGTCTGATACCAA | 26386 CAGGAATTTCGCGAAGGGGTTTC | 37370 |
| 3745 AGGGAAGTGACTGTTCTTCCTTCTA | 15403 GCAAGAGTGGCCATAATCACTTG | 26387 GCTACAGAAGGGAAGTGACTGTTC | 37371 |
| 3746 GAATTAGGGACCCCAAGAGTCAAC | 15404 CCAGCTTGGCCACAGAAAGGTA | 26388 CCATTTAAGGAGCCAACTCCTGGAA | 37372 |
| 3747 AGGCTCCTCAAAAGGCAAACT | 15405 GGAAAGTTTTAAGTAGGAGGCAGTGA | 26389 TTCCTTCACCTCATTGCATACAGA | 37373 |
| 3748 GTAGCCCATAGCCCTCAAGTCT | 15406 CCTGCAGAGCCGAGTGGAT | 26390 TGCTTTACCCTCAGCCAGTGA | 37374 |
| 3749 CTGGGGCTGATTCTTGCACACTA | 15407 TTGTTCGCAGCTCACCAGAT | 26391 TGCAGACTGGGCTGATTCT | 37375 |
| 3750 GGCTGGATGTTGAGACGGAACA | 15408 CAACCAGCCACCTGTGTGT | 26392 TCCCAAGACTCTGGCAGACA | 37376 |
| 3751 GCCTGTCATCCTAGTTCTGGAGTA | 15409 TCTGCCTGGGCTCCTGCTT | 26393 CCCTCAGGCCTCGTCATCCTAGT | 37377 |
| 3752 GGCCAGGTGGCAGCCTAAAAT | 15410 GGAGCCACAACAGTGATTCCAT | 26394 GGGGCTTAAGGAGCCCAATGT | 37378 |
| 3753 GCCTGCCCCATTGATATTTAAACAAG | 15411 CCCGAAGCACATCTCTGGTCAT | 26395 ACCATGCCTGCCCCATTGAT | 37379 |
| 3754 GTGCCTAAGGCCACTCCTTATT | 15412 CCTGCAAAGGCAGCTGAGCTAAAG | 26396 GGGTAAATGCTACTGCAGTGCCTAAG | 37380 |
| 3755 TGACTAGCCAATGTCCACAGAAG | 15413 TCACATAGGCCACATCCCTTCA | 26397 GAGGTTACTGTTTGCTTTGCATTGACT | 37381 |
| 3756 ATCCTCCCGCTCCTCTTCAGAT | 15414 AGGAAAGTGGCCTGCTGTGA | 26398 TTCCTGTTCCTCCGCCTACA | 37382 |
| 3757 CACCAAATTCCAAAGGGCCAAGT | 15415 CTAAGGGACTCACCCTTCACTTC | 26399 GCCTCCATGGTTGCACCAAA | 37383 |
| 3758 GGCACTGGGCCTTTTGTTCA | 15416 TCCCTGGAACCCAACTTCAGA | 26400 GCCATGATAAGGAATCTCGGGTGAAG | 37384 |
| 3759 TGGCAGTAGTGCTTCAGGTATG | 15417 GGGAAAAGAGGGCTCTGGAACA | 26401 ATCCTCGCGATGGCAGTAGT | 37385 |
| 3760 GGGTGAGGCTGAGGAAAGTGTT | 15418 AGGCGGTTTCACATCTTCTGT | 26402 GGAGTGCAGAGGAAGGACTTATG | 37386 |
| 3761 GCTGAGCCCCAAGGGAAAAA | 15419 GAAGCCTTGCAGCTGCTTTC | 26403 GAACTTGGGCCACTAGCTTCA | 37387 |
| 3762 GACCGCCAGCTAAAAATGCTTTG | 15420 GTCATACCAGCTGGCCCAACAA | 26404 TTCTCCTAGACCGCCAGCTAA | 37388 |
| 3763 CTCCAAGACGCTGAAACCTTCCTT | 15421 GGTGCTGGGGATGCAGTTTC | 26405 CCAGCTCTCCAAGACGCTGAA | 37389 |
| 3764 TTGGAGGCAAGTGGCACAGA | 15422 AGACCCCATTCAGGCACTCT | 26406 TCTTGCCCTGGTCCCACAGT | 37390 |
| 3765 GATGCATCAGGGCTACAGTGTATAG | 15423 TGCCCTCCTACTGCTGGACTAA | 26407 GGTGGTAGAAAGGCGTGTGGAA | 37391 |
| 3766 AGAGAGGGGAGCCCTGATCGA | 15424 GCTGGAGTGAGTGAGGCAGACT | 26408 ATCGGTTTCCTGGGCTGTTG | 37392 |
| 3767 CCCCAGACATGGTAGAGGAGATAC | 15425 GGAATCCAAACAGGCACAGTGA | 26409 TCCACTTGTGACCCCAGACA | 37393 |

FIG. 36F8

| | | | |
|---|---|---|---|
| 3768 ACTTGTCCATGTGCGTCATACT | 15426 GGAAGGGAATTTGAGCAAGCTGTTTC | 26410 GTGCAACTTTTCTCCATGAACTTGT | 37394 |
| 3769 TGTGGGGCTTTGGCAGAGAA | 15427 TGGAAGGCTGTACCCTCGGTTT | 26411 GCCTAGTACATGTGGGGCTTT | 37395 |
| 3770 GCCATGATCTGGTCGGAAACT | 15428 TGGGAAGCTGGCCTCACTT | 26412 GTCATGGGATGGAGCCATGATCT | 37396 |
| 3771 GTGGGAGCTGTCAAGAGGAAGA | 15429 ACTTCCTGGCACCCTGAAAC | 26413 GGTTGTGCCAGCAGCAAACTA | 37397 |
| 3772 CCCTGAAGGCTCCATCCTGAGA | 15430 AGAACAGAGGGCAGGTCACACT | 26414 GGTGCCATGTTTTCTCCCTGAA | 37398 |
| 3773 CATGTTTCAGCCCTGACAGCTTTG | 15431 GCATCCTTAACAAGCACCAACAT | 26415 GCTCCCTGCTTTAGGCACAT | 37399 |
| 3774 GGCTTTGGCCCCGGCTTAT | 15432 CCCAGGGCTCAGCCGAAAT | 26416 CCCATCTGCCTTCACTAAGGGCTTT | 37400 |
| 3775 GCAGGCTGATGTTTGCATCGTCTT | 15433 CCTCAGTGGTGAGGAGACTGTTTG | 26417 CACTGAGCAGGCTGATGTTTG | 37401 |
| 3776 ATTCCCTCCTCCGGCACTGAT | 15434 GGCATGGTGGCGCCTTTTG | 26418 GCATGGGTTTTGAGGCACAGATTC | 37402 |
| 3777 CTCCGTACCTGGATGAGGAAGATG | 15435 GAATCTGCCCACTTTCACCATTCT | 26419 TGCACTGCTCCGTACCTGGAT | 37403 |
| 3778 GTGCCTTGGCACATGCTGTAG | 15436 GGTGGGCAGTAAAAAGGGGATT | 26420 ACACCAAGGCTTCCTTGTGCTA | 37404 |
| 3779 AGTGGTGGAGTCGTGCTAGA | 15437 AGGAGAAAGAGCCTGGGCTTCA | 26421 TTCCCAGCCTCCCTTGTAGT | 37405 |
| 3780 GTCCCCAGATCCCAGGAAACAA | 15438 GCTTCCTTCTGGCCCACTGTT | 26422 GGCTCCTGTTTTAGTCCCCAGAT | 37406 |
| 3781 GACAGCTAGCCTAAAGCCTCCAT | 15439 TCTGGCCTGTGGCTCTCTACAA | 26423 GGCCAATATGACAGCTAGCCTAA | 37407 |
| 3782 GAACCAGCAATGGCAGAGACA | 15440 ACCGTGGGAAAGTGCAGGAA | 26424 GAGAAGGGGATAGGAGACCTGAAC | 37408 |
| 3783 AGCTGTGTCCACTGGGTCAT | 15441 CACGAAGACGAATGTATGCACAAC | 26425 CAGGGTATCAAACTGTAGCTGTGT | 37409 |
| 3784 CCCCACAATGGCCAAAGCAA | 15442 GCAGCTGGCTGGCTTTCA | 26426 CCACAAAGTGCTCTTTCCCCACAA | 37410 |
| 3785 GTCCAGACTATACCCTGCACTCA | 15443 ACCCAGCACCTGGAAGGAT | 26427 GCATAGCACCCTGTCCAGACTAT | 37411 |
| 3786 GTTTGGTACACAACTGTCCAGCTA | 15444 ACCACAGGCTGGCTGATTTC | 26428 GCCTCATCTGCAGTTTGGTACA | 37412 |
| 3787 GGATCTGTTGTAGCCCCAGAAGTT | 15445 GGGCAAAGGGACTGCTCTTCT | 26429 TCAGGCCTGCAAGGATCTGT | 37413 |
| 3788 TAGGCAGTGGCAGGGTGGTTT | 15446 CTACATATACCTGAGCATCCCATCAAC | 26430 CATTCAGGCACTGGCTGTGA | 37414 |
| 3789 TGCTTCTTCACCCCTCTGAAC | 15447 GCTGCGGAAGCAGAGGAACTT | 26431 GGCAGAACTGAAACATGCTTCTTC | 37415 |
| 3790 CTGTGTTGGCTCCTTCCCTTTC | 15448 GCAAGTGGTATTTTGGGAGGTGACATA | 26432 TGTTGGTTAATGCACTCTGTGTTG | 37416 |
| 3791 CCCCATTCTATGCAGCCTTGGAA | 15449 AAGCAGCTGGGGTGCAGTGT | 26433 GGTTTTGTGGGCCCCATTCT | 37417 |
| 3792 GCTGCTTCTACAAATCAGCTAGAAAC | 15450 CCAGCATCCTCCCAATTTCCAT | 26434 GGTTGTCGCTGCTTCTACAAATC | 37418 |
| 3793 CTCCATTGGCCTGGTTTGCTT | 15451 CACCCTCTGTGACTCACTTTTCCATTA | 26435 GGACTTGGGAGAAGCAAAGTGTTC | 37419 |
| 3794 GACACCCTGGACCCTTGACTTCTA | 15452 CCACAGGGTTTGGGACAGTGTAA | 26436 CCTAGCCTAAAATAACCATGCACTTG | 37420 |
| 3795 GTGGTTGGGAAGCAGGTCAA | 15453 CTGGGCCATTGTCTGGCCTATT | 26437 CCTGGGCCAATAGTTAGAAGTGGTT | 37421 |
| 3796 GCAGTTTCTGCACCACACATTC | 15454 CCATGCCTGGGGTGACTGA | 26438 TAGGGGTGCCTGCAGTTTCT | 37422 |
| 3797 CATGCTTCCAATAACCTCTTCGTAGTCT | 15455 AGGTGCTTGTGGCGTGTTTG | 26439 GGCCTTTCCTCATGCTTCCAA | 37423 |
| 3798 GGACGTTTGCAATCCTGGGCATAG | 15456 TGGAGGCCCAAGGGTGTCA | 26440 CCCCAGGGAAATCTACACTTCTCTCA | 37424 |
| 3799 GGTCCTCCGAGGCTTGTTGAA | 15457 ACCCTAGGCCCCAGCATCA | 26441 CCTTGTGAGGCCAGGGAGTT | 37425 |
| 3800 AGGGGCAGACTCCACTTGCTT | 15458 CCTCCTGCAAGGCGTGGAA | 26442 AGTGCCAGCAGGGGCAGACT | 37426 |
| 3801 GTATGGGATGTGCAGGATGACA | 15459 TGCTTTGAGTTTCTGGGACTAGTTT | 26443 CACTACATTGTCCGTTCCCATTG | 37427 |
| 3802 AGCTTGGGGTATGGGTGCAA | 15460 GAGGCTGTAAGGCAGCCACTTT | 26444 GGTGTGTGGATGGGTTAGCTT | 37428 |
| 3803 TTGCAACTCGGCAGGGAACT | 15461 GACATGGGGCCAAGTGATCT | 26445 GCTCAAACCACCTTTGCAACT | 37429 |
| 3804 ACACCAGGTATAAGGTGGCATTG | 15462 GATCATCCTCTTGACAGGGAGTTG | 26446 AGAAGGACTTCACAATGCCATTACA | 37430 |
| 3805 TGTCTGGGTGGGTGCTACACTT | 15463 TGCCTGGCCTGGTTGTACTTCT | 26447 GGTAGCAGAATATGGGTCCCTGTCT | 37431 |
| 3806 AGCCTGGAGGCTGAAAGACT | 15464 GGATCGCGGGTTTCATCCAGAA | 26448 CGAAACCAAACCTTCAAGCCTAA | 37432 |
| 3807 AGCGCGTCAAAGGCTGAAGT | 15465 CTGCACCGGCCAAAATGAGGAT | 26449 TCCTTTCCACAGCGCGTCAA | 37433 |
| 3808 GCTTAATCCTCTGGATGCAGTTCT | 15466 ACAGAAGCCCAGTTTGGTATATGTAG | 26450 GTCTTGTACCCTCTTACCATGCTT | 37434 |
| 3809 TGGCCGTGTGAGTCTGTAAAAC | 15467 GTGGATTCCTGTTTTGTTCTCAACTTC | 26451 TGCCGTCTGGCCGTGTGAGT | 37435 |
| 3810 GAGTGGGTTGGGGAGGTGATAA | 15468 TGCCCAGAAGTGCCTAGAAAAC | 26452 AAGGGCCGTCCTTGGGAGTTA | 37436 |
| 3811 CACCATGCCTTCCTCCTCCATT | 15469 CCAGCAAGAAGACAGAGTGTCA | 26453 TAGCTGGGACCACAGGTGCAT | 37437 |
| 3812 AATCTGTACTCCCAGAGGTGAAAAG | 15470 CTGTCTGCTGGGGTAGAGTTG | 26454 CCTCTCTTGTGTCAGCACCCAATC | 37438 |
| 3813 ATGGCTGCTTCAGGGGCAGTT | 15471 TCATCCCTACAGCTGGGACCAT | 26455 TCCCTGAGGGTAGGCCTCTGAA | 37439 |
| 3814 GTGCACCAGAATAGATGTGAGACT | 15472 CAGGCACTCTACACCAGGAGAAAT | 26456 AAGTGTGAGGACTGAGGAGTCA | 37440 |
| 3815 CAGGGTCTTTCTTCCCTCATGTAAA | 15473 GAGGCAGTCCTGACCATACAA | 26457 CCAGCAAACAATCCCAGGTCTT | 37441 |
| 3816 TGAAAGGGGAGCCCAAGTCTCT | 15474 CCCAAGTGAGGCATAGTGGTTTC | 26458 TGCCAGGAACAACTCAACACT | 37442 |
| 3817 GAGTGCCTGAAGAGGGCAGTATC | 15475 CGCCCCGACTTTGTCTTTGACT | 26459 AGCATTGTGAGTGCCTGAAGA | 37443 |
| 3818 GCAGGAGGACAGGCAACTTAGA | 15476 GTCTGTTGGATGTTGCTGTTCA | 26460 CATAGCTGGGAGATTAAACCAGTTGT | 37444 |
| 3819 TGTCCCAGCCAAGCCTAGA | 15477 GGGCATAATCAGGGAGCCAGAA | 26461 TGGTCCAGGGCTGCTGTGT | 37445 |
| 3820 GTGGTCCTAGGTAAGCTGGTGTTG | 15478 GGAGACCATTGGCCTGCTTCATAG | 26462 ACTTTCTGGGTGTAAGTGGTCCTA | 37446 |
| 3821 GGATATAGTCGTGGTGGGCTTCA | 15479 ACACTTTGAACGTCCAGGCAAA | 26463 CCAAATATCTGATGCCAGGGAAGGATA | 37447 |
| 3822 GAGGCACTGGTATCCATGTTGAGA | 15480 GAGTCCTGGGATGTGAACCATCTA | 26464 CCACTGGAAGAGGCACTGGTATC | 37448 |
| 3823 AGGTGACAGGAACCCAGGAA | 15481 TTCAGGACTGGTGCCTGCTT | 26465 GCAAGCCAGTCCATAGGTGACA | 37449 |
| 3824 ACAGACGTAAGACAAGGGTTTG | 15482 TGAGGCCACCTCCCAGATAAA | 26466 GTCCAACTGGGTTCCCCAATAAACA | 37450 |
| 3825 CCAGCAACAGCAGTGCCAAA | 15483 GCACAGCAGGTTGCTCTCA | 26467 GCTTTCCAGAGAAATCCAGCAACA | 37451 |
| 3826 CCCAGCCAACATCTCACCTTT | 15484 TGAAGAGGTTTGCTGCACACTA | 26468 CCACGACACCCAGCCAACA | 37452 |
| 3827 GCCTAAGCCTCTTTTTCACTACCCTCTA | 15485 AGCCCCTCATCACTGTGGTA | 26469 CACGCTCAGCCTAAGCCTCTTT | 37453 |
| 3828 GGTTCACAGATGGTTCTGCACGATA | 15486 CTTTCGGGTTGTGCCTGCAT | 26470 AGGACCTGGTTCACAGATGGTT | 37454 |
| 3829 TCATGGCCACCACCAGACT | 15487 ACCTGGCACGTTCCGTACA | 26471 GGCCTCCATTAGTCTCACCCAGAT | 37455 |
| 3830 GGAAAGGTCTAAGCTTGGTTCACA | 15488 GGCTTCCACCCACATACTAAGACA | 26472 GCTGATGAAAGAGGGAAAGGTCTA | 37456 |
| 3831 GCCTGGTTGCATTTCCCTATGT | 15489 CTGGGGTCTGAAGGCAGAGATA | 26473 TCAGATCATGCCTGGTTGCAT | 37457 |
| 3832 TCTGTGCCTGCGTGGAGTTG | 15490 TGGGACGCCTCTCCCCTCTT | 26474 GGCCCATCTGGGATCTCTGT | 37458 |

FIG. 36F9

| | | | |
|---|---|---|---|
| 3833 CTGCTGCATAGCCAGAGATCTTTAC | 15491 TCCATGACAGGCAGCACAGT | 26475 TGGGCTGGGGCTGCAGACTT | 37459 |
| 3834 TGCCCAGGTTGCTCCCTAGT | 15492 GAGCATAGACCGTGCAGGGAAA | 26476 TCCAGGCTTTGCCCAGGTT | 37460 |
| 3835 GCCATCCACTGAGGGCAGAAG | 15493 ATGCCAGGGTGCCAAAGTCT | 26477 ACCTGGGCCATCCACTGA | 37461 |
| 3836 CCTGCCCATCATCCTTCAGGTCTT | 15494 CAGGGCTTGTGGAGAAAGCAT | 26478 CCTTGACCCCTGCCCATCAT | 37462 |
| 3837 CTGCCTGCTGTCTCAGCTTTTC | 15495 AGTGCTGGCTGTTGCCTCTTTC | 26479 GCTATGGCTGCCTGCTGTCT | 37463 |
| 3838 TCAGGCTTCATCTCCTCCAGAA | 15496 GGGGAAGCATGGTGGAAGTAGT | 26480 CCCCTTCTAAAGCTATCTCAGGCTTCA | 37464 |
| 3839 CAAGTAGCAGATTGGTGTAGGAAGT | 15497 TCGGCTCCCTGCCAGCAAA | 26481 GAGGTGTCCCAAGTAGCAGATTG | 37465 |
| 3840 GGAATTCAGGACAGGAAAGTGTCT | 15498 GGAAGCATCCGGCTCTGACT | 26482 GCCTTTTTGGTAGCCCGAATATG | 37466 |
| 3841 GCTCCTAAGGAAATTCTTGGGGATGA | 15499 TTGCCAGGGGCACAGCAAAA | 26483 GCCAGCCTGCTCCTAAGGAAAT | 37467 |
| 3842 CCACAGGCTGCAAGACACA | 15500 GTGCATGCCAGCCTGATTTC | 26484 GGCCACAGCAGCCAGAAAAA | 37468 |
| 3843 TGCCAGGGCTAGAGTTTGAAG | 15501 AGGCCTGCTCTGGCATGTT | 26485 GACAGGGCATAATTGGAAAGCCTTTA | 37469 |
| 3844 GCAGGCACACAATAGTAAGGAACAGA | 15502 AGCAAGGGGTGGGGTTTGAA | 26486 CCAGAAGGGCTAAGAGACTTGTCA | 37470 |
| 3845 CCCCAGAGGGTACTGGGTCAAGAT | 15503 TGTAGAGGGGCCTGACTGTTCT | 26487 TGCCCTGCCCCAGAGGTACT | 37471 |
| 3846 CGAATGGGTTACTCCCCAGTGA | 15504 CACTTTGTCTCTTGGTGGAGAGTGT | 26488 AGCCCAGACGAATGGGTTACT | 37472 |
| 3847 TCAGCTTGTCCTCTTGCAGAAA | 15505 ACCGTGCCTGGCTGATTGTT | 26489 CGTGGAATAGGACTCTTCAGCTTGT | 37473 |
| 3848 GGGCTTGAATGTGCTTGAATAGTTG | 15506 GGCCATGGCAGAAATGCAAGA | 26490 GCAAGCAAGGGCTTGAATGTGCTT | 37474 |
| 3849 TTCCTTCTGGCCCAGGGTGTAT | 15507 CAGGGCCCTAGCTCCTGGATGA | 26491 GGTCCTTCTCTTCAAGGAAATGAGTT | 37475 |
| 3850 CCTCAGGCCCAGGGGTGATAA | 15508 GACCAAGGGCAGGTTACAGAGA | 26492 CTGATAAGCACACTATCCCTTCACT | 37476 |
| 3851 GCAGGTCTGTGGGTCAGCTA | 15509 TCCCAGAATAAGAGGTATGTGGATCA | 26493 CTGCTTCATGTTGCAGGTCTGT | 37477 |
| 3852 CTCTGCAATTAAAGCCAGCAGAAGCTA | 15510 TGTGCATGGCCATCCTATCT | 26494 GTGCTGAGGTTGAGAACTCTGAATTA | 37478 |
| 3853 ACAGAGAGCCGGCCACCTATTCT | 15511 AACAGGGCAGGCAGGCAGTT | 26495 AGTGGCAGCCTCACAGAGA | 37479 |
| 3854 TGGGAGCATCCCTCCTCCTAAC | 15512 GAGGCCCATTTCCACACAGTGA | 26496 GACCTCCTGACTGGGAGCAT | 37480 |
| 3855 AACCGCAGAGAAAAAGGGATGT | 15513 GCCCCATTGTCCACGTCATA | 26497 GGCTAGCAGCTGTGGAGAACAT | 37481 |
| 3856 GAGGCAGTGATGACTCATGTTTAAGA | 15514 CACCATGCCCAGCCAGAACT | 26498 GGTAGGGAAGAGGCAGTGATGA | 37482 |
| 3857 GCCCCAGCCTACTCCTCTGA | 15515 GGCAGAGAGGGTCCTGTTGT | 26499 GGAACTGGTCTGCATGTGTTACT | 37483 |
| 3858 GAGCTGCTGTAGGAGGGATGAA | 15516 GCCCAAGAGAGACACGCTGAT | 26500 TGCAGGAGACAGCAGGACAT | 37484 |
| 3859 TGCCAAGGCTCTGACTGCAA | 15517 ACCACCACCCTCTCTCCACAAA | 26501 GGGCCTTGCTGATTCTGTGCTT | 37485 |
| 3860 GCAGGTGCTACACTAGATGCAAAC | 15518 GAATTCATAGGTAGGGTGGTGGTT | 26502 AGGCTGCAGGTGCTACACTA | 37486 |
| 3861 GCTACTCCAGGGCAAAGCTACT | 15519 GGCTGATGGTACTTCGTTCTCCAA | 26503 GGATTAACCTGTTTGGGACAGCTACT | 37487 |
| 3862 TGCCACTTGACACCCATCAAAG | 15520 TCCCGCTGCTAAACTGCTGAAG | 26504 CTACTGAACCACTGCCACTTGA | 37488 |
| 3863 GGCCCCAGGTCAGGACATAGT | 15521 GCCAGTGCCAGTCTGAAAGCAT | 26505 GCCTAGTGGCATCTGTGGCATT | 37489 |
| 3864 GCCATATACCTAGCACCACACTT | 15522 CCTAGGTGGGAACCACTGAAGGTA | 26506 CCTCTTCCCACTTTGCAGCTATTC | 37490 |
| 3865 GTGATACCTCAAGACTGAGACCACAA | 15523 TTCAGGGAAGGCCCTACTGT | 26507 GAGTCCAAGAAGCCCCTCAAAT | 37491 |
| 3866 ACTGGAACCCAGGGCTTTTAAC | 15524 GCATGGGCTGCAGTGGAAA | 26508 CCCACTACAGAGCATTTACTGGAA | 37492 |
| 3867 CGCAGAGACATGTGGGCAAAGA | 15525 CCTCAGCAGGGGAAAGAAGCAA | 26509 GGCAGCAGAATTATTACGCAGAGACA | 37493 |
| 3868 GACTCCACTGGGTGTTAACTTTTG | 15526 CGCACCACAGTGGCAAATCT | 26510 CGTGTCTCCATTTGACACAGACT | 37494 |
| 3869 TTGCCCCACTTCCTCCAGAA | 15527 GCAGTACCTGCGGTGAGCAT | 26511 CCAGCTCTCCATCCTCCTTCTTG | 37495 |
| 3870 AAGGCTGGATGCAGGGCTAGA | 15528 CCCAAATTTCTTCGGCTTCACGAT | 26512 CCACCCTGTTTCAAGGCTGGAT | 37496 |
| 3871 CAGCCCCACCAGAGGGTAAG | 15529 AGGGTTGGAAGGGGAGACTGA | 26513 GTGACTATAGACCATGGAGTGAGT | 37497 |
| 3872 TGCTCCACACATGGGCACAA | 15530 GCTTCAGCTGGGATGGTGGTTA | 26514 TGCTGACAAGGGCCACCTTA | 37498 |
| 3873 AGTGGCTCTGGGCCTGTGTAA | 15531 CCCAGGGTGAGAACCCAAGTT | 26515 TGAGGGCCTTTCTGCCACAT | 37499 |
| 3874 GGTGGGCCTTGTGGAGAATGT | 15532 CCTTGCCTTGTTCCCATCTTTG | 26516 ATGATCAGGGTGGGCCTTGT | 37500 |
| 3875 CTGCATCTTGCCTTCCCAGAA | 15533 TTCTGGGCCCTTTCTTGCTATC | 26517 TGCTGAGTGCCCTGCATCTT | 37501 |
| 3876 ATTAAGACAGGGAGGCACATGAAT | 15534 GGACAAAACCTGCACCCATTG | 26518 CTTGGTATGCGCCCCTGAT | 37502 |
| 3877 CGTAAGGGGAGGAGGTAAGCAACA | 15535 GCCAGTACATGTCAGGCACTTA | 26519 CCCCAGCTCTGTCCCGTAA | 37503 |
| 3878 CACTGACCATCCAGCCTGATTTTG | 15536 AGTGCTGTGCCATTCAGGAAA | 26520 CCGTTGCTATCTCAACACTGACCAT | 37504 |
| 3879 TGGGCCATGCATAAAAGCTAACA | 15537 GCCCAGTGTGGAAACATGGAA | 26521 TCTGTGATATTGGGCCATGCATAA | 37505 |
| 3880 GAATGGGTGGCTCCTCTCTGAAG | 15538 CTGAAGACTGCAGAGACGATGAGATG | 26522 CTCTCAACAGAGAGGATGACCTAGA | 37506 |
| 3881 TCACTCTCATAGCACTGTGTTTCA | 15539 CCCAGACAGCCCTGCACAA | 26523 GCCCGCATCTTTAGCTGTGCTT | 37507 |
| 3882 CAAAGCTGCAAGACGCCCTAA | 15540 TGGGGCAGTTTCCCAGTAGT | 26524 AGTGCCAAATCTCTTTCCCCAAA | 37508 |
| 3883 GGCCATGTGGAAATGGGACCTT | 15541 TTGGAAGCGAGCAGCCATAC | 26525 TCAATTCCTGGCCATGTGGAAA | 37509 |
| 3884 CAGTGTTTCGGGTAGGGTAGA | 15542 CCACCTAGTCCTGGGCTCTTAG | 26526 GCTTGCTATGGTAATGGCTACAGT | 37510 |
| 3885 CGCTTGGAAAGAGAGCAGGAAATC | 15543 GCCAGGAAGCAATCTCCGTAATC | 26527 TGGCCGCTTGGAAAGAGAGA | 37511 |
| 3886 CTTGTCAGCAAGCTGGGTCTCT | 15544 GCGCATTATCACCACTCAGACTTC | 26528 GCGAGTCCTACACCCTTGTCA | 37512 |
| 3887 GCCTAAGAAATCGCTACAAGACTAGA | 15545 GCCGTCCAGGCAGTAGTTC | 26529 GGGAGGGCCAAAGCCTAAGAAA | 37513 |
| 3888 GCAGCCTCGAAACTAACCCACAA | 15546 GCTGCTAGACTGCGGGTTTC | 26530 CCATCTGCTTACTCCAGTTCTGT | 37514 |
| 3889 GGAAGGAGTCTCTCTCAGGAGCTGTA | 15547 TGCATCGCCCCTCACCAA | 26531 TCCCCAAGTGGAAGGAGTCTCT | 37515 |
| 3890 GGCTGTTGCCATGAACCCATAG | 15548 ACTCTGAGTGGAGGTGGCCTTT | 26532 GCAATAAAGTTAGTCCAGGCTGTTG | 37516 |
| 3891 AACCAACCTGTTTACAGTCTCACT | 15549 CTCCCCACCACCACTGAGAATAA | 26533 GGTCCAGAAGGTTAACCAACCTGTTTAC | 37517 |
| 3892 CCCTCTGGTCAGGAGAGTAAA | 15550 GTAGACTGCTGGGGTTTAGAGACT | 26534 CAGGCTGAGCTCTCCTATCTAATATTTC | 37518 |
| 3893 AGCAGAGACCAGCCCATCAT | 15551 GGCTCACCAGTGTTACCAGGAT | 26535 GAGGCTAGAGAACTAGTAAGCAGAGA | 37519 |
| 3894 CCAAGGACTCCTGCAATCCTAGTCA | 15552 AGGGCCTGTGAGGGTTGA | 26536 TCTCACCAAGGACTCCTGCAA | 37520 |
| 3895 CACTAAGACTTGCCTCCCCATCAT | 15553 GGTGGAGTCAGTGGAGCCAAA | 26537 GCCTCAAGCTTTCTGTAAACACT | 37521 |
| 3896 CCTTCCTCACAAGTGCTTTCTGAAT | 15554 CGGCCAAAGAGGTTTCGTTCT | 26538 GTGTTCCACCAGCTAGGCACAT | 37522 |
| 3897 TCCTCAACCCTTTGCACACAT | 15555 GTGGCCCTTGCTGACCATTA | 26539 GCTCAACCAGCTCACTCCTCAAC | 37523 |

FIG. 36F10

| | | | |
|---|---|---|---|
| 3898 GTGGCAGTCTTAGCTTCCAGTT | 15556 CTTCCACCAAGAGATACAACAGTGA | 26540 TGGCCGTGTGGCAGTCTTA | 37524 |
| 3899 CAGCAAAGCAGCAGGTGACAGA | 15557 ATTCTGGGCTGGGTCCCAAA | 26541 GGAATCAGGATGCCATGGGATGAA | 37525 |
| 3900 AGTGGCTGTCAAGCCCAACT | 15558 CTTTTCCCCTTCCCATCATCTGATTC | 26542 AACTGACCAAAGTGGCTGTCA | 37526 |
| 3901 GCCTAACACAAAACAGGTCCATTT | 15559 CACATGGTAGCAGGGATTGCAAGA | 26543 TCCCCAACCCACCATTCAGTTG | 37527 |
| 3902 GGCTCTAAGACCATGCTACCTCATTC | 15560 GGGGTGTCCACCTCGCTTATG | 26544 GCTAAGTTCATCACAAGTCTTGGCTCTA | 37528 |
| 3903 TGGGAACCAGCACATGGATTG | 15561 CTGGCAGCAAGAATCCACCTT | 26545 CGATTATGGCTCTACCGGAGATAATTG | 37529 |
| 3904 TTCTGTCGCTGTCGTCCTT | 15562 CCATCCCACTTGACCCCAATCA | 26546 CTTGCCTGACATTTAGCCTTCTGT | 37530 |
| 3905 CCACGGGTGAGTCATCCTCATATC | 15563 ACGTGCCAAGCACCCAACAA | 26547 GCGTGTGAGCTATTTAAGAGCAGAT | 37531 |
| 3906 CCAGCCATTGTGTTGAATCCTTT | 15564 CAGAACCGGAGGCAACAGT | 26548 CCTTAGCTTCCAGCCATTGTGT | 37532 |
| 3907 GGGTGGTACTGTGCGTCCAA | 15565 AGGCACAACTACCTACTCACAAAG | 26549 GGACAAGTCAAATAATCAAGGGGTGGTACT | 37533 |
| 3908 GGGGCTCATTTAAATACTCCCTCTGT | 15566 CCAGAGCAAACTCAGGTGACAAC | 26550 CCCTCTGGCTAGGGGCTCATTTA | 37534 |
| 3909 TGCTATTTGGGTGTCAGTCCTTT | 15567 GGGATTACAGGCTACTTTTCTAGTCTT | 26551 CTCCAGCGACCCTTGCTATTTG | 37535 |
| 3910 CAGAGCCCAAGGGCATTGAACA | 15568 GTAACCACTCCCTGGCTACTGT | 26552 GCACTGCCACCTGCTGATT | 37536 |
| 3911 TCTCTACCCTGACAGTGCAACA | 15569 CTCTGAGCTCTTGCGTTTCTGA | 26553 GGGAAAATGTTTTGACCAAGGAGTTCTCT | 37537 |
| 3912 AAGGTTCCATCTGTGGAAGAGTTT | 15570 TGTGCTCTCAGCACTTTTTGTGA | 26554 TCAGGAAGCAACTAAAAGGTTCCAT | 37538 |
| 3913 GGCTGCCAGCAGGTTGTCT | 15571 ACCTCCAGGCTTGTGCTACT | 26555 AGGCGCCGAGAGCAAGCTA | 37539 |
| 3914 TCCTCGGGAGAGTGACCTGTAA | 15572 ACGGTGGAGGCTAAACAAAACAT | 26556 CTGCAGGCCTCCATCTTGTT | 37540 |
| 3915 GGAACTGCAGACAAGAGCTAAAC | 15573 GGTCTGACCACCCTACTGAAGA | 26557 GGCTGATCTTATTGCAGTGGAACT | 37541 |
| 3916 CACATGCATCCTGTCCTAACTGT | 15574 GACAATGTCCCCTGACTGGAATTT | 26558 CCCTCTGTGGAAGAATGTGTGA | 37542 |
| 3917 CAGAGCCTGTTTCCTCATCAATCTCT | 15575 CCTCAGGGAGCCTGTAGTCTCT | 26559 CAGCAGATCCTACAGACCTGTTTC | 37543 |
| 3918 GGGTTCTTCTAATGCTGGAGACA | 15576 GGGGTTAAGCTTTCAGGAGCTAAG | 26560 GTCTTATCGTCTTCACAGGGTTCTT | 37544 |
| 3919 TGTCCTATAGCAGACTCCCAAGT | 15577 GGGCTTCAGCTGGAAGTTGTTG | 26561 CTGACCCTGAGCCTGCTTTTTG | 37545 |
| 3920 GCAGCCCTTGCCGAGAATAGA | 15578 GCCCCAAATTTGCAATGCAGTAG | 26562 TGCCAGCCTTCCACAAACTTC | 37546 |
| 3921 CACTCCGATGCCCTGGTATTCA | 15579 CTCTACGGAAATATGGGCCTGATG | 26563 GTTTGTCCTCCTTTATCACCACACT | 37547 |
| 3922 GTCCTGTCAGGCATTGTGGAAGT | 15580 GGAAGCCAAGCAGTGACAGT | 26564 AGTGGGCCTTGTCCTGTGA | 37548 |
| 3923 ACTGCATGAAGGCTCTGTGATT | 15581 GTGTGATCCAGAGCAAGTCTTCTA | 26565 GGAGCCTGAACCACTGCATGA | 37549 |
| 3924 GCCAGGACTCTAAAGGGAGCTTGT | 15582 CTGCATCCCACGTTGGCTTT | 26566 AAGGGAGGGCCAGGACTCTAAA | 37550 |
| 3925 TCCCACACCTCAGCCTTGGAA | 15583 CCACAGAACCAGAGGGACTTGAAC | 26567 CCCCTTCCTGGGTACCACCTAAT | 37551 |
| 3926 ACTGGCCAGGCTCCCATTC | 15584 CCAAGCAGGGGATTAGAAAAGTCTGA | 26568 GGTCACAGCTTTCCCCATCATA | 37552 |
| 3927 TGCCCTTCTGCCTACTGAAAATC | 15585 AGGCTAGACCTAGGCTTTGGAT | 26569 CCCTTGAAATACCTAATTTCTTGCCCTTCT | 37553 |
| 3928 ACCCCTCCACAACCTCAAGTCA | 15586 GCCCAGGGAAATCCTCTCTGT | 26570 ATGCCCCACCCCTCCACAA | 37554 |
| 3929 CACCTTAGCAGCCCACTTTCT | 15587 CATGTCAAGGGCCTGTCAGT | 26571 CCCTGCTGGGCACTATATCACCTT | 37555 |
| 3930 CAGCAGGCTCCAGTTCAATCT | 15588 CCCACAAGCCAAGCCAACAA | 26572 GGAGGTGCCTTTGCCAAACA | 37556 |
| 3931 GGAAGGGATGCAGAGCACAGATAC | 15589 CGATTTTTGCCTCCTGGAACGAA | 26573 GGACTTTGGGCCGTAAGGAA | 37557 |
| 3932 CACCTACCCAGTGGTAGTAGTGACA | 15590 GAGTTGGGTGTGGGTGATGTA | 26574 GGCTTAAAGAGTGACCAAGCACCTA | 37558 |
| 3933 GCCCCTACTGATAGTGTGCGTAAAG | 15591 GAAAGACCAGCTGTTCCATCCAA | 26575 GGAATGTTGTCTTAAATAAGCCCCTACTGA | 37559 |
| 3934 AATTCTGCCGGATCCGACTTT | 15592 AGAGTGTGGGATAATGGTGGAAGA | 26576 GAATTTCTGCTTACTGGGCCAATATC | 37560 |
| 3935 TTCTCTCTGCATGGGTTGCAT | 15593 CAGGTTCTCACATTGGGACTGACT | 26577 CACTCCACCGTGCTTTTCTCT | 37561 |
| 3936 GTGGGAGTTCTGTCCCAGAGA | 15594 ACAGGAGTGTTCCAGCTAACATC | 26578 AGGGTGGCAGCCTTCTTCT | 37562 |
| 3937 GCCTCGGCCTCCTGTGTTTTT | 15595 GCGCCCAGCCAGATTTCTGAATTA | 26579 CCAGCCGCTTCAGGTGATCT | 37563 |
| 3938 GCCCCTCCTTTCTGGAGTGTTT | 15596 GGAAAACATGCCCACCCGAGAA | 26580 CAATACTTTTAAGAAGCCCCTCCTTTC | 37564 |
| 3939 AGACGGCCTCTGGGGCATT | 15597 GTCCACTCACAGGTGGAGATGAGT | 26581 CTTTTTGGGCTTACCATCACTACAGA | 37565 |
| 3940 GGTGGGCAATTGTGGTGCAT | 15598 TGCCATCCGCTTTGTTTCCTA | 26582 CTTCTTCTCACTGGTGGGCAAT | 37566 |
| 3941 GGAAATCATCCTGCCACCAGTA | 15599 CAGGCAGGTGGAGGAACTCA | 26583 CTGTGGAAATAAAGGTTGGGATGAAAG | 37567 |
| 3942 TCGGTGGCCTTGGGAAAC | 15600 TTCGCCAGCCACGAGGAAAT | 26584 CCTCAGGACTGGAGTTTACACGAAGT | 37568 |
| 3943 CCCCAGGCAATTCAATTCATTCATCA | 15601 GCCCCAGCTTGGACAGATG | 26585 CGAGGACCCCAGGCAATTCAA | 37569 |
| 3944 AGCTTGGCTGGGTGGGTTTT | 15602 GAAGGAGGCCCTAGGGAGGATTT | 26586 CCGATAGGAGGGAGGGAGCTT | 37570 |
| 3945 AGCTCCAGGTCTCAGTGCAT | 15603 TCACTCAGACTGGGTGCAA | 26587 GAGGCAGGACGATTTCTTGACCTA | 37571 |
| 3946 AGGTGGCCTGGGAACCTCTT | 15604 GGTCCGCTGACCTCTCAATCTT | 26588 AGGCCGGAGCCAGATCCTATTG | 37572 |
| 3947 CCAGTTTCGCCCTGCTGAAGA | 15605 AGGAACTGGAAGCCGCTCTCT | 26589 ACCCACCCAGGCCAGTTTC | 37573 |
| 3948 GAGTTTTCGAGTTCCAAGTTCCAAT | 15606 GCACAGTGAGCCACTCTTCT | 26590 GCAAGGCTAGAGTTTTCGAGTTC | 37574 |
| 3949 CCAGTTCCCGGACATAGACACT | 15607 GGGTGGAGGGGTGTCTAAAATG | 26591 TAAGCCAGGGCCCCCAAA | 37575 |
| 3950 GTGTCCAGGGTAAATGGCAAGA | 15608 GAGTCTACACGGGTGTGAGTAAG | 26592 CAGATGGCAAGTGTCCAGGGTAA | 37576 |
| 3951 CCACTTCCCTGTGGAAGAGCTAGA | 15609 AGGGTTAGTGCGGTAAATCAAGT | 26593 TTGCCTCCTGGTTACCACTTC | 37577 |
| 3952 GCTCGCTTTTCCTTCCGCCATT | 15610 CCGCTGTTGCCTTCGGTGAT | 26594 TCTCGCGGCTCGCTTTTC | 37578 |
| 3953 CAGGTTTTGCCACAGTTAGTGATG | 15611 GTGGGAAGAGGCTGACTTTCAA | 26595 TGGGATATGAAGGGCAGGTTTG | 37579 |
| 3954 TGGGCTCAAGTGCCTCCTAGA | 15612 GCCCAGTGCCTCACACTTGTA | 26596 GGTCTGAAACTCCTGGGCTCAA | 37580 |
| 3955 GAACGGAGGCAGTGAGATCAAG | 15613 AGGCGGGTGTCTGTGGAAGAT | 26597 CCCTGTGAGGGCAGGATGAAC | 37581 |
| 3956 CCCCACCACAGCATGAAGATGA | 15614 TGCCAGCTCAGTATGTGGAAATG | 26598 GAGGAACAAGGCAAGGTGATG | 37582 |
| 3957 GGGGCCACAGGTGCTAATGAAA | 15615 GTGCATCTAATGACCAGGAGAAGTCAA | 26599 CTGGTCACACTAAGGCACCAT | 37583 |
| 3958 GGTCACAAAACACGCGGGAAA | 15616 TCCCCGCAAATTCTTTCCTCTT | 26600 GGGAGGGGATTTAAGGTCACAAAAC | 37584 |
| 3959 GCTGAGGTGACCTTCTCCAGATTTTC | 15617 ACTGGGGCTCCAGAATGTCA | 26601 GGTGTGACTGTGTGTTTACAGGTT | 37585 |
| 3960 GGACCCAGAAACTTGCACTTAAAC | 15618 GGCTGTGCATCTGCATCTCT | 26602 CTCTGGATTAGGACCCAGAAACTTG | 37586 |
| 3961 GCTGTAGAAGGGAAGTTAGCACAA | 15619 AGCCCCTTACGAAGGGCTTAG | 26603 GAGACAGAATCCAGAGCTGTAGAAG | 37587 |
| 3962 CTGCTGTAAGCCTCTGGGACTA | 15620 TCGGGGTTACTGGCAGAGCAA | 26604 TCACCGCCATGCCCAAGAAT | 37588 |

FIG. 36G1

| | | | |
|---|---|---|---|
| 3963 CCGTGGAATGTGGCGATCTGA | 15621 ACCCGAACAAGCTGGCATCA | 26605 ATGTTTAGAACCCCGTGGAATGT | 37589 |
| 3964 CTACAGGTGCTATTGAGCTGGAA | 15622 GGGAGCTCTATCCTAGGGAGTTATAG | 26606 CCAGCTACCTCCTACAGGTGCTATT | 37590 |
| 3965 GGGACATACCACTGAGTGCAAA | 15623 CCGCGAGAAAGAGAAGAGTCA | 26607 GCCCACTGAAGAAATTGGGACATAC | 37591 |
| 3966 GGGGTCATATCTCTGGACCTATCAT | 15624 GGGTTCAGTCGGGAAAGTCACA | 26608 GGATCATCCAAAGGGGTCATATCTCT | 37592 |
| 3967 TGCTCCAGGGTTTTTAGCATTTG | 15625 CTGGGCTTTGACCAGTGAGGAT | 26609 GACCCCATATGCTCCAGGGTTT | 37593 |
| 3968 GCTGTGGGCAGAACTTTGATCTCT | 15626 CACACCTTTTCCCAGGAGCTCTA | 26610 TGACTGCTGTGGGCAGAACT | 37594 |
| 3969 TGTCAGATCGTGGGCCCTAAA | 15627 GGTCCAGAGTGTGTCTAAAATGTCA | 26611 GCGCTAAACCACAGCAGTATAAAA | 37595 |
| 3970 CCACCTATCAATTCCCAGTTGGTT | 15628 CGTGGGAAATGGCAGCCTTCA | 26612 GGGCTTCTTTTCCACCTATCAATTC | 37596 |
| 3971 CTTGCTACAATCAGACCACCCTTA | 15629 TCCATGCTTAGCACGCCTTAAA | 26613 GCACTAAGGGTTCTTGCTACAATCAGA | 37597 |
| 3972 TGCTCTGTCATCAGGCTGAATC | 15630 GAGCCCAAAAGTCTGGCACTAC | 26614 GCAGGGTGTTGCTCTGTCATCA | 37598 |
| 3973 TGTCCAACTGCCTGCACACT | 15631 GGCCGGCCACAGTGAGAAA | 26615 GCCAGTCCTGCTGTCCAA | 37599 |
| 3974 CCAGCTTCCTCTAGTGACAGATTT | 15632 TGGGGCATTGGGATCCTTTG | 26616 TGTGAGACCAGCTTCCTCTAGT | 37600 |
| 3975 CCACGTACGCCCTCTAGTGAA | 15633 AGGTCGCTGAAGAATGGTAGATTT | 26617 CAATGCCCTTCTCACCACGTA | 37601 |
| 3976 GCCCTACCCATTTTGTGCAAGGAA | 15634 ACTACTGTCACCCGAGTCTTTCT | 26618 GCCCACAGCCCTACCCATTTT | 37602 |
| 3977 CCCCGCGTCTGTGCTCTTCA | 15635 AAACGCAGGCTGGCTCTGGAT | 26619 TTCACTTCCTAGCAGGTCTCTCT | 37603 |
| 3978 CCATGAGCTAGAGGGTCCTACA | 15636 GAAGTGCAATGGGCAGAAAGAGA | 26620 CCAAAGCCCTTTCCATGAGCTAGA | 37604 |
| 3979 GCCAGGACTGTAGAACCAGGAT | 15637 CCTTGGCCCAGTTATGTTCTTGA | 26621 GGTATCTGAATCAGCCAGGACTGTAG | 37605 |
| 3980 TGCCTCAGACTGGGGATGT | 15638 CCCCAAGTGCTGATGGTGTT | 26622 AAAGATGCAAGAGTCCTTGGTTTG | 37606 |
| 3981 GCTCTCACACATTTACCCAACAGAT | 15639 ATGCCTAGCACAGGGTAGACT | 26623 CCCACATGCTCTCACACATTTAC | 37607 |
| 3982 GCCTGTCTTCTGGAGGTGTGA | 15640 CCCCAGTAAGCTGTGACTGAAC | 26624 AGCAGCACTGAGGCCTGTCTT | 37608 |
| 3983 AAGGCACGTGGTGGCAGAA | 15641 GAGGGACCCTAGATCCAGAGGAA | 26625 AGGCAAAGTCAACATGCAGAGA | 37609 |
| 3984 CTGCAGGCTGTTTGGTCTGA | 15642 TGGCCCACAGCTCCACAT | 26626 GTGGATATAAGCTCCCAGTGGGTAAG | 37610 |
| 3985 CGTGGGGACTTCATGATGGAAA | 15643 CAAAGGTGCACCAGGCTCTCT | 26627 CAGCTAACTAACGTGGGGACTTC | 37611 |
| 3986 CTGGGTGAAGACGGTGTGTCAA | 15644 GCGCTGGCTACAATCCGTGAA | 26628 ACCTGCTGCTGGGTGAAGA | 37612 |
| 3987 GGGAAAGCAAACCTACACACAAAC | 15645 ACTTCCCTCAGCCCTACCTCTA | 26629 GGGCTCCTAGGGAAAGCAAACCTA | 37613 |
| 3988 AGAGGCTCGCTGGCTGTGA | 15646 GGAAGGGTGTCCTCAGACCACAT | 26630 CTGTTGGTTTTGGAGTCAGGTCAGA | 37614 |
| 3989 GGTGCATTTCTGGAACGAACAAG | 15647 CCTCCTCTCACCTCCTACTCTTTT | 26631 GAGTGCTTACGTGTGGTGCAT | 37615 |
| 3990 GGGAAGCTTCTAGAGGAGCCAAT | 15648 ACATCTGTCCATCCTTTGGAGTTT | 26632 AGGCTCTCAGTGGTGGTGTTAG | 37616 |
| 3991 CCTGCTGGAAATGTGGCTAAGA | 15649 GGGGTGGTCAACCTGAGAACAT | 26633 GGTTTGCCCTGCTGGAAATG | 37617 |
| 3992 AGTGGTGTGAGAGAGATGTGGAA | 15650 ACTAACACTTTATCTCCTCAGCCTAGA | 26634 AGGGCAAGTGGTGTGAGAGA | 37618 |
| 3993 CTCCCATCTCATCCCCATGCAA | 15651 ACCAACCTACAGCACAGAAAG | 26635 TCCCTACCTCTCCTCCCATCTCA | 37619 |
| 3994 AGACCGTAAGCAATATACCAGTCTTG | 15652 GTGCTGGGTGCTGAAGGTAAAG | 26636 CTCCTTTCCCTAGACCGTAAGCAATA | 37620 |
| 3995 CTGGGGAGGGAGTAACAAGAAGA | 15653 CTGGGAAATTGCCCCTCTATTTCT | 26637 GATACCTTTCTGGGGAGGGAGTA | 37621 |
| 3996 GAGGTGATGGGTGACTATCCTATCAGT | 15654 GCTCTGAAATTGTCCCCTGCAA | 26638 TGTCTAAGAGGTGATGGGTGACTA | 37622 |
| 3997 GCCTTGACCACCCATCTAGAGTAA | 15655 AGTAGGGAGCCATGGTAGTGAA | 26639 CTCCTGGGAAACTCTGCCTTGA | 37623 |
| 3998 CATAGTTGTGTCTTCATTAGGCTGAGT | 15656 CAGCCCGAGGACACATTAGTCA | 26640 GTGGAAGCCATTGTGTACGATCA | 37624 |
| 3999 TGGCACCTTTAACCCCTCTGT | 15657 GTCTCCAATGCCTTCCGAAATGTGT | 26641 TGGCGAGTAATTTTGGCACCTT | 37625 |
| 4000 AGGCGTAAACACAGTCAGGAAA | 15658 AAGAAGAGCCACCTCAGTTGTT | 26642 GCCCAGCCGTTCCAGGATTTAT | 37626 |
| 4001 GGCCCAACAGCCCAGAAGAT | 15659 CAGGAGCCTATTCATTTTCCCCAGAA | 26643 AAACCATCCTGGAGGCAGAAC | 37627 |
| 4002 CCCTGTGAGCTGGGCCATTTTT | 15660 TCCTGTTGTGGTTCGATGGTTTAG | 26644 GATCAGGAAAATCCAACCCTGTGA | 37628 |
| 4003 CGGGAGTCTGCACACATGGAACT | 15661 GCTGGCGGGAAGTCACACAA | 26645 CGGGGTATCGGGAGTCTGACA | 37629 |
| 4004 CCTGAGGTGAATGTACTTTGCAGGTT | 15662 CCACAAAAGAAGATACCCCTGCTT | 26646 CCAGTTCTGCCTGAGGTGAATGTACT | 37630 |
| 4005 TGGCCAGAACTGGGCCATA | 15663 GGCTTTCCTCGTGGCTTGA | 26647 GCTGCTCTGAAAACCTCTGCTTGA | 37631 |
| 4006 CTGTCTGCAAGTACCACGTTTTC | 15664 GTCCCAGTTTCACCCTGAAGGATT | 26648 CACATGGAATGTACTGTCTGCAAGT | 37632 |
| 4007 CCAGTTTCCTGCTCCTGACAAG | 15665 CCTGGGAAAGGTGAGATCAGACA | 26649 GTGCTGCCTAGGTACCAGTTTC | 37633 |
| 4008 ATTCTTGGCCACACCAAGCTAT | 15666 GAGCAATTGGCTGGCAATGAGT | 26650 TGGTAGGGCTCCCTTCCTCTAT | 37634 |
| 4009 CTGCGGATGTGTGGTGAATTTTCTTC | 15667 AGCACCACCAAAAGGCAACT | 26651 AGTTCTTTGTCTCTGCGATGTGT | 37635 |
| 4010 CCTGGGTCTGATGCTGCAATG | 15668 AATGCACCCCTCTCCCTGCTT | 26652 GGTAAGTGTCCCTGGGTCTGAT | 37636 |
| 4011 ACGAGAGACCCACGGTTCCTAA | 15669 CATGGGTGCACCTGTTCTCA | 26653 GGCCTATGCGTTAACACGAGAGA | 37637 |
| 4012 GGGGCCAGATAGTGGAGACATTG | 15670 ACCTGGGCCTGCCTGTATGA | 26654 GGGATAACAAGGGGCCAGATAGT | 37638 |
| 4013 CCAGGCCAGAAGCATTATCAGT | 15671 TCAGGCCCACTCCCCGGTTA | 26655 TTCCATACAATCCAGGCCAGAAG | 37639 |
| 4014 ACACACGCCCTCTGACACCAT | 15672 TGCTCTGGGAAGCATGAGTAAC | 26656 GGCTGCACTACCTGAACACA | 37640 |
| 4015 GCTCAGTCTCCAGCAATTAGTCCTT | 15673 GCTGGAGCTGGTAGCAACACT | 26657 CTCTCAAGCTAGTTCTTGCTCAGT | 37641 |
| 4016 CCACCTTCTGGTTGGGAATGTTT | 15674 GCAAGTCTGCTTGCAGAAAGAAA | 26658 GGAGAAGCTTTCCACCTTCTGGTT | 37642 |
| 4017 AGACCACCACCCTTGAGACT | 15675 AAGCAGTGAGTTTGCTTGTGATAC | 26659 GGCTGTCAGCACTTCGGACTTA | 37643 |
| 4018 CCACAGTGCAGTTGTGCCTAAAAC | 15676 GGGCGGCCCTTCGTTCAAA | 26660 TTCGGCCCCACAGTGCAGTT | 37644 |
| 4019 TCCACCCCTGCAGACTAAGCAT | 15677 GGGATAGACTGAGGGTCAGGGAAA | 26661 ATCTCCAAACTGTGAGTCTGGTTT | 37645 |
| 4020 CTTGCCACTCCCTGAACACT | 15678 AGGGAAGAGCCCAGAGACATCA | 26662 GCCTGATGCTCCATCCTCACAT | 37646 |
| 4021 CGCACAATGGGAGGAAACAAAA | 15679 CCTTCGGCCTTGGCTCTAC | 26663 GGTAATAAGACTGACCATCGCACAA | 37647 |
| 4022 GCCCAGGACCAAACTGTGAAGT | 15680 GGGGTGGGACACATGGAAATCA | 26664 ACAGGTCAGCCCAGGACCAAA | 37648 |
| 4023 GACCTACCTAAGCCCTTCTCTTTG | 15681 CCACAGCTATGCCCTTCTTCT | 26665 CTTGGCATCCCAGACCTACCTAA | 37649 |
| 4024 GGAGGAACTGGACAGGCATTAG | 15682 GTCTCCAGTGCTGTGGTGAAG | 26666 TGGTTGTAAGGAAAGTTGGAGGAA | 37650 |
| 4025 TGGTAGGGAGTTGGGTGGTGAAG | 15683 TGTGGCAACGGCGAACTGAT | 26667 TGGGAGGTGGTAGGGAGTTG | 37651 |
| 4026 GCTGCAGTGGAAAGACGTACA | 15684 AGAGAGCGTCACCTGCTTATG | 26668 CGTCATTTGAATTCGGGACTTGTCT | 37652 |
| 4027 CCCTGCTACCTGTGTTCTTCCATTAC | 15685 GCACGTGCACCAGGAACAACA | 26669 CCTGACCCTGCTACCTGTGTT | 37653 |

FIG. 36G2

| | | | |
|---|---|---|---|
| 4028 GGTGGCACCACTTTGACCAATAC | 15686 CCAGGAGTCAGATGGCCGATT | 26670 GGATGTCTTCAATCCTGGCTGATGT | 37654 |
| 4029 TGGGATTTCTCGTTATCCCATTTCT | 15687 CCCACTCGGAAGAACAGGTTAC | 26671 TGGGCCTGGGATTTCTCGTT | 37655 |
| 4030 GCCGCTGCTGACAGCTACA | 15688 GCTAGAGAAGAGCTCCCATTGTTC | 26672 AGGCATCGGTCTGAAGGACTTG | 37656 |
| 4031 AAGGGCCCCTGCCTGAGGAT | 15689 CTTCCTAACAGCTGGGTGAATGA | 26673 GTGGAGACTGTGCTGCCTAACA | 37657 |
| 4032 GGTACAAAAGTGGGCTTCTAAGCTA | 15690 GGTCTACTGCGTGTGTTTAGTTG | 26674 TCTCTGGGGCCAGGTACAAAAG | 37658 |
| 4033 GGCCACTTAAAATGCTCAGGCTAT | 15691 GCTTACCCAGGTAGATGCTCTAGT | 26675 TGCCTTCCAGAGGGGCACTGT | 37659 |
| 4034 CTGCTCTGAGGCTGTAGGGAATCA | 15692 AGGCTGCCATGCAAGTCTTC | 26676 GGTGCCTAATTTTCAGCACAGTCT | 37660 |
| 4035 GTTGTGAAGTTACACCTCTCTGGTT | 15693 CGTGCAACACTGCCTTCCTT | 26677 TGCTGTGACAGAGTGTTGTGAAG | 37661 |
| 4036 CATGTCCTGCCTCCAAGCAA | 15694 CCACTGTACACAAAGAGGACGAT | 26678 AGCAGGAGCTGTGCTCTGA | 37662 |
| 4037 AGCCTGAATGCACCAATGTATGA | 15695 TTTGGTCTTCCCGGAGATAGTTATG | 26679 AGCTACAGTCCCCAGCCTGAAT | 37663 |
| 4038 GGTCTGGCTCACAGTGAATCTT | 15696 ACGTGCAGAAGGCAGCAA | 26680 GGATGGACTAATATAAGGTCTGGCTCACA | 37664 |
| 4039 CACCTTCTCCTTCTGTGGGTACA | 15697 GTACCCCAGCCATTGTGACAT | 26681 GACAGGCACACCTTCTCCTTCT | 37665 |
| 4040 GAGAGGGGTAAGTGGAGCAGTA | 15698 TGTCCCTCCTCTGCACTGCTAT | 26682 CTGGAGAGTTCACAGATTAACAGAAGA | 37666 |
| 4041 GGGACCTAACCATCTCCAGACT | 15699 CTGAAGACAGAGTTCTCAAGACACCTT | 26683 TTCAGTCTCAGGAGCGCTGACTT | 37667 |
| 4042 CAGCTGGGGTCTTTCATTCACA | 15700 CAGAGTGTGTTGGGGAAAGTTTGGTA | 26684 CATTTTGCTACAGCTGGGGTCTT | 37668 |
| 4043 GAGCTGAGACCCTTTAACTTTACTGA | 15701 GCCTGAGCCTCCCTTTCTCA | 26685 TCTTCCAGAGCTGAGACCCTTT | 37669 |
| 4044 CCCCAAGATAACCTCTCCCTCTATC | 15702 TGTGTCCTGGGGACATTGACA | 26686 GCCAGCCTTCTTCCCCAAGATA | 37670 |
| 4045 TGGCAAAGTGAAGGGTGACATC | 15703 GATGAAGGGCCCTGATTTTCCAT | 26687 CCAGCAAAAATTGAGAGCTGGCAAAG | 37671 |
| 4046 GCAGGCAAAACACAGAGGTGAT | 15704 ATTGGGCTGCCCGGTGTTA | 26688 CTCTGGGTGTCAGTAGCTTCTTT | 37672 |
| 4047 AAACTTGCCAAGACATCCTCCTT | 15705 GACCTAGCAACTCTTGAGGAAACA | 26689 CTACACTGCGAGAAGTAGCTTAAACTTG | 37673 |
| 4048 GTCGGGCAAGAGCTTTCACT | 15706 CAGCCGAGCTCACACTTGTCT | 26690 TGTTTGCTATAAAGTCGGGCAAGA | 37674 |
| 4049 TCTGCTTGCGGTCTCTGCTTTC | 15707 GCCATGCAAGGGAACAGTCCAA | 26691 GACTTATGGCTTGAGCCTCTGCTT | 37675 |
| 4050 GCCCCAACTGTCTTTGTTCTTG | 15708 CTTGCAGGATAAGACCACCATGT | 26692 ACCCCTGCCCCAACTGTCT | 37676 |
| 4051 CCATTCCCTCTGAGCCAACTACTA | 15709 GCGAGGTTCCCCTTGATGCTT | 26693 CTACCTCCACCATTCCCTCTGA | 37677 |
| 4052 AGAGTTCCATGCAAAGCCTTCT | 15710 CCTTCCTCCCTGCTGGTTTGTA | 26694 CTTGGTGGAGAGGTACGCTAAG | 37678 |
| 4053 TCACTGTCTCTCCTCCCTTTCA | 15711 GTCTTGAACTCCTTGTTGAGGATCA | 26695 CCAAGGGGTCCTCACTGTCTCT | 37679 |
| 4054 GGCACAGTGAGAAGGTAGCTGTTTG | 15712 TTCCCGGTGGGGCTCTCTTC | 26696 GCTCCATTTCCTGGTTCCCATGT | 37680 |
| 4055 CAGAACATATATCCCTGCTCTCTCTTT | 15713 CCCTGCCCCTCCTCTCATGT | 26697 CAGAGAGTGGGGTAGTATACTCAGA | 37681 |
| 4056 TGAGCAGATGCAGCTGTTTGT | 15714 AAAAAGCTGTGCTCTCTTCTCT | 26698 GGATGAGGCTGACACTGCAT | 37682 |
| 4057 GCAGCCCCGATAGAGATTGACT | 15715 CTGGGAAAAATAAGGCTGGAATCA | 26699 ACTCAAGTGCAGCCCCGATA | 37683 |
| 4058 GGGGCCTTTTTGTGGGGTTAAA | 15716 TGAGGGGCCACCAAGCTAGGAAA | 26700 GTGAATCAAAGCGGAACTTGTCA | 37684 |
| 4059 ACCCCAATCCCTGCTAATACTGA | 15717 TGAAATGCCCTCCTCTTGGTTT | 26701 CGCTTTGTGAAGGACACCCCAATC | 37685 |
| 4060 AAGTTGGGCTCCCTGGGAAAG | 15718 CTTGTATGCCAGTCTACATCTGTTTC | 26702 CAGACCACTCCCCTTACAACTGA | 37686 |
| 4061 GCTTCCTCCCAATATTCCCTTCA | 15719 CCCAGCCTAAAATCCCTGAGCTA | 26703 CTGTATGTCTTACGCTTCCTCCCAAT | 37687 |
| 4062 ACCGGGCAACCAGCCCTAT | 15720 CCCTGAGAACCCTGGAAGCTACT | 26704 TCCGGGGAGGACCACTCACA | 37688 |
| 4063 AAAACCAGCGTAATGAGGACTGA | 15721 CGCCCCTGCCTAAATGGAAATG | 26705 GACTCTCCCCAGGAATGACCTA | 37689 |
| 4064 TGGCAGCATCTCTACCTCAGA | 15722 TGAGGGAGGATCAGTAAACCATGT | 26706 CCAGTGCAGATGGCAGCAT | 37690 |
| 4065 GCCCTGCGATAGGAATGGTTAGGAA | 15723 CGCCCAGCCTGCTTGAATCTT | 26707 CTCCTGTTGCCCTGGATAGGAA | 37691 |
| 4066 CTTGGACTGAAAGGAAGCACACTCT | 15724 GGGACCTGACGCACGACAATAA | 26708 CCCCTTGCCTTGGACTGAAAG | 37692 |
| 4067 TCTCTGCCGGCGATGTCTCTA | 15725 ACCTCCAGGCTCCAGGAATTTG | 26709 GCTGGCGATTGCCGTCTCT | 37693 |
| 4068 CACTGCTCGGGATGTAAAGCTATTG | 15726 GCTGACAGATTTGTCCCTCTGT | 26710 ACCACACTGCTCGGGATGTA | 37694 |
| 4069 CAGTGGCCTAAGGTGGAGGTAA | 15727 GTAACGTTTGCCTGGTCCATCT | 26711 AATGCAGGCAGTGGCCTAAG | 37695 |
| 4070 AGGGCGGCCAGAGATGAAAAG | 15728 TGCCCTCCACCTGGCTTTC | 26712 TGCGCCAGCTATGGACACA | 37696 |
| 4071 ATCTTGGACCACAAACCTCAAGT | 15729 AGAGTGGAATTACCAGGGAGTCT | 26713 GGTGTCATCTTAAATCTTGGACCACAA | 37697 |
| 4072 GTTGTCCTTCTCCGGTTGCATTC | 15730 GCAGGGTCCGGCCCTAATGA | 26714 AAAATCAGGCCTGTTGTCCTTCT | 37698 |
| 4073 GAGCCCAAGGGCACCAAGT | 15731 GCCTTCCTCTACCAGGGTTCTACT | 26715 ACACCCGGTTACGCAGAGA | 37699 |
| 4074 GCAATCGACTGAGGTACTTGGGTAAG | 15732 CTGTGGTCGGATTCGTCGAA | 26716 CACAAGTAAGAGCTGCTGAGCAAT | 37700 |
| 4075 CGAGGAGGTTACTCTGACCACACT | 15733 AGTGGCCAGGGAGGAAGAACTA | 26717 AGGGACCCAGGGAGGTTACTCT | 37701 |
| 4076 CTAAGACCCAGGACGGAGTCAGA | 15734 CGTGACCTCCACCCCTAGT | 26718 GCTGCAGCCAGAGCCTAAGA | 37702 |
| 4077 GAACCTGAAAAACAGGGTGTGGAT | 15735 TGTTGGGTCCAGCCAGTCTCA | 26719 GGCTATGGGTTGATCAGAACCTGAA | 37703 |
| 4078 AAGGGGTGCGTGAGCAAGT | 15736 CCTGCTGTGTGCAGTGGTGAA | 26720 AGCAAGGGGTGTGTGAGCAA | 37704 |
| 4079 ACAGGCTTTCTACAACAGGTTCA | 15737 TGTGAAAATCCCTGTTGCTCTTCA | 26721 CCTTCAGCACAGGCTTTCTACA | 37705 |
| 4080 GGGGAGCAGTGTGGACTTG | 15738 GAGAAGAGAGGTGATAGGGGACAT | 26722 AGGGACAGCACAGATGGATGA | 37706 |
| 4081 GAGGAAGAATCTATCTGTAGGCACAA | 15739 GCGCTTGCCCATAGAAAGTGA | 26723 TGCGGTATGACATGAGGAAGAATC | 37707 |
| 4082 GCCCAAGAACAGGCCACTCTATG | 15740 TGGACGACCTTTTGCCATTTTG | 26724 GAGTGCTTTCAGCCCAAGAACA | 37708 |
| 4083 CAGAGCCACACGTCTTGATTTGA | 15741 AGGCAGCAGAGAGGTCCAAA | 26725 CGGGAGCCTTCCCTAAGAAGGTTTT | 37709 |
| 4084 GGCCACCAAGGCTGTGAAAC | 15742 GGGCTTGAACCTCAGCTCTATCATC | 26726 AGTACGGAGAAGGCACCACAA | 37710 |
| 4085 AATGGTGCCGTCACCTGAGA | 15743 CTGACCAGAGAGATTGGGCCTTCT | 26727 AGCTAGCCCCACTTGCATTG | 37711 |
| 4086 GTTCGGAGGTTTGCCAGCTTTG | 15744 ACTGTTCAGCTAACGGTGTCAAG | 26728 TGATCAGAATGAGTTCGGAGGTTTG | 37712 |
| 4087 CTGGGTTCAGGAGCAACTAAGAAAC | 15745 GAAAGCCTGAGAAGGTGCCAAT | 26729 ACCTAGGAAGGGGTCAGGTTCT | 37713 |
| 4088 TCTGTGTTCCCCTCCGTCTTT | 15746 CGACGGGCAGCTGTCAAGA | 26730 CGCCTTCATGGTGATCTGTGT | 37714 |
| 4089 AGCCACCCTCTCCCAAGACAAA | 15747 TGCCTCCCTTTCTCAGGGTCTT | 26731 ACTTGTTCAGGGTGCAGAGGAGTAG | 37715 |
| 4090 CACAGCTCTCATCACCTACGAA | 15748 GCCTTGAATGTCAGGCGAAATAAC | 26732 AAGCCTTCCACAGCTCTCATC | 37716 |
| 4091 AGGGAGCTGCAGGTTCATGT | 15749 AAGAATGCCCTGCACTGTGT | 26733 AGCAGCTACGAGGCCCTTCA | 37717 |
| 4092 CCTGCGAATAACACGTTTCTGTAG | 15750 GGGAGAGGTATGCCAGGCTCTAA | 26734 CTGTCGCACATTTCCTGCGAAT | 37718 |

FIG. 36G3

| | | | |
|---|---|---|---|
| 4093 TTCCAATCCCAAAGCATCTCTTCT | 15751 TGACTGTTGTCCCTGTCAGTTTG | 26735 GGCGTAGATGCCAAAGCATAC | 37719 |
| 4094 GCCCCGAATTACAGCTTGTTAC | 15752 ACAGGTCCCTTGGGCCCTTATT | 26736 CTGGAGATTGAATTGCCCCGAAT | 37720 |
| 4095 ACCAATCCCGAGGTGCCTAAG | 15753 AGGCAGCCCCTGCTCACTT | 26737 GGCAGTGGAAGCCTTTGATACCAATC | 37721 |
| 4096 CACACTTTATGGAAATGCAGAGACTGA | 15754 CACGGACGTGCATGACACTA | 26738 CCCTGGAACCTTCCAAGTTCACACT | 37722 |
| 4097 AGTGCCTGCTTTGCATCTACATA | 15755 CAGGAGCAGGGGTGTATTGAAAG | 26739 CCCAGCCATTTAGTGCCTGCTT | 37723 |
| 4098 AAGTATCGGCGAAAATCCCTAATCT | 15756 TCACCCACAGCCATCTCACA | 26740 GACCACGAAAGTATCGGCGAAAA | 37724 |
| 4099 AAGCACTGGATTTCACTGAGACA | 15757 AGGGCTGTCTCCTCTCCTGTTT | 26741 TCAAAGAGGCAAAGCACTGGAT | 37725 |
| 4100 GGCAGAGAAGCCACATCCAACT | 15758 CTGCCCCACCATATCTGAGAAG | 26742 GCAAGGCTACCTAGGCAGAGAAG | 37726 |
| 4101 GCCGAGGAAAAGCTGACAGT | 15759 TCTTTACCGCATGGTTCTAACACAA | 26743 ACGCACATGCCGAGGAAA | 37727 |
| 4102 CTTCTCAACCTCAGTACTGTGCTACT | 15760 CAGCCTTCCACGATGGAGAAAC | 26744 CAGTCCAACTTAAAACTAGAGCAGCTT | 37728 |
| 4103 AGGAAGCTAAACTGCAGAGCAT | 15761 GATACCACAAACTTGGAGCAAACA | 26745 CTCTCTAGGACGAGGAAGCTAAACT | 37729 |
| 4104 CAGTGAAACGATGAGGCATTGTGA | 15762 GCTGGAACCACAGAGACGAACA | 26746 GACACACCACAGTGAAACGATGA | 37730 |
| 4105 TGTCATCAACCGGCCATTCAA | 15763 GAGCTACTGGAGTCCAAATCACTT | 26747 GTGTGTGTGGTTATAGGCTGTCATC | 37731 |
| 4106 GGCACTGTAGCTTCCCAAGT | 15764 GCATGGTGCACAGGTGCATATTCT | 26748 GCTCAAGCAATCCTGGCACTGTAG | 37732 |
| 4107 GGTGAAAGTCAGCTAGGAGTAAATG | 15765 GGCCATCTAGGGTGGTGAACAA | 26749 CCGCAAGATGGTGAAAGTCCAGCTA | 37733 |
| 4108 TCTTGGGCCACCTCTGTTACT | 15766 GTAAACATTCACCAGGAGCTTCCATA | 26750 GAGTGAAGAACACTTGACTGACTCTTG | 37734 |
| 4109 GGACACTGGTTCATGGCATTG | 15767 GGGTTATGAAGACTGGCTTCGACAT | 26751 GCTGAATGAAATGAACAGGACACTGGTT | 37735 |
| 4110 TTTCTCTGCTGTCTCCAAGCAA | 15768 TCCAGAAAAATGGAGCCACACA | 26752 CCAGACCCCATGCAGCATTT | 37736 |
| 4111 GTGGATACCCCTTGCCGCTTA | 15769 GACATCAGGGTGCTGTCTTCTCA | 26753 ACATGGTCCTTGGGGTGGATAC | 37737 |
| 4112 CTAGAAATCACGCGGCATACACA | 15770 AGTGTGCGTCAGGACTGAGA | 26754 GACACTGGAAGTTCCTAGAAATCA | 37738 |
| 4113 GCCATGTACCGAGAACCATCTTTG | 15771 TTCGGGACCGTTTCCCCAACA | 26755 CACTAGTTGCCATGTACCGAGAA | 37739 |
| 4114 GCGACCCAAAGGAGTTTGTCT | 15772 GATGACACCTTCTATGTCCTCAAGT | 26756 GCCTTTGTAAAAGCGACCCAAA | 37740 |
| 4115 ACAAGCCCCGAGGGATATGA | 15773 TGACCTGGACACACAGGATATATGA | 26757 AGACAAACCTCTTGGTCTCAAAACA | 37741 |
| 4116 ATGCGGGGAGTGAGGAAGTT | 15774 TGAAAGCCCACCTTCATTGTCA | 26758 GGACAGGAGCAGCTATCTAGAATCA | 37742 |
| 4117 CAAGCCCCAGCTTTGGGAAGA | 15775 GGCCCAGCACTACGTCAACT | 26759 GCAAGGGCAGAACCTAGAGCAA | 37743 |
| 4118 GGCTGTGGGGATATGGGGAAAC | 15776 GACCCAAGGGGAGTTTGCATTC | 26760 AGTGGAAGGCTGTGGGGATA | 37744 |
| 4119 GAATGGGGTTGCCTGGTCATCT | 15777 CCACCAGGTCTCCCTTTTGTGA | 26761 GAGAGGCATTCCTTGCTTCTGA | 37745 |
| 4120 GACGTGGTAAGTCCCAGGAAGT | 15778 CACCTCTCCCCTCCCAGAACAT | 26762 ACGGCCAAGACGTGGTAAGT | 37746 |
| 4121 GAGAAAGTCTGGCGTCTTCACA | 15779 CACCCTTCAACACCCAGTACGAGTAA | 26763 GCGTGGACGAGTGAGAAAGTCT | 37747 |
| 4122 CATCTCTGCGGCTGCATCTTTG | 15780 GGTGTCCCCTGAACAATGTCTGTTTC | 26764 GGGAGTAAGAGATACAGGACACCATCT | 37748 |
| 4123 CCTTCTATCCTAGCAAGTGCCAAT | 15781 AGCACCCCTGGAGCTTGT | 26765 CCTGTTCACATCCCATCCCTTCT | 37749 |
| 4124 GGGGTTCACAGCTTTTAGACGCATCA | 15782 ATGCAGAGGCGGAGGCAGATA | 26766 CTGGAATTTTCAGGGTTCACAGCTT | 37750 |
| 4125 GGGGAGTTGGGAGGATCTGA | 15783 CCTAGAAACCCTGAGCAGCAACA | 26767 GTTTTTCCCTTTTGTGGGGAGTTG | 37751 |
| 4126 GCCCAATCAGACAATGATCCAGAGCTA | 15784 TTCCTGGAGTGAGCCAGTCTGT | 26768 CACAGATCACTGCCCAATCAGACA | 37752 |
| 4127 TCCCCGCAGAACGTCTATTTAAC | 15785 GACAAGCATCTCGAAGGGCATA | 26769 TCGAATTCCTCTCCCCGCAGAA | 37753 |
| 4128 TGTGCCCAGGCTTATTGATTTCT | 15786 CAATTTCCAGGAGGCCATGATACT | 26770 CTGTTGTTGTGCCCAGGCTTT | 37754 |
| 4129 CACCTTTTCCAAGAAGTGTTGCTT | 15787 GGGTGAAGTGGGTGCATCTAA | 26771 GTCCTCTAGGGGCCCTTCAAAT | 37755 |
| 4130 TGCACGTGGAGGTCTACAGAGA | 15788 GCACCTCGTGCCTCGGTTTATT | 26772 CCTTGGCACTCCCCACTGTT | 37756 |
| 4131 AGCAGCCACCTGCGTACAAA | 15789 GCCCTGCCAGGAACATTTATTGTCT | 26773 CCAGATATAACACGGAAACAGCCAAAG | 37757 |
| 4132 ACGCAGGCGGCTGGATGTT | 15790 GTCTCCAGTACCTGTGGGTCCAT | 26774 AACCGAGGCGGCTGGAACA | 37758 |
| 4133 GAGCACTGTGTGCCACCTAT | 15791 AGTGGGGATCGTACAGCTCTT | 26775 CTGTGTGCAGAGCACTGTGT | 37759 |
| 4134 CTGTTAGGCGGTGCTTGGAT | 15792 TGGCCACCCAGGAGTGATAC | 26776 GGATGTTGCAGCCTTCCTGTTAG | 37760 |
| 4135 CCCGCTCCCCAGATTCAACAGTTC | 15793 AGACGTGGGTAGGTAAGTATGGAA | 26777 TGCACACCGCTCCCCAGATT | 37761 |
| 4136 CGTGCAGCGTTTTGGATCTGT | 15794 CAGCTGAAGGACCTTGGTGAGAT | 26778 TCGTCTCGTGCAGCGTTT | 37762 |
| 4137 GTAAAGATTGGGGACTTGGGGATTA | 15795 TCTCAGGCTTGGTAGCCTATGT | 26779 CAGCTTTGGGTGAGGGTAAAG | 37763 |
| 4138 TCCACCGCCCTCCTCACTT | 15796 GCCGAGGAAGGAGACAGTGACA | 26780 CCCTGGAGAGGGGTCTTTTCT | 37764 |
| 4139 CAGTCATCAAGCCTAACTGAGCAT | 15797 CCCCAGCAGCATTTCAGCAA | 26781 CCAAGGCTTTTGTTCGTTTTCAGTCATC | 37765 |
| 4140 CGCAGTGCCCAATCCACCTT | 15798 CCACTCCCACCACTGCACAAT | 26782 TGTCGGGAATGAGCCAGTCA | 37766 |
| 4141 CCCTGTGACTTTGGGTAGCTTTTG | 15799 GGCAATACACACACGGCTCAA | 26783 CACTTGTCAGTTTACCCTGTGACTT | 37767 |
| 4142 GGTGCATTCACAGGTGAGTCATT | 15800 CCTAGGGTGAGCCAGTTCCTAGA | 26784 GGTTGGCCTATGGAAGGTGCAT | 37768 |
| 4143 CCCTCCACACCTGGTTGTCATA | 15801 CCTCACAGCTGAGCCATGAAA | 26785 CCATTGCCTGCTTGTCAAAATGAAC | 37769 |
| 4144 AAGTAGGGAGGTGTGAGAGACAT | 15802 ACAGTACTGGGCCAGATGAA | 26786 AAGAAGGAATGGATGTGCCAAGT | 37770 |
| 4145 TCCCCACTCCTTTGACCTGAGA | 15803 CACTAAGTCTGGGCATGGACTTAC | 26787 CCACCCTCCCCACTCCTTT | 37771 |
| 4146 GCTGCCGGCTACGAAAGA | 15804 AGTGGAAGAGCCTTGAGAAGTTTT | 26788 AGCTGGAGGAGGGCAGAGA | 37772 |
| 4147 GCAGAGGTATTTCAGACCCGCTAT | 15805 ACCCAGCCTGCAGGAGAAAG | 26789 GGAGAGGGTAAACAACAAGCAGAGGTA | 37773 |
| 4148 GATTTGCCCGGCCCTCTACT | 15806 AGCCCAGCCGAGACATTT | 26790 GCGTGTGCTGAGAAACTGGATTTG | 37774 |
| 4149 TGCACTTCCTTACTCTCCTTGAAC | 15807 CTGGACCAGCCAGTCCAATGGTTA | 26791 GGCAGGATTGCACTTCCTTACT | 37775 |
| 4150 CATTGGTGGGTATGGGTGTTCT | 15808 CGTTGCTCAGTTCCTGGAAAGTT | 26792 GGAGGAGAAGCCATTGGTGGGTAT | 37776 |
| 4151 GGAACTCAAAGCATAGCCTCCTCATTT | 15809 GCTTCCGGATGTCTACACCAA | 26793 AGTAAAGTGGAGGAACTCAAAGCAT | 37777 |
| 4152 TGGGCTTCAGAGACAAGCCTAT | 15810 TCTTCCTAAGCCTGGTAGGAGTT | 26794 TGGAGCTGGGCTTCAGAGA | 37778 |
| 4153 CCTGGAGCAAACCCGTTTGTGA | 15811 TTCCCAACCCTCGGGACACT | 26795 AGTGCGGCCTGGAGCAAA | 37779 |
| 4154 GCAAGCACTACCACTTCCCAAAAG | 15812 CCAATCAGGCCAGTGTCAGT | 26796 CCCATCTGACTCGAAGCACTAC | 37780 |
| 4155 GGAATAATGCCCGTGGACCTTAAGAA | 15813 GAGAGGAACCGGTGGGACTA | 26797 ACCGCCACGCAAAAGCCTAA | 37781 |
| 4156 CACTGCAGCCTCAACCTCTTCA | 15814 GGAGGCTGAGGTGGAAGGATCT | 26798 GTTGGAGTAGAGTGGTACAAGCAT | 37782 |
| 4157 GCAAAGCTCCTACTGCTCACT | 15815 CAGCCACCAGGAGGGTGAA | 26799 CGATGTCCAGCAAAGCTCCTA | 37783 |

| | | | |
|---|---|---|---|
| 4158 TCCAATCCAAGGTTGGCTGAAT | 15816 GGCCCTCCGTATCCAAGGTT | 26800 CCCCTCCTCCAGTATTTCCAATCCAA | 37784 |
| 4159 CCTCTGTTGGTGAGGTGCTAAG | 15817 TTGTATAACACGCTGCAGGAAAAG | 26801 AGTCCTGTGTTAGCCTCTGTTG | 37785 |
| 4160 GCTGACAGTGGCTCCTGAGA | 15818 CTAGTGGCTTGCTCAATTCCTATTTG | 26802 GGAACTGGATGTGGCTGACAGT | 37786 |
| 4161 TGGCCTTCCATGCTCAAAGAAC | 15819 GCTGGCTTCTCCAGTAACAATGA | 26803 GACATGAGCTTGGCCTTCCAT | 37787 |
| 4162 ACACGTGCATGCGACACTCA | 15820 TCCTCACAAGAAATGGACAATGGAT | 26804 TGAGAGTCGTACAGCAGCAAAT | 37788 |
| 4163 CAGTTTCAGTCCTCTGCTGGACTT | 15821 CCTGGCCGTGCCTGATATTTCT | 26805 CCTGGGCCCAAAGACAGTTT | 37789 |
| 4164 TGGTCATATCGCTTCTCCTCTTTG | 15822 AGGAGAGACACAGAGGGCATTT | 26806 CACATCAGTGCAATCCCTGCTTTC | 37790 |
| 4165 ACAGGCACCGAGAGGATGAA | 15823 GTTTCTCTGGCCATTTAGGACTCA | 26807 TGCCCTCGAAATCCTGTGAGA | 37791 |
| 4166 CACCAAGCCGATGAAATTGATCTTG | 15824 GACCTTTCTTCCTTTCTCTCACCAA | 26808 GGCAAGTTTCACCAAGCCGATGA | 37792 |
| 4167 GACCTGCAAGATGCCCAGTAAG | 15825 TAGGGTCCTGTCCCCTCTCT | 26809 TCTGTCCAGGAGACCTGCAA | 37793 |
| 4168 CCCAGCACCCTTGCCTGATTTA | 15826 CCCAAAGCAGCTAATGAGCATTGCATA | 26810 GAGAATCAGTGGGAGCTGCAT | 37794 |
| 4169 GCCTCCTTCTCTGTTGACTATTCTGT | 15827 TGTGTGTTACCAATGCCAAACAATC | 26811 GGGGTCACCATTTTGCCTCCTTCT | 37795 |
| 4170 GCTTGGGCAGGCATTTCTCTT | 15828 TCTCAAGAAAACCTGTGGCAAGT | 26812 AGGTAATCACTTGGCAGTAATGCTT | 37796 |
| 4171 AGACCGTCAGCAGGATCACA | 15829 GGCTGGGAGGGCCTTCAAATATC | 26813 TAGCAGTCTGGGCAGCCATA | 37797 |
| 4172 CCTCGTTGAGTAGTTTGGCATTG | 15830 GAAACCTTGTTTCCTGCAGATGATG | 26814 TCTGGTGACCTCGTTGAGTAGT | 37798 |
| 4173 GAGAGCTGCAAGTCATCCTCATTC | 15831 CTGCTGACCTGACTGTGAGTGAA | 26815 GCCATGTGTATTTAGTGCTGGTCTT | 37799 |
| 4174 AGGGAAATCCAGCCTTCTCCTT | 15832 CAGGTCCACCAACAAATCATCATC | 26816 ACCACCCAGGCAAGGGAAAT | 37800 |
| 4175 TGGCTTATGCTCTGAGGGTCTA | 15833 GCAGACATGTGGGTGACAGA | 26817 TGTGGTCCCACTCTGGCTTATG | 37801 |
| 4176 GGGGTGCCGTAGTGATCAGTAGAT | 15834 GCTGCGGGCAGCATTTTAAG | 26818 CCAAGGGGTGCCGTAGTGA | 37802 |
| 4177 AGAGCCTGGCACTGGGTATT | 15835 CACCCTGGACCTCAATCCAT | 26819 TCTGCGGGCAGCTGTTAGA | 37803 |
| 4178 GTGAGCTTGGCTCAAATCCATGA | 15836 AGCCTTGCAGGCCCTACT | 26820 TGGGCAGACAGGTGAGCTT | 37804 |
| 4179 CAGTTTCCTCTGGCACCTTTGTTC | 15837 ACAAGTGATTCTCATGGCCACTT | 26821 GACAGCCATTCATCCCCAGTTTC | 37805 |
| 4180 GACGTAAAGCTGGGAAACCTTCT | 15838 CCCTCAACCATGTGCAGAAAACTTG | 26822 ACCAAATGCCCAGCTATATGTGT | 37806 |
| 4181 CACATCACCGGACGCCTTT | 15839 GGGGAAGCAGCTTTCACTCTCT | 26823 GCTCAGAGGTCACGGTCACA | 37807 |
| 4182 CCTTGACAGCAAATTCAGGACAACT | 15840 CGCCAGGCAGGCTGTTAGAAA | 26824 TGCTGTGTCCTTGACAGCAA | 37808 |
| 4183 GGTTTGGCACAGGATGAAGCAAGA | 15841 CCTATTGTTCTTGGCCCCTTTAGT | 26825 CTATCAGTAGGTTTGGCACAGGAT | 37809 |
| 4184 CCACAGGCCCTCATAAGCCTCTA | 15842 ACTGCATTGTGCGTGACCAT | 26826 TCCTTGCCACAGGCCCTCAT | 37810 |
| 4185 CCAGGGCAAAACAGAGGTCCAT | 15843 TCCTGAGCGTGGTGGAGATG | 26827 GCTGTAGGAGCCAGGGCAAAA | 37811 |
| 4186 GGGCGTCTACGATCACTGAAA | 15844 CACGTGAAATGAATTGCCTTCTGT | 26828 GCTTCAACAATGAGGGCCGTCTAC | 37812 |
| 4187 TGCTGCCCACCTGGCATTT | 15845 GGAGCAGCAGCCATACTCCAA | 26829 AGGTGAGAGGAGCAGGTGTT | 37813 |
| 4188 TGCGCACATGACTCCTCTAGT | 15846 CTCATGACTGGTTGTTTCTCCTTGAA | 26830 GATTAACAACACTCTTGCGCACAT | 37814 |
| 4189 GCAGATGGAATCAGCATCTCTCGAT | 15847 TCCTCCTGCTCCTGGGTCAT | 26831 GAAGGAGCTGCAGATGGAATCA | 37815 |
| 4190 GCTGGGCTATGTGCCTTCAGAT | 15848 TGTGGTCTCTGAGCCCTGCTGTT | 26832 AGGAGTCATGCTGGGCTATGT | 37816 |
| 4191 TGTGCTTGGCTTAGGCTAGAGT | 15849 CATGTGGCTCTAGAGGGAGGAA | 26833 GGCTGTGGCTTGGGAGGAGTATAA | 37817 |
| 4192 AGGCAGGGACTGGAGGTAGAAAG | 15850 GGAGGCTGCCAGAAGTCAGAAC | 26834 GCTGCTGCCTTGGACAGAAA | 37818 |
| 4193 GGACTCTGTCTCAGTGGAGGTT | 15851 GAGTTGTCTCTGCCTTTTTGGGGATA | 26835 GTGAAGTAACAAGGACTCTGTCTCA | 37819 |
| 4194 TGGTGCGGTCACCCGTGTT | 15852 ACTTCCCCTGTAGGCACTGTCA | 26836 GCCAATGAGGCAATATGGCCAATGA | 37820 |
| 4195 GGCCCTATCCCTTGAGGAGGTGTT | 15853 TAGCGCGCGCGACAAACTA | 26837 GCAGGGCTGATGGCCTAT | 37821 |
| 4196 ATGCCCTTGAGGGAGGTGTTG | 15854 GTCCACAACGCATTACTGCTCAT | 26838 TCTATCCAGTATCTACATGCCCTTGA | 37822 |
| 4197 CCTCAGAACGATGAGGGAATGAAC | 15855 GACCTCCAGGGTGCATGTCAAA | 26839 GTACTTTCTGCCTCAGAACGATGA | 37823 |
| 4198 GGCCACAAGAATCCCAATCTCA | 15856 TGCTGCCAGCCACTTTGTGT | 26840 GGCGGAGATAGAGCTATGAACTGA | 37824 |
| 4199 AAGTTCGAGGCTCACTACTTTTCT | 15857 CTGCCTCCACTGTGTCTTCTGT | 26841 GGTGGGTAGGTTCTAAGCACACCTAAG | 37825 |
| 4200 GGGGATCTGGGGAGTATCTGGTAT | 15858 TCTCATGGTTGGGTAATGCAAAGA | 26842 CCAAAGCCATGATCTGGGGATCT | 37826 |
| 4201 GGGTAAGGCAGAGATGTGAACTGT | 15859 GTGTTGGGGCAGACCTTCAGTA | 26843 GAGGTCAGGGTAAGGCAGAGAT | 37827 |
| 4202 CCGCTTCCTTGCCTGGGAAT | 15860 CTCCACCTGCCACACTCTCT | 26844 GCCTTGGGCACGTCACTTC | 37828 |
| 4203 CCCATTGAGGAGGGCTTTTGA | 15861 GGCTCAGGGCCCAAGGATCT | 26845 GGTTCTCTTCCCAACTATCCCATTG | 37829 |
| 4204 GACAGGACAGCAGTGTCAATGGTT | 15862 GCCTTTATTCCCTGCCCCAATC | 26846 GACGTGCAAAATCACTGAGAGACA | 37830 |
| 4205 GCTCTTTTGGTACCCGGAACTCTAC | 15863 CTCTGATTCTGCCCCTGGAACA | 26847 GCAGGAAAGCAGCTCTTTTGGTA | 37831 |
| 4206 CTCACAGCCTGACAGCTGAA | 15864 GCCTGCACTCTCCCACAACTATG | 26848 ACACAGGCCTGATATTTCTCACA | 37832 |
| 4207 GAGCAGGTCAGTCTCCAGATCCTT | 15865 CTCCCACCAGCATCCAAACACA | 26849 ACAGGTGGAGCAGGTCAGTCT | 37833 |
| 4208 GGCTTGTCCTGAATGCCAGGTA | 15866 CAGCAAGCAGGCTCAGGTACT | 26850 GTTGGGTTGGCTTGTCCTGAA | 37834 |
| 4209 CCACCCTGAGCTCTTCCTGTT | 15867 GCATCAGCATCACTAACGAGGTCTTC | 26851 GGCTCTTAGAAGTGGCCTGTGTT | 37835 |
| 4210 GGGCTTTCTCAGACTTCAGAGTT | 15868 GGTGTACAAGAACGTCTCAGTTGT | 26852 AGACCCGGCCTGGGCTTTCT | 37836 |
| 4211 GACCCATGAAGGGAGGACACTTTG | 15869 GTCACAGGGGCACAGCTT | 26853 GGCAATTACAACAGTCAGTCTTCACA | 37837 |
| 4212 TGAGCACAGCTTCAGACCAAT | 15870 CCAACGCTCAGCCTTCGTCTT | 26854 GCACTGGAGTTTGAGCACAGCTT | 37838 |
| 4213 GGAAGCATGGTGAACTGCACATT | 15871 CCGTGTCTTGGCAGAAGCTCTA | 26855 GCTGGAGGAAGGAAGCATGGTGAA | 37839 |
| 4214 CTGGAGGTCTCTCCACTGCTTT | 15872 GGCACGAGCCTCGGAAGAT | 26856 CCTATAAGCTTGCTGGAGGTCTC | 37840 |
| 4215 TTGGGTAATGCTCGCTATGTCTAAT | 15873 GATGGCGCTGAATGGAGTCT | 26857 CCTCCACCCTTGTATCGTGAGT | 37841 |
| 4216 CTCCTGTGAATCTCATCCCTTTCA | 15874 GCAAGCTCGGGGTGGTTT | 26858 CTCTGCATACACCCTCCTGTGA | 37842 |
| 4217 CCCGGGAATACAGCCAGCAT | 15875 GGAATATACAGACCCTTCCTTCAACT | 26859 AACTTACGGGCCCAGGGAATAC | 37843 |
| 4218 CATATGCCCTTATGCCTGGATTCT | 15876 TCCCTGGCCTCCAGTGATTTG | 26860 GCAGGATGGTGTTAATTCAGGGAGAT | 37844 |
| 4219 GCTGAAGCCAAGGGAAGAGGAGAA | 15877 CCCAGAGGTGCCTGTGACAT | 26861 AGGTTTCTAGGTGGGGCTGAAG | 37845 |
| 4220 AGCCAGTAGCTGCCCTGAGAA | 15878 TCCCGCTGCGTGTTAGTTTC | 26862 ACCTCTCCTCCACAGCCAGTA | 37846 |
| 4221 CCAGAACCTGGCCATCTCTTCCAT | 15879 GCAGGAAGCCACACAGAAGTT | 26863 GGAGTAGAGCAGGAGTTGGGAATAG | 37847 |
| 4222 CCCGATAAGCGTCTGATGGAAAC | 15880 TCCGTTGTGTGCCAATGCTA | 26864 TCCCAGAGCTGACCCGATAA | 37848 |

| | | | |
|---|---|---|---|
| 4223 CCTTGAGGCAAACACACTGCTACT | 15881 TGGCAGTTTCTGAGTGGGATTTG | 26865 GGCAGCCAACGATTGGTACT | 37849 |
| 4224 TCCAGGCTTCATGGCACTCCTA | 15882 CACAGCTCCAGGGGCATCATA | 26866 TCCTCACCTCCAGGCTTCAT | 37850 |
| 4225 CAGAGCCCCGTTACTCTTTCTTGTAG | 15883 AGTGTACAGGAGTGGCTTCAGT | 26867 GAAGAATCTCAGAGCCCCGTTAC | 37851 |
| 4226 GGGGAAGGGAGATTGGTAGAGA | 15884 GCCTCTTCGGGTCCCTGTTCT | 26868 GGCTTAATTGGAGGGGAAGGGAGAT | 37852 |
| 4227 CCGAGCCTTTGTTTCACTCTGTTC | 15885 CTGAACAAGGCGCTGAAGGAAGA | 26869 CAATCAGTCCCACGGTCCATTC | 37853 |
| 4228 GGGTTTGTCTTACCTTCAGCTTCT | 15886 AGTGCAGAGAATACCCGAGACA | 26870 GCCTGTATTTGAAAGGGTTTGTCTTAC | 37854 |
| 4229 TCAGCCAGCAATGTTAAAAGACAAG | 15887 GGGGCTGACTTATTTGGTGGGTT | 26871 TGAGGCTGGCTTCCAAATTTCA | 37855 |
| 4230 GGTATCGTTCTAAGCAGGGAAAAGA | 15888 GCCCAGGTGAAGCAGAACTTTG | 26872 AAGTGAAGGCATAAGGTATCGTTCT | 37856 |
| 4231 GCAGGCCTAACTTGGAGAACT | 15889 GGACTCACAGAATGTGACCAGATAG | 26873 CGGAAGTCCAGCAGGCCTAA | 37857 |
| 4232 AGGACAGCAGGTCAGGAACCTT | 15890 GGGAAGCCCCACTTTAGGAGTT | 26874 GGGAAGCTTGGGCTTTGCTA | 37858 |
| 4233 CCAGGTGATCTGCCAACCTATTCT | 15891 CCTTTTCCTCCCCAGGACTTC | 26875 GCCAAATGCAAAAGCCAGGTGAT | 37859 |
| 4234 GACTTCTGTTACATGCCCCTCACTT | 15892 AGGCCCATGTGGCTGATGTTAG | 26876 CGGCCTCATCCAGACTTCTGTTAC | 37860 |
| 4235 GGCAGGAAACCTGTAGATGGGAGTA | 15893 GTCCCCTGTCCATAGGAGAGACT | 26877 CACACTGAGCTATAAGGCAGGAAAC | 37861 |
| 4236 GCTGGGGAAGAGTCTGTAGACTTAG | 15894 TGTGATCTACCAGCAGCCATTATT | 26878 TGCCAGCTGGGGAAGAGT | 37862 |
| 4237 GCATAATGAAGCCATTCCCAACCTT | 15895 GCACCTGCGAAACGTGGAA | 26879 GTGGATGGGATCTGTCTGAGCAT | 37863 |
| 4238 CCAGGACCACAGTTGGAATCCTAT | 15896 TGTTACAGGCAGAAGTGCAAGT | 26880 TGACCCACCAGGACCACAGTT | 37864 |
| 4239 AGGAGTGGCACCTCCCAAGA | 15897 TGGCACAGCCCACCCGAAA | 26881 TAGCAGGGGCCACACGTTAG | 37865 |
| 4240 GTACTAAGACGAAGCGAGGTCCAT | 15898 CTCTCCCACTAAGTTCAAGTTCTGT | 26882 GCACTGTTTTAGACACGAAGACA | 37866 |
| 4241 GTGCTTGGAAATGGGCTAAATTGT | 15899 TCAGCAGAGCCTGAAGCAATG | 26883 ATGGCGCTGGTGCTTGGAA | 37867 |
| 4242 ACGGTCGGGCTGCTGATGTTA | 15900 AGCCTCAGACGCCGCATGAAG | 26884 ATAGGGCTGCCTCCCAGAGA | 37868 |
| 4243 GGGAATTGCCCTGAGCAAATACTAAC | 15901 GCCTGGCCTGCACTGAGTT | 26885 CTGACTACTGTCAAAGAGTTAGGGAAT | 37869 |
| 4244 GCCAGCTCAAAGGCCATACA | 15902 GGCTATAACACCCTGCTGACAT | 26886 GAGTCACCTGTAGCCAGCTCAA | 37870 |
| 4245 GGAGTTTCTTGGCAAAGGAGCTATG | 15903 CAAACAGGGCACGTCCCAAAG | 26887 CCAGTTGAAGCTCTCTGATGGTT | 37871 |
| 4246 CGTGGCCAGGACCTTTCACA | 15904 TGAGGACTAGAAAGAGGCACTGAT | 26888 CTCACAGGGCCCATTCATTACA | 37872 |
| 4247 ACCGAGCGTTTAAAGAAGGCAAGT | 15905 CATGAAGTGCTACTACGACTCTTAACT | 26889 CCCAGGCCTTACCGAGGTTTA | 37873 |
| 4248 AAGGCAGGAATGTTGCAGCTA | 15906 GTGGACAACCCGTCTCAGATTC | 26890 GCCTGTTAATACTCCAGTGAGGAAG | 37874 |
| 4249 GCCGAGAAATGCGGCCAAGA | 15907 CGCCGGACTGTCCACTGAT | 26891 CACAACCTGAGTGCCGAGAA | 37875 |
| 4250 AGGAGGGGTACAGATGCCCAAA | 15908 CCTCCTGCTGCACATCTTTCT | 26892 TTCCTCCCAGGAGGGGTACA | 37876 |
| 4251 CCCCGCTGTTTCCCTTCATT | 15909 TCAGCTCCTCGAGGCATGTTTG | 26893 TCAGGCACCCCGCTGTTT | 37877 |
| 4252 ACACTGTCCTTGACTCCTTTGTT | 15910 TTGAGGATGCGTGGGATGTAG | 26894 GGCCAAAAGGTGAAACACTGTCCTTGA | 37878 |
| 4253 GGTGACTAAGCAGCAATTCCCTTTAC | 15911 TGGGCCTCGTCAGGCCTTTAT | 26895 CTTGCCAAGCAAATTGGTGACT | 37879 |
| 4254 GTGTCCTACTTCAGGAAGGAATGTTCA | 15912 CAGCAGCAACCATGCTGCAAA | 26896 CCAAGGTTATGGAGTGTCCTACTTC | 37880 |
| 4255 GTTGCCAGCACAGTCAAGCTTTT | 15913 ACAGCGGAGAAGGTGGTGAA | 26897 GCATGCTGCCCTACTTGTCA | 37881 |
| 4256 ATGCCCATGGAGACGCATGT | 15914 GTCCCATGGATGAGTGGCTTTG | 26898 CCCAGTGGCTTCCACAAGTGA | 37882 |
| 4257 GCCCAGAACCCACTGAAATTATTC | 15915 AGGCTAGGCAGGCTTAGGATTG | 26899 GGACAACTAGGGACAGCCTCTCT | 37883 |
| 4258 GAGGGGTTGATGAGAGCAAAGT | 15916 CTCGCAGAGCAGAACCTCAT | 26900 TCAGCAGTGTGAGGGGTTGATG | 37884 |
| 4259 GCCGGCATTAAAAGTCCATATCTAAGT | 15917 AGCTCAGGGAGGCGGAAGTATT | 26901 TGAGTCACGTGCCGGCATTA | 37885 |
| 4260 CTGTGCAAACATCAAGGGATTAGAAG | 15918 CCCACTAGGCCACCCTCCAT | 26902 CAGTGTAGACTGCTTTCTGTGCAA | 37886 |
| 4261 CAGCAAGCTCAGCTGGGGAAGA | 15919 GACACAGATCTCTGGTAATTCAGAGCAA | 26903 TGTGTTCTCAGTTGTCTGGGTAAG | 37887 |
| 4262 CATGTCTCTGGGAAGTTGCATGT | 15920 CCAACAGCAGGTAGGCAAATG | 26904 CCAGGTACCTCCATGCCATAGACA | 37888 |
| 4263 CTCTGCAAACCCAGGCAGGCTAT | 15921 GTACCACTCAGACCAGGAAAACA | 26905 GGGGAACACTCAGGTCTTGTGAGA | 37889 |
| 4264 AGGAGGTTGGTGAGGCAGACT | 15922 CTCCCCACCTTCGTCTCTGA | 26906 GAGGATAAATGGAAGAGGAGGAGGTT | 37890 |
| 4265 TCTGCCCTTCGCATAGACCTT | 15923 AGATAGCAATGCTGCAACGTAAGA | 26907 GTGACTCATTCCAGGTGTAGAGGAT | 37891 |
| 4266 CACCTTGATTGGCAGGTTGACT | 15924 GTGCAAGTTGCTGTTGTCTCACT | 26908 AAAAGTAGGGCAGTCACCTTGATT | 37892 |
| 4267 CAGTGCGTTAGGCCCTGAGA | 15925 TCAGGAACCGTGACTCTTTTTCA | 26909 ACGTGCAAGCAGTGCGTTAG | 37893 |
| 4268 GCTCTCCACATTGATTGGCTTCA | 15926 GCTGCCATCTTGCCACTTTGTA | 26910 CCTGGCTTTGCTCTCCACATTG | 37894 |
| 4269 GGCATGGTGACCAATGGGTTGT | 15927 CAGTGCCCACAGCCTTCATTGT | 26911 CCTGCTTCACTCTGTGGCATA | 37895 |
| 4270 GCTCCTCTCATCATTTCGGTATCA | 15928 CCACCGCAGCAGCTATTATGT | 26912 GGAAAAACATGTACAGCTCCTCTCA | 37896 |
| 4271 GGCCTCAGGCTAAGTTCTTTCT | 15929 TGTCTGTCCCGGCAACCATAG | 26913 TGGAACAGGCCTCAGGCTAA | 37897 |
| 4272 ACAGCAGTGTTGCCACCAT | 15930 GCTCTCCATTATGCCGTTTATAGTGA | 26914 GCACCATAGGACAGCAGTGT | 37898 |
| 4273 CTGTGTTAACCGTGTGATGACTCT | 15931 CCCCTTTCCATACTGTGCTCTT | 26915 GCCTAACTCTTCCCTTGTTCTGTGT | 37899 |
| 4274 CCATCAAGATGGCTCCTCGCATTT | 15932 GGAGCCCAGACCCCAACAAG | 26916 TCCCGCTGTCCCCATCAAGA | 37900 |
| 4275 CCACTCTGTCTGAAACGTGTTACT | 15933 CACCACACCCAGCCTCTGT | 26917 TGGGCTAATCCACTCTGTCTGA | 37901 |
| 4276 GGGCTTGAAATGCAATATCCCTTTCTTGA | 15934 CCCTAGGGGCTGCAAGGTTAC | 26918 CAAGCCAACTCAGGGCTTGAA | 37902 |
| 4277 CCTCACGAATTCACAAGGAGACTA | 15935 TCCTGCTTCAGCCGCCAAT | 26919 GGTGACTGTGTTCCTCCTCACGAA | 37903 |
| 4278 GGCTTAGGTCAATGCCATCAAGA | 15936 TGTCCCCAGCATCGGATCA | 26920 GCCTCCTGAGGCTTAGGTCAATG | 37904 |
| 4279 CATTCAGCACCCCACACACATT | 15937 GCACTGTCCTGTCCTGGTTGAA | 26921 AAGCCATCCCCAGCCCACATT | 37905 |
| 4280 TGGGGTCAGGGGAATGTGGAT | 15938 GGTCCAGGGATCTGGACACA | 26922 GGAGAAATGGGACGCAGGAGAT | 37906 |
| 4281 CTCTCCCTTGTGGGTTGTGCTT | 15939 GCTGCACACCACTGACCAAT | 26923 CCCCAGCACCACCTTATTGT | 37907 |
| 4282 CCCCGTGTTCTTCCCTTCAGT | 15940 GAGGGAAGGAGCCGCATGTATAAG | 26924 TCTCCGGCCGTCCAGCTTT | 37908 |
| 4283 GCAGGTGGCGTTAGAGCACAT | 15941 GCCCTGTAACAGTAGCCAAAGT | 26925 TGTTCAGCTCCTAAAATGGCATCA | 37909 |
| 4284 ACCAGCTGCCAAAACATTAGGAT | 15942 AGAGAGAGCCTTCTTTCCCTTAGA | 26926 GGGAAGAACACACCAGCTGCCAAA | 37910 |
| 4285 AGTTTGGAAGCTTTCTGGGATACA | 15943 CAAAGCATGCCACTACTGTGTGT | 26927 GGATGCCCTAGGTGAGTTTGAA | 37911 |
| 4286 CAGAATCACCACGTAAGGCAGAT | 15944 GTCCCTGTGAACTCCTGATCACT | 26928 CCCCACAAAACTGGCACTGAGA | 37912 |
| 4287 TGGGTGCCGCACATCAAG | 15945 ACAGGGCCTTGGTCTTGCTT | 26929 GGGGCTGTGGTTTCAGAATCAGT | 37913 |

FIG. 36G6

| | | | | |
|---|---|---|---|---|
| 4288 | CCATGTACTGAGAGCCTGACCTAA | 15946 | TGCAGTCTGAACAGCATGGAT | 26930 | AGAACAGGGGAGACAGTGAGAA | 37914 |
| 4289 | AGGACCTGGAAGAGCCACAA | 15947 | CCAGGCCCACTCAAAGCACAAA | 26931 | AAGACAGCAGAGGACCTGGAA | 37915 |
| 4290 | GAACCCAAGAGAGACATTAGCAACA | 15948 | TTCCATGCCTGCATAGTGCTT | 26932 | TGCCCTATGCTAGAACCCAAGA | 37916 |
| 4291 | TCTGCAGTTGGGGTGGAGATGT | 15949 | CTGAGCTGCCTCCTAACCACAAG | 26933 | GCGGGAACCATGCATTCTCT | 37917 |
| 4292 | GCCTGGGCCAGCTGTTAAGAT | 15950 | TCCCACCAGGTCCTCTGAGAT | 26934 | GCCTGTTGGATGGTCATAGACACTAC | 37918 |
| 4293 | CTACACTGCTCGCTCTGAAAATG | 15951 | CACCTCTGCTCTTTGGTAGTGGAT | 26935 | GTCACAGGGATTTGAAGATACTACACT | 37919 |
| 4294 | AAGCCTGAACGGAGCCCTAA | 15952 | GTCCATCTCCTTGGGAGTGATG | 26936 | TTCTGAGCGGAAGCCTGAAC | 37920 |
| 4295 | GGAGGCTGTAAGCAAACCAAATC | 15953 | GCCCAGGGGTTCTGGGACTT | 26937 | CACCAGTCAAGGAGGCTGTAAG | 37921 |
| 4296 | CTACCAGCAGTTCATGGTTCAGA | 15954 | GTTCCTCCTGCCCATGCATTA | 26938 | GTACAGCTTCTACCAGCAGTTCA | 37922 |
| 4297 | GCTTTTGCACTTGGCTCCTTGT | 15955 | TCAATGCGCTCCCTGGTATTT | 26939 | GGTTGTACACTTGCTTTTGCACTTG | 37923 |
| 4298 | AAGCTGGGTGGCCTCTGATAG | 15956 | GGCAGACTTTATTTCCCATTTGCTCTAC | 26940 | GACACAAGAACTGGGAATGGAGGAA | 37924 |
| 4299 | TGAGGACCCGACTCCTTGATAG | 15957 | AGATGCTGGCAAGGAAGGAAAT | 26941 | GTCAGATGTTGTCTTCACACTCCTA | 37925 |
| 4300 | CTCTCCCAAAGCAGTGGCTGTT | 15958 | AGCGGCTCAGGCACAAAGAA | 26942 | TCAGCCTAGCCTCTCCCAAA | 37926 |
| 4301 | TCTGCGAGAATTAGCAAGGGATT | 15959 | AGCAAGAGCACAGGGTGGAA | 26943 | AGAGCTTGGATCTGCGAGAATTAG | 37927 |
| 4302 | GGGTCCCTGGGTGCATTTTA | 15960 | TTGCCACCAATATCAGGAGTGTATAG | 26944 | ACAACCACAGAAGGATGTCAACT | 37928 |
| 4303 | GGCCTCCAAGCTCTGAAGCAT | 15961 | AGGCTCGGGAGACCGGAAA | 26945 | GGATAGGATGTGGGCGAAATTCTTAC | 37929 |
| 4304 | GGACTGTGACCCACCAACAGAT | 15962 | AGACCGTCAGCTCCGAGGTT | 26946 | GCTTTCCTCTAGGGTTGGACTGTGA | 37930 |
| 4305 | AGCGCCTCTGCATGCTTTTC | 15963 | AAGGCCACTTAGGGCAGAGA | 26947 | CGGTGTCCCTAGGCTGAGATAAC | 37931 |
| 4306 | CTTGGCCCTGAAAGGAAGATACA | 15964 | TGGCTGCACAACCCCAGTT | 26948 | GCACAACTTTATCTTGGCCCTGAA | 37932 |
| 4307 | TGAGGAACTGTTGGAGGCAAAT | 15965 | AGCTTCCTGGAAATCTACATTGTGT | 26949 | GGCCCAGTCTATGAGGAACTGTTG | 37933 |
| 4308 | CTGGCCCTTGTGAGCTTGTCTAAG | 15966 | CAATGCCAGTTGCCTCTCACA | 26950 | GTCTCAATTCCTCTGGCCCTTGT | 37934 |
| 4309 | GGCTTCCTCACACAAAGCCTTCA | 15967 | AGCATCTGGTGGTGTTTTCGAT | 26951 | CCCTAACAGGCTTCCTCACACA | 37935 |
| 4310 | GCAAGCAAGGGAAGGGCATGA | 15968 | GCAGCCGGAGGCATTCACTTA | 26952 | GAGGGATGTGAGGAAGCCTTTAC | 37936 |
| 4311 | TCTGGTAGGACTTCGTAAACTGTAAG | 15969 | TCTGGGCCACCTGATGGTAT | 26953 | TCCCCGTGGTCATATTCAGAGAA | 37937 |
| 4312 | GGTGGATCAGTCCTCAAAACCTCAAG | 15970 | GGCCTTTGGCCACAGACTGA | 26954 | CCAGTGGTGGATCAGTCCTCAA | 37938 |
| 4313 | CCAAATCCATCACTTGCTCCTGCAT | 15971 | GCCCAGAGAAATGGAGCACAT | 26955 | GGGGAGGAGACCCAATCCAAATC | 37939 |
| 4314 | GCTGAAGAGTGGGGTTCAGTT | 15972 | CCCAAAACCATTTCCCTATGCCTTA | 26956 | GACACTGGGGACAAATAGGCTGAA | 37940 |
| 4315 | CGTGGAGAGAACGCCACCAT | 15973 | GCCTGTCTCGTCGTCACTAGGAT | 26957 | CAGCAACTGCGTGGAGAGAA | 37941 |
| 4316 | CCACCATCTTGGCTCTTGTTTTCT | 15974 | GGTGTAAGGAGCAATGGATGT | 26958 | TTCAGGACCTCCACCATCTTG | 37942 |
| 4317 | CCCCAGAAGGTGACTCCAGAAAC | 15975 | GGGTGAAAACGCACCCAACA | 26959 | AGGCAAAGTCCAACCCCAGAAG | 37943 |
| 4318 | CTCTGTCCTCATCTCACTGTTTATCTT | 15976 | GGTGTGGTCAATGGTGTCAGA | 26960 | CACCGCCACATGCAATCATC | 37944 |
| 4319 | CAGCCTTTCACCCTGTGACTCT | 15977 | TGCCGGGCAATCCAGAGAGA | 26961 | CCTCACTTCTAAGAGTAGCAGCCTTTC | 37945 |
| 4320 | CCTTGTGGAACACAGAGACTCAT | 15978 | GTGTGCCTCGCCTCTTTCT | 26962 | CGCAGGCCTTGTGGAACA | 37946 |
| 4321 | CGCACAGACACCTGCAATG | 15979 | CCAGCTTTGCTCTTCATAACAGCTT | 26963 | CCACCAAGGTACGCACAGACA | 37947 |
| 4322 | GTGCCCTATCTTCCAACTTCTGT | 15980 | GAGTGATAGCACTGAGCCAGTAAA | 26964 | GATACAAGAACACTGTGCCCTATCT | 37948 |
| 4323 | ACACCACTGTGGATCTGGAAGA | 15981 | GCTCCGGGTGCAGGAATCAA | 26965 | GCAGTAATGCCTCTGAATACACCACTGT | 37949 |
| 4324 | AACCACCTGCTGCCTCTTTT | 15982 | AAATGCAACCTATGCCAGGTACT | 26966 | GACATTTCTGGGCTATGTGGTCGAT | 37950 |
| 4325 | GGCTGCCTTGGCGAAATCTCTCT | 15983 | AGTCACCTCCAGCTATGTTTGAATAC | 26967 | AACTTGCCCTTGGCGTGCAT | 37951 |
| 4326 | ACGTACCTAAAACCCACTGCTAGA | 15984 | TGAGCTGCGTGCCTCTGA | 26968 | CCACAGGTACTGACTGATACTGAGA | 37952 |
| 4327 | AGACTGCTGCTGAGTTTTGAGT | 15985 | CCTTGTGCTAGACATGAAGCAAGA | 26969 | TTCTAAGCTCCTAGAGGGAAAGACT | 37953 |
| 4328 | GTGAGCTGGATTGTGCTATGGTA | 15986 | CCCATAGTCCCATCCTCCCTGAAT | 26970 | AGAATAGTGTGAGCTGGATTGTGT | 37954 |
| 4329 | GGCCACATTTCCCACCAATATTCT | 15987 | AGGCAGGCTCTCGCATCT | 26971 | CGTGAAGTCCTTGGCCACAT | 37955 |
| 4330 | GTTAGCACGAGGGGATCTTGTT | 15988 | CCGACCCTGCTGCAACAAATGA | 26972 | GGTCCCACTTGACAACAAGCAAAG | 37956 |
| 4331 | GGTGTAAAGCAAGGACAACAGTTC | 15989 | TGACTGCTTTTCCAAAACTGGTACT | 26973 | CTGGTAAGTTTTCCAAATGGTGGTGTA | 37957 |
| 4332 | AGGCCACCCATGGTTTCACA | 15990 | AAGGGCCACCTGTCAGAAGT | 26974 | GCTGCTCCCATGAAATCCACTCT | 37958 |
| 4333 | GTGCCGCGTAGGGACTGATA | 15991 | GTGGCTGGTTCCTATGGTATGAGA | 26975 | GGGACAGCGACAGTCCTGATG | 37959 |
| 4334 | CGGTAGACGGTGTGATGTGTGA | 15992 | GGCTCATCGCATGCATCTTTGATT | 26976 | TGGGGTGGGAGACGGTAGA | 37960 |
| 4335 | CCATGTGGGACCACCTGCTT | 15993 | CAATCTCAAGCCCTGGGCAAAG | 26977 | TGGAAGAGGGCGATACCATGT | 37961 |
| 4336 | GAAGCACCAACAGCAGTTTCAGT | 15994 | ACCCTGTAGCAGGAGCTGTGT | 26978 | CATCTGAGTAGAGAAGCACCAACA | 37962 |
| 4337 | CTCAAGGGTAGGACTGTCTGTGA | 15995 | TGGCTTATATGGCCTCACCTATCT | 26979 | GTGTATTGGCAGGCTTGATCTCTCA | 37963 |
| 4338 | CCAGTGGACACACTGCTTCTTG | 15996 | AGGACTGGGGTGGTGAAGGAA | 26980 | CCCTTCATAATCCAGTGGACACA | 37964 |
| 4339 | CTCCTCAAAGCGCGGTGATGGTT | 15997 | GGGTGCAGGGAATGCACAGAT | 26981 | CCAGACCACGAGCTCCTCAAA | 37965 |
| 4340 | CCTGAGCCACAAAGAGCCTTAC | 15998 | CCTCAAATGAGGGCAGGGACATTC | 26982 | TCCAGGGCCTGAGCCACAAA | 37966 |
| 4341 | CAGCCCCTCCATTTTGCTGAT | 15999 | TGTCGTATCCCAGGGTTGTATTTC | 26983 | AGAGTCATCCAGCCCCTCCAT | 37967 |
| 4342 | GGCAGGAATTGTGAGCTGTAGT | 16000 | GGGGCCAGAGAGCTTTCACT | 26984 | GTGGTCACATTGGCAGGAATTG | 37968 |
| 4343 | GGACGCAAGGGAAGCTGTGA | 16001 | CCATCTCGACGCAGAGAACCTT | 26985 | ACCAGGCTGTGGGACAGACA | 37969 |
| 4344 | GGCTTCCTTTGAAACTCCCTGAGA | 16002 | GGAAACAGACGGGCGTCCATA | 26986 | CAAAAGCAGGGCTTCCTTTGAA | 37970 |
| 4345 | CAGTGGCACAATCATAGCTCCCTTT | 16003 | AGGATCACCTGAGCCTGGGATT | 26987 | GGGGTGCAGTGGCACAATCATA | 37971 |
| 4346 | CTGGCTAAACCGATAGGTTCTTCT | 16004 | CACTGGGCTGCTCATAGAATACA | 26988 | GTTGGGCTGGCTAAACCGATA | 37972 |
| 4347 | CAGCAGCATTCACGACATCCAT | 16005 | TGGCCCAGCCCAGAAAAACT | 26989 | AGGGGCCCTTGTTCACACACA | 37973 |
| 4348 | CACTGAATGCGGTGTTTGATTAAGA | 16006 | GTGAGCCTCCAGATGTTTCCTT | 26990 | TCCCCACTGAATGCGGTGTT | 37974 |
| 4349 | GGCTGGGGTATACAGAAGGCATGA | 16007 | GAGACCGCTGCCACAGTCA | 26991 | GTCAGCTTGCAAAGCTCCTTTAGA | 37975 |
| 4350 | GCTCTCTCCCAAACACTGCTTTC | 16008 | ACCAAACCCCTTAGGCCCACTA | 26992 | TGCCACATGCTCTCTCCCAAAC | 37976 |
| 4351 | CCCTGTTTGTCTTGGCTCTATGAA | 16009 | CATTGATCAGGGTACTGAAGTGGTA | 26993 | CTGTTAGGGCCCTGTTTGTCTTG | 37977 |
| 4352 | AGGAAGACCCTGCATTTACATTGA | 16010 | GGAGACAGAGCTCCCGATTG | 26994 | TGAGGAAGGAAGACCCTGCAT | 37978 |

FIG. 36G7

| # | Sequence | # | Sequence | # | Sequence | # |
|---|---|---|---|---|---|---|
| 4353 | AGTCAAGCTGGGAGATGAGGATA | 16011 | CAAGCAGATAGGAGGCGATCAGA | 26995 | GGACTTCCCCGCAATACGAAAG | 37979 |
| 4354 | CAGTGTCTACTGCTCCAGTGCTT | 16012 | GCTCATCACACTCACCCCAGCTA | 26996 | TCCATCTTCTCTGTACAGTGTCTACT | 37980 |
| 4355 | GGGAGAGGGTTGGACTCAAAAG | 16013 | TGAGGGTGGCAGCGTCAT | 26997 | AGCCCTCCTCGGACCCATGT | 37981 |
| 4356 | GCGTAGTGTGTGTGAAAGACTCAGAT | 16014 | GCACAGCACTCTGCCCTTCA | 26998 | GAAGAGGCTGTTAGAAGCGTAGT | 37982 |
| 4357 | CCATGGCAGCTTACTCCCAATC | 16015 | GGTCTGGGCCTTAAGAGGCATTGA | 26999 | GCAGTAGTCCAGCCTGAGTTTC | 37983 |
| 4358 | AGCCACAGCCTTGGTCTCACA | 16016 | TGCCCTGGGGCGAGGTTATTA | 27000 | TGCCGGCCTCAGCCTCAGTA | 37984 |
| 4359 | CACCACACATCTCCTAAGCATGTA | 16017 | CACCAGGACAAGTGCTGTCT | 27001 | CCCCAGCCATAGTCTCTGATTC | 37985 |
| 4360 | GTAGCTGAGACATGGTGTCAAAC | 16018 | GGAGCATCGCTCAGCTCTTCTT | 27002 | CCTGGTCTCTCAGCCTTAGTCA | 37986 |
| 4361 | CCTCCTGAAGACAGAGTCCAACT | 16019 | CCGCCTTGACAGCAGGAAGT | 27003 | AGTGAAGACAAAGTCCTCCTGAAG | 37987 |
| 4362 | CCCTGGAAACTATAAATGGCTGCTA | 16020 | ATGCAACTTCCCTGAAAGGAGTAA | 27004 | GGCAAGGAATTATAACTTAGGCCCTGGAA | 37988 |
| 4363 | TGACTTCCTGGCCAGTCCAT | 16021 | CTGCCTTGCTGGATGGCAAAATG | 27005 | TCCCAGGGCACACTATGACT | 37989 |
| 4364 | CTGTCTGACCAGACCTCAGACT | 16022 | CATTTGGGAGCCATGGTGGTA | 27006 | ATTTGCACCCATGTCTGTCTGA | 37990 |
| 4365 | GGCCAGAGAACATGTCTGTCATC | 16023 | GGGCTAGGAGCCCAATATCATTT | 27007 | TGCAGGAGGCCAGAGAACAT | 37991 |
| 4366 | GCCTTATCTTCGCCCCTCTTTG | 16024 | CCCATCTCCCTTCCCATCTGTCT | 27008 | GCCCCATCCCTTTGCCTTATCTTC | 37992 |
| 4367 | GCTGAGAGGTTTTCACACGGATAC | 16025 | CAGGAAGCTCCACACAAACACA | 27009 | GTGTCACACGCTGAGAGGTT | 37993 |
| 4368 | CCCAACTTGTTCAACTCTAAGTGTCT | 16026 | CAGTGCCCTCCAGCCAAAG | 27010 | CCTGCAACAAGAGATAAGCCCAACT | 37994 |
| 4369 | TGAGGGTGTCCAGGCAGTTTG | 16027 | GTCACCGACACCCTGTGGAT | 27011 | TGAGCCACTGTGCCTGGATA | 37995 |
| 4370 | GCTTAGCCAGTCCTTCATTCTACAAC | 16028 | ACAAGAGGCCCTAGAATCCAAGT | 27012 | CAGTTTAGATATGCTTAGCCAGTCCTTCA | 37996 |
| 4371 | GGCCTTTGGCCTTCCTCATCAT | 16029 | GGCGGACTCCACCTGAAGA | 27013 | TCACCTCACCTTGGCCTTTG | 37997 |
| 4372 | AGGGCTTTGGTGTCCTGGAA | 16030 | CCATTCTTCGTGGTCCATTTGTCT | 27014 | CAAACACATGCTTTCCTCAAACAAG | 37998 |
| 4373 | GCATGGGGATATAACGTGTTCAGTTTG | 16031 | GATCAGGTTGCAGTCTCAGCAT | 27015 | GAGGATACTGAGGCATGGGGATA | 37999 |
| 4374 | CTCCTCAAAGCCACTGCCTTGAAA | 16032 | GGCAGTAGAGAAGGGTCTAGGAT | 27016 | GGCATGGGGAGGAAGTACACAT | 38000 |
| 4375 | GCCTTGTGGGTCAAAGAAAGCAT | 16033 | TCACCAGATGGCATTTGTCTTCA | 27017 | TGAAAAGGCCTTGTGGGTCAA | 38001 |
| 4376 | CCAGGCTGGAATCCCTGTGT | 16034 | ACTGAACTACCTGGACATCTGTTTT | 27018 | AACTACTGCCCAGGCTGGAA | 38002 |
| 4377 | GCGACACGAAAATACAGCAAAAC | 16035 | GCAGGCACACGGAATGCAAA | 27019 | GAATGCTTCATGCGACACGAAAA | 38003 |
| 4378 | GGCAGACTGAAAAGGAGATACAGA | 16036 | ACAGCCCTCCCGGCTGACTT | 27020 | CCAGCTGTCATTTTAGGGCAGACT | 38004 |
| 4379 | CCCTGTGTCTTCTGAAGCTGATG | 16037 | CAGTGGTGACCTGTGGGAAAG | 27021 | CCCTGAAGCCCTGTGTCTTCT | 38005 |
| 4380 | GTCTCTTTTCCCCTAGAAAAGGTTACT | 16038 | CCCGACCCCTGATACTTCACAA | 27022 | GGAGTTTCTGTCTCTTTTCCCCTAGAA | 38006 |
| 4381 | GGCAGGCAGCTTTTCAAAATGAAGT | 16039 | GAGCAGTTCTGGCCATAGGAT | 27023 | CTTGATCTGGCAGGCAGCTT | 38007 |
| 4382 | CACACGTGATTTATGGGAGACAAG | 16040 | TGCCATCTTCTTCATTGCAGTTG | 27024 | ACAGAACCCTTTCACACGTGATT | 38008 |
| 4383 | CAGGTCACTTCTTCCAGGTCCTT | 16041 | GCACAGGCAACATCACAGTTG | 27025 | GCCTGTATGATATTCAGGTCACTTCTTC | 38009 |
| 4384 | GGGAGAAAGGAGCAGGCTAATTG | 16042 | GGAGACCCAACTGTGAACAAGA | 27026 | GCCAACCAGTTCTTTGGGAGAA | 38010 |
| 4385 | GGGGACTCAGGCTTCTGTGA | 16043 | TCATGCCTGGGACCAAATTCTAAG | 27027 | GAAAGCAGCCAGGATTACAACCTA | 38011 |
| 4386 | GTGTACCCTCGGCTATGTTTACT | 16044 | GCAGCTGCCTCTGAGTGTTTG | 27028 | TCCTGCCTGTCCCCAGTGTA | 38012 |
| 4387 | AGAGAGGCCAGCAGCTCCAA | 16045 | TCCCTGGCTCCGTGGTGCTT | 27029 | GAGAGGGTGAGACGGTAGAAAC | 38013 |
| 4388 | ACAAAAGCCTCCTCGGGTACT | 16046 | TGCCGTTGTTTGGAAGCACTA | 27030 | CACCTGAAGCATTTTTCATCCTGTTCA | 38014 |
| 4389 | GGCCACAAGCATTGTAGGTGTT | 16047 | AGGTTACAACCTTGAAAACCCAAAC | 27031 | AGTGCGGCCACAAGCATT | 38015 |
| 4390 | CAGCTCTGCCAAAAGGATCTCTCTA | 16048 | GGGAGGGATGGGGTGCAAATC | 27032 | GACATCTTCTACAGCTCTGCCAAAA | 38016 |
| 4391 | GCTTGCAATGCCCTCCCCTTAT | 16049 | AAGGGTCGGCGGGGTTCAGA | 27033 | CTGCACTGCCCTGTGCTT | 38017 |
| 4392 | CCCACAACACCCAGGTTCTGA | 16050 | GCTGATTAGGTGGACTCTGTCCAA | 27034 | ACCAGTGGCTTCCCCACAACA | 38018 |
| 4393 | TGGTGGGCTCAGTAAGTTCAAAG | 16051 | TGGCAGCACTGGGCACAT | 27035 | GGACTTCTGTGGGATGAGCATT | 38019 |
| 4394 | CCACACCTCTCCTTGGATTCTAAC | 16052 | TCCTGGAGCACAGCCTTCAT | 27036 | AGCCCTTTCCACACCTCTCCTT | 38020 |
| 4395 | TGGTAGGCCCCAGAAAGCTA | 16053 | GGGACCTGAGCCTCTGTTTTGA | 27037 | TGCCCTCTGCAGGGAATGGTA | 38021 |
| 4396 | CTCAAGCTGCTAAGTGTTAGGTTTC | 16054 | CCACCACAACCACTCCAGTT | 27038 | GCAGCCAGGAGCAACTTGTACTCA | 38022 |
| 4397 | GACCACAGGTTTCCATCTACATTACT | 16055 | TGCCCTGAGGTTTGCGTAGT | 27039 | CTCTTCTCTAGACCACAGGTTTCCAT | 38023 |
| 4398 | CATCATGTCGCAGCTGCATTTTC | 16056 | GATTCTGCAGCAAGGTGCTATG | 27040 | GTGCGAAAGACTGGAGCAATC | 38024 |
| 4399 | CACCAACTCTGCTTTCAGACAGAATC | 16057 | TGGAAGGGGCGAGGGAAT | 27041 | GGACAGCACCAACTCTGCTT | 38025 |
| 4400 | GGGCAACAGGAGATTAGTAGCTATG | 16058 | ACTGGGCTGATTCGTCTCACT | 27042 | AGCATTAATGCCGCAACAGGAGAT | 38026 |
| 4401 | AAGAACCTGGGCCCCTGATG | 16059 | GGCAGGCCTAACAGTTCCAT | 27043 | GATAGTTGAGCAGAGAAACAGGAAGA | 38027 |
| 4402 | GGGACAATAAGGAGGAAGAGCAA | 16060 | ACGAGCTTTTGGCTGTGCAA | 27044 | TCATAGGCATCTGGAGGGACAATAA | 38028 |
| 4403 | ACCATGCTTCAGTGTGCAAGA | 16061 | CCATCCTGGTGACTGTTTCCTTTCA | 27045 | GCATGACGTCAGAAACCATGCTTCA | 38029 |
| 4404 | GGTAGCTGCGTAGAAACGTTCA | 16062 | GAGCCGAACAAGCGTTTCTGT | 27046 | GTGGAAACCCGATTCCCTTTGGTA | 38030 |
| 4405 | ACACCTGTGACTGCTGAGT | 16063 | TGTGGCAGTGGGGAAGGTGTAA | 27047 | TGACCAAACCAAAACACCTGTGA | 38031 |
| 4406 | CCCTGGTGCTAGTTTCTTACAACA | 16064 | GTGCTGTTTTCCTCCCACCTTCT | 27048 | GTGGTCTCCCTGGTGCTAGTTT | 38032 |
| 4407 | GTGGACCTGGATGACCTGTCTTG | 16065 | AAGCCCTGCCCACCCACTGA | 27049 | CGAGACCCGATCCCTGAAGT | 38033 |
| 4408 | CGCCATGTTTCAGGCCACCTT | 16066 | GCTGCCTTGGGAATAGACGTTCA | 27050 | ATAGCCGAGCCGCCATGTTT | 38034 |
| 4409 | CAGAGCAGTTCCAGGCTTCACA | 16067 | AGATGCTCTGTCCTGGATGATGT | 27051 | GGTGGGCAAAATGACCAGACAGTT | 38035 |
| 4410 | CGGGGTAAAGTCTCAGGGAAGTGA | 16068 | CTCCCTGACAACGTCTGGAATG | 27052 | GGGCTCCGGGGTAAAGTCT | 38036 |
| 4411 | GGCACTTGGCATGTGTGATTT | 16069 | GCTCTCATCACACTTTGGACCTTGA | 27053 | TGCACCAGGCACTGTGTTAG | 38037 |
| 4412 | CCAGGGAGAAGAAACCCATCCTT | 16070 | TGTAGGGTGGGGTTGAGAGATTT | 27054 | CACAGCCTTCCAGGGAGAAGAA | 38038 |
| 4413 | TCCAAGGGGCCTTCAGGTTTCT | 16071 | GCGGTTGGTGCTCCTCCTAA | 27055 | CCATGAGAGTACCCACTCTGTCCAA | 38039 |
| 4414 | TCACTGGGCTCAGTGTGAGTAAG | 16072 | GCACTGTGCTCCTGCTGTTTG | 27056 | TGGGTGGGTGTGAGGACCAAT | 38040 |
| 4415 | AGGGGCTTCATGACCGGTTT | 16073 | TGCCAAGCCACCACAGAAA | 27057 | GAGGATGAAATGATATAGAGGGGCTTCAT | 38041 |
| 4416 | GGCAAAGTCCTTACGAAGTGAGATG | 16074 | TCCCCATGCACACACCCTCTA | 27058 | CACTCAGAGTAGAAGGCAAAGTCCTTAC | 38042 |
| 4417 | GCTAACTCCCCTAGACAGGAAAAG | 16075 | AGGAAGGCAGATGGTGTCAAC | 27059 | CCCCAATGCTAACTCCCCTAGA | 38043 |

FIG. 36G8

| | | | |
|---|---|---|---|
| 4418 GCCAGTGCCCACTGAGGAA | 16076 GGGCCTTGCCTCCCAGAAAAT | 27060 GCCTCCACAATCCTCCCAGGTA | 38044 |
| 4419 GTCTACACACACGCCTCAATAGT | 16077 TTTCCATTTCTCCCTCGCTTATTCT | 27061 GCACTAAGAAGTTGCTTTGCTGTCTAC | 38045 |
| 4420 GGGAGAAGGCGCCTCTATTTCTGA | 16078 AACTGTTCCTGCAGCCCTTT | 27062 CCCAGCCATTCCCTCCAACAT | 38046 |
| 4421 TCCCTCAAAACCCACGTATTTGT | 16079 TCCCAGCACAATGCCTGTCT | 27063 GCATATCCCTTGACTGTTCCCTCAAA | 38047 |
| 4422 CACAGCCCTGCTTAGGAAGA | 16080 GCCTTCAGTATGTCTTGCGTCTTG | 27064 TGCCAGTAGGGAGTCACTGAGA | 38048 |
| 4423 TTTGAGCCCAGGAGGTCCAGTCT | 16081 GGAGGGCAGTGGCACAATCATA | 27065 CCAAGGCAGCAGGATCATTTG | 38049 |
| 4424 TCCCTACACACTCCCATGAAGA | 16082 AAGGGTGGCACCGAAGTCAGA | 27066 CTTTCCGGTCTCCCTACACACT | 38050 |
| 4425 ACCCAGACTGGCCTCCAATTC | 16083 GGCCAAGGTGGAAGGATTGCTTA | 27067 CATAGATGGGGCATCACTGTGT | 38051 |
| 4426 GTGGCCTCGAGGAAGCATAA | 16084 AGGTGAAGCTGAGCCACTTG | 27068 CCAGTAGACCCACCATGTCTGT | 38052 |
| 4427 GTGCATGAGTTTCACATGTCTCTCTT | 16085 CTACCAAGTCTGCTGTCCCAAA | 27069 GCAGAGAGTGCATGAGTTTCACA | 38053 |
| 4428 TGTGGGGCTGTAGGACACAA | 16086 CCCACGCTGATTAATGCTCCTTTG | 27070 GTGCGTGAGAATAGATGCTGACAT | 38054 |
| 4429 GGGGTCAACTCCTATCACCTTTC | 16087 GAGAGGCTTTGAGGCATTGAGA | 27071 GGTGGTGGGGTCAACTCCTA | 38055 |
| 4430 GTGGCAGGGGTCTTTGTACTTC | 16088 GGCAGTTGGGGAGGAAAGGTAT | 27072 TAGCCTGACTGTGGGAGTGT | 38056 |
| 4431 GGCAGAGACGCTACAGTAACGAA | 16089 GCAAGGCTGACCAGGAATGT | 27073 AGGGCCCTGTTACTGGCAGAGA | 38057 |
| 4432 GAGACCCCTTTCCTTCTGCTTGA | 16090 AGACAAAGTCCTCCCCACTCT | 27074 GCTGCACAGCTCGTAGCTCTAA | 38058 |
| 4433 GAACAGCACAAGGTGGGACAAAC | 16091 ACACAGGCAGCGTTTGCTT | 27075 TGCCTTCCACAGGGAGGAGAA | 38059 |
| 4434 CTGTTTGTAAGGTCTCTGGGTATGA | 16092 ATTAAGCCCCATGGGTGGTATG | 27076 CCAGGACTAAGGGAGTTGTCTGT | 38060 |
| 4435 CACCATCAGAGCTGGGGTCTTT | 16093 CAAAGTCGGCCCGTCTCACT | 27977 GCACCAGGCCACCATCAGA | 38061 |
| 4436 GGATGTGAAAGCTGGAGCACTGT | 16094 CCTCATCCAGAGATTGCAAGGTT | 27978 GGTGCACAGCAGAGGATGTGA | 38062 |
| 4437 GACATCTGTGTGCTTGTTAAGGGAATGA | 16095 CTACCTGCCACTGTGTAGATG | 27079 GGGTGGACATCTGTGTGCTTGT | 38063 |
| 4438 TCCAAGTTCAGTGCCAGTTCTATC | 16096 AGCCTGCTGATGCAGGAGTTG | 27080 GGGATTCAAGTCCACATCTTTTGATTC | 38064 |
| 4439 TGCCTTGGCCCTTGCCTTTT | 16097 GCGAGACTGATTACAGACTGAGCTA | 27081 ACCAAGATCCACTCCAGCAAAA | 38065 |
| 4440 CAAAGGGAAGACACGAACTCCTT | 16098 GCGCTGAAGTGTTGCATTCTGT | 27082 CACAGAGCCCAAAGGGAAGACA | 38066 |
| 4441 CGATGTGGCGGTATACAGTGTTG | 16099 TGGCCGAGGCTGTGAAGGTA | 27083 TGCAGTCGATGTGGCGGTAT | 38067 |
| 4442 CGCTTCACTGGCCAGAACTTG | 16100 CCAGCTCCCCTTGTGGTTAAA | 27084 TCAGTTTTGCTCACGCTTCACT | 38068 |
| 4443 GCATTTGTTCATTGTGCGTGTGT | 16101 GGCATGCCTTTCCACCTAGT | 27085 GCTCTATGTGCTAGTGTGTGCAT | 38069 |
| 4444 AGGGATAGAATTGCTGACCAGATAGA | 16102 AGCCTCCACTCCCCTCCTTCT | 27086 GCACAGTCAGTTGTCAGGGATAG | 38070 |
| 4445 CGAGCCGGACAGCAGTTCATTA | 16103 GCTCCCCGAGGCTGTGAGTAA | 27087 GCAACAACAACACCTACAGGAGACA | 38071 |
| 4446 CCTGAACTGCCCTCCTCAGA | 16104 GGGTCCACAGTGTCCGTGTTT | 27088 AGAGGAGGCTCCAGCGTGAA | 38072 |
| 4447 GCAGCTGAGGAGTCAGGGTTCAA | 16105 AGCCCCAGCTCTCCCATGT | 27089 TCTCTGGGCAGCTGAGGAGTT | 38073 |
| 4448 CAGGCTTGGAAACTCAGGGACTT | 16106 TCGACTGCTCTGTGCCCATCT | 27090 CAGCCACAGGCTTGGAAACT | 38074 |
| 4449 CCCACATGGGAGACCGCTAA | 16107 GGTGAAGGCAAAGTCCTCCTT | 27091 GGTTCCTGGTGAGGGAAGATGT | 38075 |
| 4450 GCTGTGGTTTTATGCTCCCCTAAAC | 16108 ACAGCCCTGCTGCTGCTT | 27092 CACCCCTGACTTAGCTGTGGTT | 38076 |
| 4451 ACCGCCTGGTTCCTGATTCT | 16109 CACACACAGTCCTAGGCCATAC | 27093 TTGCTCACTACCGCCTGGTT | 38077 |
| 4452 CAGGGGAGGCCTAGAGTTAAGTTC | 16110 TCTGGGTCGCGTAACTCCAT | 27094 TGCATAGACAGGGGAGGCCTAGA | 38078 |
| 4453 GGGGCTCTCCCTCTCGATGTA | 16111 GCTGGCGGAGCAGTTCGTA | 27095 CGTCCACGAAGCCCCAGTA | 38079 |
| 4454 CGGGCCACCTGGAGAAAGAATAG | 16112 AGGCAGCCTGGCCTTACA | 27096 TGGCCCCACTACTTCCTGAAC | 38080 |
| 4455 ATGGGTGGCTTCGGCTCAA | 16113 GCTGTGGGCGTGTGCAT | 27097 GAGTGTGGCAGTCGGCTACTAAG | 38081 |
| 4456 GCCAAGTTTTTCAGAGAGCAGCAGAT | 16114 AGTCGTGGGCTGTGTGCAT | 27098 TCTGATGGCCAAGTTTTTCAGAGA | 38082 |
| 4457 CCCTCGCTCACCTTCTCTTC | 16115 TGCCTGTTATGCACAAGCACTA | 27099 CTCCACGAAGCATCTGTTGACT | 38083 |
| 4458 TGACACTGACCGGTGTGGAT | 16116 GGGGCAGCTGGAGACTGGAT | 27100 TGGGGACTTGGTGTCCACTGA | 38084 |
| 4459 CCTATCCCATTCCTCACAGCCATT | 16117 AGGGAATGGGGAATATTGAATGCTT | 27101 TCTGGATGACGAAGCCCCTATC | 38085 |
| 4460 TGGCTGGAAGCTAATTTTGGTTTG | 16118 GGGTGGGGCTCAGTGTTGA | 27102 CAAGCAGCTCTTGGCTGGAA | 38086 |
| 4461 GAGGCCACCTACGGTATTCAAAC | 16119 GCAGAGCAGGGTGAACAGT | 27103 CATGTTACCCAGAGGCCACCTA | 38087 |
| 4462 GACTCCAGAACAGAAGGGTCTTG | 16120 TGCCCAGGCTTCTTGGTGTT | 27104 GGAGGGGACAATTGCTGTGTGA | 38088 |
| 4463 AGAAGCCTCCCCTCCCTCTGT | 16121 AGGAGGATGGGGACGAAGGAT | 27105 CCTTCCCTAAAGTCCCAGGAGAGAAG | 38089 |
| 4464 GTGGCTAGAGCTTTGAGCCTATG | 16122 GTTGCTGACAGGTCAGTGTCT | 27106 TCTGTCCAGTGGCTAGAGCTT | 38090 |
| 4465 CCAGCTGGCCTGACACTCAAA | 16123 CCCTAGGCCACTGCAGCAA | 27107 CGGATGCTGCAGGTGGAATCT | 38091 |
| 4466 GTCCTGGCTGGCTAAAGGTTGT | 16124 GACAAGCCTGGGGAAACTGT | 27108 CCCACAGACTCGCCAGAAA | 38092 |
| 4467 GGGCTTCCCAAACACACAATC | 16125 ACGCAGCACCCAGAGGTAAT | 27109 AGGTGACTAGGGCTTCCCAAA | 38093 |
| 4468 ACAACAGATTACAGGAGCACAGTTA | 16126 TGTGGGCCACCTCTTTTGAA | 27110 CAGGTTTGGACTTGAGTCAACAGA | 38094 |
| 4469 GGTGGATGAATGCCCTGTCAAC | 16127 GCCTTTTGTGCAGTGGTCAGCAT | 27111 TGGCTGAGGAGGTGGATGAATG | 38095 |
| 4470 TGTGGGCCCCTGGAGCTACT | 16128 TTAGGCCCCACTGCAGATCA | 27112 CCGAAGGCCTCTGGGCTTTA | 38096 |
| 4471 GCGTCCGTGTCACTAATTTTCTTG | 16129 GGGGAACCACCCAAGGTTCTTT | 27113 ACATGTGCGTCCGTGTCACT | 38097 |
| 4472 TGCCCCTCCTGAAACCACATTC | 16130 AGTGGCACTTCCACCTGTGA | 27114 TCCAGTTGCCCCTCCTGAA | 38098 |
| 4473 CATGGCTGGAATGAGTCAAGTGCTA | 16131 AGACCTCAGAACGGAGTTGTTC | 27115 AGGGGATATCATGGCTGGAATGAGT | 38099 |
| 4474 TGACTCCTGGGAAGCTAGACTTAAA | 16132 AGCCTGACAAGTGACTGT | 27116 AGGCTGGCACAGGTATGACT | 38100 |
| 4475 TCTGATTATGAACCCAAGGCTGTT | 16133 CACGAGCACCAGGCATCA | 27117 GCGAGGCTGGGCAGTATCTGATTA | 38101 |
| 4476 CTCCCTGTCTGCATCTTTCCTTAT | 16134 GGGCAAAGCTCTTGAGACCGAA | 27118 GTTGCATCTTCATCTCCCTGTCT | 38102 |
| 4477 TGAGTGACCATCCACTGACAAG | 16135 AGTGAACGCTGTGGGTTTGTT | 27119 TGGTGGATGCAGCTGGTATG | 38103 |
| 4478 GAAGTCTCCATGTAGCCACTGAAT | 16136 CGAAGAGCCTGGGGTAGTTTTG | 27120 CCACAGAAACACTTCTCGCTGAA | 38104 |
| 4479 GCTCTGTGCTTTGGGAGACTGT | 16137 AGTGTTCCGCTTGGCTGGTA | 27121 GATATGCTGAGCTCTGTGCTTTG | 38105 |
| 4480 GCCAGGAAGCATCCATCAGACA | 16138 GAGAGAACGGACAACTTTTCCCAACA | 27122 GACTCGATCTAGCCAGGAAGCAT | 38106 |
| 4481 GCCACTGGAAAACCTGCATGAATGA | 16139 GCAGCCTCCACAGAGAACAT | 27123 TGCTGTGTGCCACTGGAAA | 38107 |
| 4482 GCGAGGACTAGCTTGCCTCTTT | 16140 CCTGCAGCCAAGTGCTTACTCT | 27124 TCAAGAGGAAAGGCGAGGACTA | 38108 |

FIG. 36G9

| | | | |
|---|---|---|---|
| 4483 ACTGCTGTGTTGCTAGCACTT | 16141 TTGAGCAGCTACCATATTCACACA | 27125 GGCAAGAACCCTGTGTGTTCTTC | 38109 |
| 4484 ACAAGGCATCGCCACACCAT | 16142 CACATGCACACACATCGGATAGA | 27126 AGGCTTGACTTGGGGAGGACAA | 38110 |
| 4485 GCCTACATTCCTCCATCAGCTT | 16143 ATTTTGCCCCAGAAGCTACAGT | 27127 GCTCTTCTAGCTTAGGCCTACATTC | 38111 |
| 4486 ACAATCCACCCCGGTCTTCT | 16144 GCTCAGACCCTTGTGCTTCTCT | 27128 CGCAAACAGCAGCTCTGAGAAA | 38112 |
| 4487 GTAGCAACTCTGCAATAGTCTTTCCTT | 16145 GAGACTGCATTGGCGTACTGA | 27129 GGTACAAGGGGTGTAACCATAACAGT | 38113 |
| 4488 CCTTTCACTGCTTGCTGTGGGATA | 16146 GCCACCTTTCCTCTGCAAGTT | 27130 GCCATCATTTCCTTTCACTGCTT | 38114 |
| 4489 CGGCCTGCAGAATCCACACTATT | 16147 TGGCAGCAAGAGGACTGACA | 27131 CAGAAATAGAATGTGAACCCAGGTAGT | 38115 |
| 4490 GGCCTTAGTCATTGCGCCAAAC | 16148 GGATAGGACAGTAGCCATGGAGTT | 27132 GGACAACTAGCCTGGCCTTAGTCA | 38116 |
| 4491 TGTGTCGACCCTTTCCTCAAAC | 16149 GCTTTTTGTAGGAGTAAGAAGGGAGAA | 27133 CTGGTCCTGGAATGTTCTGTGA | 38117 |
| 4492 TGCAACTGGGAAGGCAAAG | 16150 GGACACCCGAGACCTGTGCTA | 27134 CCTGGAAAACCAGGTGAACCGATCT | 38118 |
| 4493 GGCAATGGCACTACTGGTACA | 16151 CCACCAGCTGCTTGGCATA | 27135 CAGCCCAGCACACTGACAAT | 38119 |
| 4494 GCCACAAGCTGTGAGCTGTCT | 16152 CCTGAGCCTGGCCTGAGATG | 27136 GCAGTGGTCCTGAGCCACAA | 38120 |
| 4495 TGGCGGGGATGGGGATCTCA | 16153 GGTCCACGTCCGTGCCTTTATT | 27137 TGCCTGCTACCTCCTTTCAGT | 38121 |
| 4496 GGGACCCTTCTCAACTCTACTCTCT | 16154 GGGAAAAGCACGTTTGTTCAGT | 27138 GAACTCTGGGACCCTTCTCAAC | 38122 |
| 4497 GCTCCTGGGAAGACATATGCAA | 16155 GCTTCTCTTTCCTCTCCGAACA | 27139 GAGAGAAGAGCTCCTGGGAAGA | 38123 |
| 4498 TTCTGGCTCCACTACTGTGTTAC | 16156 AGGCTCAGGGAGGTTAGGATAC | 27140 GGGCTCAAATTCTGGCTCCACTA | 38124 |
| 4499 GGGAGACACTGAAAAGCAAGACT | 16157 CCATGTCCCTGGCACTCTGTTT | 27141 GTCACTGTAGTGGGAGACACTGAAA | 38125 |
| 4500 ACAGGAAACCCAGAGAGTTGTAATAG | 16158 ACTTTGGGATTCTGGAGGACAGA | 27142 TGGGCCTGGCAGAACAGGAAA | 38126 |
| 4501 GTGCCCTGTGTCACAAAAGCAA | 16159 AAAATGCCTCTGCTTCTAGGATGA | 27143 TGGCATGTGCCCTGTGTCA | 38127 |
| 4502 GCCTGTCTCTTTCCAAGGCCTAA | 16160 AACGTGACAGGAAGGACACTTT | 27144 AGGCTGATGCCTGTCTCTTTC | 38128 |
| 4503 TGCCCCAGATCTGTCCAATGA | 16161 GCTACTTGGATAGGCCTTGCTTTG | 27145 GGGAATAACCAACCCCATGGAGCAT | 38129 |
| 4504 TTGAGCTGAGAGACAAACGCTTA | 16162 ACCGTGCCCAGCCTTGTT | 27146 GCAGGGGTGGGTTGTTTTGA | 38130 |
| 4505 CCCAGAGCCACACGCTCAAA | 16163 TGTGCAGCTGGCGTGAAT | 27147 GCTCCACGATGCGCTCCTT | 38131 |
| 4506 TGGTTGCCTTCCCAAATTCGTA | 16164 AGGCCCCACTTCTTGGGATT | 27148 CCAGTTAGGTACTCCTGTGGTCTGA | 38132 |
| 4507 TGCCTTTTCGTGCAAAGCTAAC | 16165 AAACACACTGGAAGCCTGAAGA | 27149 GCTGAAGCCCTAGGGTTTGCCTTT | 38133 |
| 4508 GTGAAGGGAAGGGCAACTGT | 16166 ACGCGGCAGGTGCCTAGGAT | 27150 GGCTAGCAAACACCTACAGTTGTGA | 38134 |
| 4509 CTGCAATCACAGAACCAGTCCTAGA | 16167 GGAGTCCACCTCACCGACTTAC | 27151 CCCACGGTTCTGCAATCACA | 38135 |
| 4510 CCCAGCTCCTTTCCCTCACAT | 16168 TGGACAGCCTCTGCTGCAT | 27152 ACATCCACTTCCCAGCTCCTT | 38136 |
| 4511 GCTTGTCACCATGCCAGATCCTT | 16169 TCAAATTCCTGCATAGGGCAACA | 27153 GCCCTACTGCTTGTCACCAT | 38137 |
| 4512 GGAATGGAGCCGTGTGTCAT | 16170 CCCTGGTGGGCACTTCAACATT | 27154 CAGCTACAAAAGCCTTTGGGAAT | 38138 |
| 4513 CCCCTAACTATGGAGAGCCAGAA | 16171 TTCCCCAGCAGAGACGGTGAA | 27155 CAGAAATGCCCAGTCCCCTAAC | 38139 |
| 4514 GCAGGACATTGCCAGGGCTTT | 16172 TTTCCAGAAATTCAGGCCACTTTG | 27156 CGGAGGCATGATTGCAGGACATTG | 38140 |
| 4515 GTGGGTAAGCTGTGCTGTGTTG | 16173 CCTCGGGTTCCAGAGTCTGTTG | 27157 AGCAGACAGAGCAGTGGGTAAG | 38141 |
| 4516 AGGCACCCTGAGGTGGGTTAG | 16174 CTCACTTGACAGGGACAAGAAGT | 27158 CCTGGCTGGCAGCAGATCA | 38142 |
| 4517 GGAGTGTTGGCACCTGTTCA | 16175 AGGCACCGCATACCCTGAAGT | 27159 TGGTGAGGGGTGGAGTGTTG | 38143 |
| 4518 GGGTGAACCAGCAAGCTCCAAA | 16176 TGCTGAGCTGATGGGTTGTAG | 27160 TCCAAGTCTGCAGGGTGAAC | 38144 |
| 4519 CAACAACACTGGCAGAAGAAATGTA | 16177 GGGAACATGCTGGAAGGATTCTA | 27161 TTGGCCTGCCAACAACACT | 38145 |
| 4520 GGGAATGGAACTCAACCATGGAA | 16178 ATGCTCCCAGTTCCCTCTT | 27162 GGACAGTGTGGGAATGGAACTCA | 38146 |
| 4521 GGATTTCCTCGAGATGCATGTGA | 16179 AGGCGCAGCCCTTCCTCAA | 27163 CCCGCCATTTACGCGTGGATTTC | 38147 |
| 4522 AACTGGCATGGTGAGCTGTATT | 16180 GCTTTGAAGAGCGAGGTCACA | 27164 GTGCAGAGTTCCCAGTGCTAT | 38148 |
| 4523 CTCCGTCACCTCTGTCTGTAAAGT | 16181 CCAAGAGGCAGGCATTACCAT | 27165 TGGCTCCGTCACCTCTGT | 38149 |
| 4524 CAGGCAGTGACAACTCAGTCT | 16182 GCTTTTTGGGGCATGCAGTT | 27166 TACCAGGACAGGCAGTGACA | 38150 |
| 4525 CCTGGCCTTAGAGGCAGCAT | 16183 GCAATGCCAGAGAGGCAAGA | 27167 CCAGTTCCAAGCCTGGCCTTA | 38151 |
| 4526 TCTCCCCTTAGGGCGTTTGT | 16184 GGAAAGTTGTGCCAAGGCAAAGAGA | 27168 GTGTGTGTCCATTCTCCCCTTAG | 38152 |
| 4527 ACAGACCCAGACTCAGTGATGA | 16185 ACAGTCCCAGCCTGACAGTTC | 27169 TGGCTGGCAACAGACCCAGACT | 38153 |
| 4528 TGCCATGGAAGATGTGCGATT | 16186 CGGGCATGCTTGCTCTGT | 27170 GGAACATGCAGCAGCCTCATATTTG | 38154 |
| 4529 CCAGACACTGAGTTAGTCACGTT | 16187 CCCTCCCTAGCCAATGCTTAAC | 27171 GGAGGAAAAATAAGAACCAGACACTGA | 38155 |
| 4530 CCAGTGCAGTTATCTGGCACACA | 16188 GTGGCCCATGTTGGAGAATGA | 27172 CCGGGAAAACCAGTCAGT | 38156 |
| 4531 TCTGGAAAGCCGACCACTGT | 16189 GCCTCCAGGTACTCATCCACTTGT | 27173 GCTCTGGAGTCCTTGTTCTGAAAG | 38157 |
| 4532 TGCTCCTTCATGCCACCTAGA | 16190 GGAAAGAAGGCTAGTGGTAAGAGACA | 27174 GCTATTTGATGGCATTGCTCCTT | 38158 |
| 4533 AGCAGCTGCCAAACCAAGTAA | 16191 CGTTGAGGGCAGGAGGGAAAT | 27175 TCAATAATCAGGCTCTGGGAGGAA | 38159 |
| 4534 GGGCTAGTGTCCATAGGCTCAA | 16192 CAACTGTGCCAGGGGTCCTAAA | 27176 AGACCATCCAGGGGCTAGTGT | 38160 |
| 4535 CTGGGCCTGATGGGACTTGA | 16193 CAGCCCCTTGCTGGGAATCA | 27177 GTGTGTTGGGGACACAGCAA | 38161 |
| 4536 ACTGGTGTGTTAAAAGGGAGTTTGT | 16194 GCCTCCTTGCCAGTCACCTA | 27178 GGCTTTTTAACAGGTAGAACTGGTGTGTT | 38162 |
| 4537 GGTCTTGTCAGGAGTTTGAGCCTAT | 16195 CCACACTGTGTTGGCCAATGT | 27179 CTCTGTATCTGGTCTTGTCAGGAGTT | 38163 |
| 4538 CTTAAAACCCTTTGCCTTCTTGCTA | 16196 CGCCACTGGAACCAGAACT | 27180 GCTCCCGTGGTCATCTGTGTTT | 38164 |
| 4539 AGTGGGAAAGACCTCGGTGACA | 16197 TGGCTTGCGTGGGTGGGTTCAA | 27181 TACCCCTGGCCGCTGTA | 38165 |
| 4540 GGAGGTCAATGTCAGGGGTCAGA | 16198 CAGGTGCTCCAGGCTGTGAT | 27182 GGTCAGGGTAGGAGGTCAATGTCA | 38166 |
| 4541 CCCACAGGACAGGGACTATGT | 16199 GTGCTTTTGGACCACTCCCTTTG | 27183 CCATGTTCCCCTTTGGACTAGAGTT | 38167 |
| 4542 GACCCCAGAAAGAGCCAAGTCT | 16200 AAGGTCCAGGGAGTGGACACA | 27184 CCTCCGTGACCCCAGAAAGA | 38168 |
| 4543 GAGAGGTTTTGATCTCTCGGAGTTG | 16201 GCGACGGGAGGAGTTGAGTTG | 27185 CCCACCAGATTTCTTCCTTCCTGAGA | 38169 |
| 4544 CAATTAAGAGGGCTCCTGGAAACT | 16202 GCAAAGGGAAGTCCAGAGGAAAC | 27186 CAGCTTGTCGCTGGAGCAAT | 38170 |
| 4545 CAACAGCAGGGTTCACACAAC | 16203 CTAGGACAATCTCACCCCACAAG | 27187 CCCAGCCCCAGGTTTACAACA | 38171 |
| 4546 ATTGGCATGGCAAGTCTATGGAACA | 16204 CCATGCAGCAAGGGCCTAT | 27188 GCTGGAGTTTCAATTGGCATGGAGT | 38172 |
| 4547 GGCAGCAGTGATAAGAACGGATTG | 16205 CAGCAGCCTCTGGTCTCTTC | 27189 GGCTTTGGCAGCAGTGATAAG | 38173 |

FIG. 36G10

| | | | |
|---|---|---|---|
| 4548 CGTGGGTCTGAAACAGGAACATTG | 16206 TGGCAGGGTTGGGGAGAGAT | 27190 AGGAGACGTGGGTCTGAAACA | 38174 |
| 4549 CAGGCAATGTGGTTTTGGCTTA | 16207 AGCCACTGCACTGGGCTTA | 27191 GCCAGCCTACATTTATCAGGCAATG | 38175 |
| 4550 GCCCCTCCTTCATTCACTCAACT | 16208 CCTGGCCCAGAGTAGGTGTTTA | 27192 CCTGTCAGCCCCTCCTTCAT | 38176 |
| 4551 GATTGGGACTGTGCCTCTCAAAG | 16209 TGGGAGAGGCATGTGGAATGA | 27193 GGGCCAGGCAGATTCAGAGATTG | 38177 |
| 4552 CATCATCTCTTGCCTGGGTTATTGTA | 16210 GGATGCAGGGACATCAGCTAAG | 27194 GACCAAGTTGCCATCATCTCTTG | 38178 |
| 4553 GCACTAGAAGTGCACCTTGACTGT | 16211 TCCCCTACCCCAACCCTAATTAAA | 27195 ACCCTCCAGGCACTAGAAGTGA | 38179 |
| 4554 GGCCTCTTTAGCAGCCCTTATC | 16212 AATGGGCACAGCCACAGGTT | 27196 ACCCGACAGCTCAGGTCAAT | 38180 |
| 4555 GCCCTGCCTCTAAACAACCACATA | 16213 GCCCAGCCAGGCTAAATGACTT | 27197 TGCGCCCTGCCTCTAAAC | 38181 |
| 4556 CCCACTGTGCTCAGCTCTGTTT | 16214 CCTGAAGCAGGTTTGGAAGACT | 27198 CCTCTCTGTAATGCCCCACTGT | 38182 |
| 4557 CTTGCCAGTTCACCTGACTGTAT | 16215 TGGGGCCACCTACCTGGATA | 27199 GGTTGCCTCTTGCCAGTTCA | 38183 |
| 4558 CAGCCCAAAACTGGTAGCCAAT | 16216 CAGCCTGGCACTCAAAAACTGA | 27200 CAGGGAGGAGCAACACAGTTCA | 38184 |
| 4559 ACTGTCGGTCAGGATCATTTTGAA | 16217 GGTGTGGGGAGACCTCTATGTT | 27201 TCAACCACTGTCGGTCAGGAT | 38185 |
| 4560 CCACTGGTCTCTCACTCTTCACT | 16218 GGGGCATTCCAGGCCCTATT | 27202 TTCACGCCACTGGTCTCTCA | 38186 |
| 4561 GCATGCAAAGGTCCACAACAT | 16219 CCACATGGGCTGAAGGGTTCAT | 27203 ATCACCTAAAGCAGCATGCAAAG | 38187 |
| 4562 GGGGCAGGGAGATGAAGAAACT | 16220 ACCCCAAGGAGGAACCAAGT | 27204 AAGTCATGGGGCAGGGAGAT | 38188 |
| 4563 CGATGACTGAACCTGAAAGGTGAT | 16221 GTCGCGGTATGAGGGAGGATT | 27205 TCCAAGCCAAACGATGACTGA | 38189 |
| 4564 GGGAGGACTGCTGGAGGAAT | 16222 TGAGTGCTTGATGTTTCCCTTCA | 27206 TTGCCCCAAGCAGCATCA | 38190 |
| 4565 TACCCCAGCGTGGAGACAGT | 16223 TCTGGCAGCTGGCTTCTTG | 27207 GAGGCATCTATACCGTGAAGAACTTG | 38191 |
| 4566 TAGGTAGGGCCACGAGGAGTAG | 16224 CTGTCCCAGGCCTTTTGTGT | 27208 CCTGCACACAGTCTGTTGGATAG | 38192 |
| 4567 GACTGTGGGACTCTGTGCAA | 16225 GAGTTGAGTTTCGAGTGCAAAACTTG | 27209 GCCAAGCATGGAAACCATTTGACT | 38193 |
| 4568 GACACCATCGGGAGACAGATTAC | 16226 GTGGTTTTGTCCCATTCCCTCTTT | 27210 CGTGGGAGTCCATGACACCAT | 38194 |
| 4569 CCAGCATACTTGTGACCTGAGAGTTC | 16227 TGGCTGACCAGGGGCATCTTT | 27211 CCCCAGACCAGCATACTTGTGA | 38195 |
| 4570 CTGTATAGGGCTCTGGGGTTATAAAG | 16228 GCCATGTCCCTGGGATCTGTCTA | 27212 GGGCTCACCATGGATCATTATCTGTAT | 38196 |
| 4571 CCTGTGCAAGTTCCCAGAGAGA | 16229 TGGGTTCGGGGCCCAACAA | 27213 GAGGGAAAGTGACCTGTGCAA | 38197 |
| 4572 CAGAGCTTGTACTTGGACCGATGT | 16230 GCATTTCTGTGGTGGGATAGTGT | 27214 GTCTGACTGCAGAGCTTGTACTTG | 38198 |
| 4573 GTTGATTTTGGTGGGCTTCAGTT | 16231 GTCTGCCTCACTAGTGGCCTAT | 27215 CACTTCCCAAGCTAAAGGGGTTGA | 38199 |
| 4574 GCATCTGCAACTGTGTGATCTTG | 16232 GGGAAACAAGCACAGACTCCAA | 27216 AGCCAGCATCTGCAACTGT | 38200 |
| 4575 CAGCCTAGAAGCCCAGTCCATT | 16233 GGGTCACTTCCTCCTTGGATTC | 27217 AAGGGCTTTAACCAGCCTAGAAG | 38201 |
| 4576 AGCACTTGCCACTGTGTGT | 16234 GGGAGTCGCTATTTACCGAGCTTT | 27218 CACAGTGCACAGAAGCACTTG | 38202 |
| 4577 CCTGCCCTTTGCTGATGAAAC | 16235 ACCCTGGGCAAGACACTCT | 27219 TTGAGACCAACCCTGCCCTTTG | 38203 |
| 4578 AGCGATGCGGGGAAGACTTT | 16236 GCGCTCAGCCATTTGCATCA | 27220 CGGCTCTTCACTGCTCTACTGT | 38204 |
| 4579 CCTCAGAGCATTTGAGGAACAGAA | 16237 ACCGCCCCAGGAAGCTTAG | 27221 GGAACACACAGCCTCAGAGCAT | 38205 |
| 4580 AACGTCATCTCCACCAATGAACT | 16238 GCTGCACAGGGCTCAAAGCTAGA | 27222 CTCCAAAGAACACTGCCCAGTAA | 38206 |
| 4581 GGTTGTCAGCACTCTGGACAAAA | 16239 AGGAAACCAGATCTGTGCACTTG | 27223 GCTTCCTGTAATGGGTCTAAGGTT | 38207 |
| 4582 CTGGGGTGTATTTTAGCTTCAGAGT | 16240 TGGGTGAGGCTACTGTGAGT | 27224 GCAAGGAAGTAATTAGATCACTGGGGTGTA | 38208 |
| 4583 GCCCCTCAGGTTGTGTTTCT | 16241 GTCAAAGGGGAAGCATGCAAAG | 27225 GTGGGTTGTTGTAAAGCCACGAT | 38209 |
| 4584 CTCTTCTGAACTCCACACTCACA | 16242 TCCAAGAAGAGGTGTGCAAAATGA | 27226 CGAACCCACACTTCTCTTCTGA | 38210 |
| 4585 GGGAGAGGCGTATTCTGTGATG | 16243 CAGTACCTGGCCCATAAAAGGTAGT | 27227 GAATCAGAATGGGAGAGGCGTAT | 38211 |
| 4586 AGTAAGCCAGATGCCCAATTTGT | 16244 TTCAGCTGTTTCCACCACAGT | 27228 CGGCCTTAGCCATGGGAAATCA | 38212 |
| 4587 CCTTGTCCAGGCCATGTGT | 16245 AGGAGAGAGGCGGAAGGAACAA | 27229 GTGGGGAGACCTGCTATCTTCTAC | 38213 |
| 4588 GGTAATATCCAGTCCATCCTTACTTCTGT | 16246 CAGCCCAGCAAGCCTCCAA | 27230 GCCAGGATGGTGGATGATGGTAA | 38214 |
| 4589 GGGATTCAGGCTCCTTTCATCTTG | 16247 TGGAGGTCAGGTACTGAAGACA | 27231 CCTCTTTGGTGACTCAGGGATTC | 38215 |
| 4590 GGGGAGGCAGACCTGGTTA | 16248 ACTGGACTCCTCTCCCCACATT | 27232 GGCTTCAAGAGCTTCCCTGTTG | 38216 |
| 4591 GCTGAACGGTTCCTTATCTTTCATC | 16249 GCCCAAGAGGCAGGCATCAA | 27233 GACCTTGCTGAACGGTTCCTT | 38217 |
| 4592 GAGAGTTTGGCGCAGAGGAGTAAG | 16250 GCAGCTGTTTCAGCGAATAGTTCT | 27234 TGGAAACGGGTGTGAGAGTTTG | 38218 |
| 4593 TCCTATCCCTCCCCTACCACTT | 16251 ACTTGTGATGACAAAGGGAAGGAA | 27235 AGGCAGAATTGACGTTCATCCTAT | 38219 |
| 4594 CGTGATCTGACTCTGGAATGACCTT | 16252 ACAGACGGTGGCGTCATCAA | 27236 GTGGTTCACAGCCGTGATCTGACT | 38220 |
| 4595 GGTACCTCCCAGATGTCCATTTC | 16253 CTGGGTGTGTAGTGCAGTCAGTTC | 27237 GCACAGCCAGGCTCACCTTTGA | 38221 |
| 4596 GTTATGGTGGGAAGAGTGGAGTATG | 16254 TCCCTCCAGAGCTTCACAGAA | 27238 TCAGTGGGCTGGATGGTAGT | 38222 |
| 4597 CTGGCTCAAGCTCCCTTGTGAA | 16255 TGAGGCTCAGACAGATGATGTTG | 27239 AGGCCAAATCCTGGCTCAAG | 38223 |
| 4598 GCAAGATGTGCCCACCACACAA | 16256 AGGGACCCGTTTCAGTTCATC | 27240 TGTTGCTGTCTGGCAAGATGT | 38224 |
| 4599 GGCAGGGAGGTACCATCTTCTTG | 16257 CCCCTTTGATGCCACAGTTATTTC | 27241 TGGCTTGGGGCAGGGAGGTA | 38225 |
| 4600 CCTCCACTACTGGTCCTACCAA | 16258 CCAGACTATGCCACAGGGCTAATG | 27242 CTAATTGTGTTCCATACCTCCACTACT | 38226 |
| 4601 GAGGAGAGGACACCAGACTTGTTG | 16259 TTGCCTTTGCCCGCACATC | 27243 AGTGCAGAGAGCAAATTTCAGGAT | 38227 |
| 4602 GGCCATTGCACTTGCTACTTC | 16260 AGGACCACGGGCTGCAGGTA | 27244 AAGGCCTGACTTGGCCATTG | 38228 |
| 4603 GGACACCCTCCACTGGTAACACTAAG | 16261 TGTGCCCAGGGTTGCACATA | 27245 TCTTTGTTCAAAACGCCCAGAAC | 38229 |
| 4604 CAGCCCCTGGCTTTATGTTCACT | 16262 CCTTCTGCTCAGGCAAAATG | 27246 CACAATCTCAGCCCCTGGCTTT | 38230 |
| 4605 GCTCATTCCTGGCATCCCTTGT | 16263 CCTTCACTCCTGGGTGAGGAAT | 27247 CCCAAGGTGCCAAGCTCATT | 38231 |
| 4606 CTCAGAGGGCCTGATCTCAATGT | 16264 GTAGATTAGCATGAGTGGGAACTGA | 27248 TGATGACAGAGGAGTAAAGGTCTCT | 38232 |
| 4607 GTGGGATAGATCCCTGCAGATTC | 16265 AGTTCCTCCAGGAAGGTGCTA | 27249 GGTGCATGCAAAGAGTGGGATAG | 38233 |
| 4608 TCTTTCTGAAAGCATGCCTAATCT | 16266 ATGCCGGTGGGTTTATGAAT | 27250 CTCAGCCCTTCACCTTCTTCT | 38234 |
| 4609 CCCGAATCCCACCTTTGAGGGTTTA | 16267 CGGAGCACCACCAGGATTGTT | 27251 CCCATCCCGAATCCCACCTTT | 38235 |
| 4610 TAGCAGGGGACTGGGCATTCAA | 16268 CTTGCCATGTGCCAAGTTCTGA | 27252 TGGGAGTACCTGGATCCCCTTAG | 38236 |
| 4611 GGGATAGAGGTCAGACACAGCAGTT | 16269 TCTCGCCCACTGTCACCATGA | 27253 GGCACACGATGAAAGGGATAGA | 38237 |
| 4612 TTGGGCGGTTTGCTGTGT | 16270 CACCAGGCCCTTGTACTCAGAT | 27254 AGGACCACAGCAGCTTCGATTC | 38238 |

FIG. 36H1

| | | | |
|---|---|---|---|
| 4613 GCAGGAACCATACCAACTGCTCTT | 16271 CACATTGGGACCCAGGACTAAG | 27255 GTCCAGAAGGCAGGAACCATAC | 38239 |
| 4614 GCCCTAGCTCCATCTGTCCAAT | 16272 GTACAGCCCCAAACATGACTCT | 27256 TCAGGGTGCCCTAGCTCCAT | 38240 |
| 4615 GCAGCCTTTGCCTTTTGCTAAC | 16273 GCGTAGTCCAGGCCCTAGAGA | 27257 CCCAACCACAGCAGCCTTTG | 38241 |
| 4616 GATGACACTGGGGTCGTGTGATAG | 16274 CCCCAGCCTAAGGTTTGTCCTT | 27258 AGGTTCCCTGCCTTAGGGATGA | 38242 |
| 4617 CTCCCCTGCATCTAGGTGTTTAC | 16275 CCCTACCCACACCACACAAAA | 27259 AATCCTCCCTCCCCTGCATCTA | 38243 |
| 4618 GTGCAAGACAACCACTGGTGAGA | 16276 CCCTCCGCAAGGGGAAATGAAA | 27260 CCATCCTATATGTCAGGTGCAAGACAAC | 38244 |
| 4619 CCTGTTGCCTCTGGAAACTATCT | 16277 CCAGATGAGCTCCCAGGACTTTG | 27261 GGAGGTAGCAGCATTTACCTGTT | 38245 |
| 4620 TCCCCAGCTCCAGGGAAGAA | 16278 TGGTGGACAGGAGTGGGAAGTT | 27262 TCTCCAGCCGAGGGTCTCA | 38246 |
| 4621 TTCTGGGAGTGAGACCGTTTG | 16279 GTTTTCCTCCACCCCTTTTCTCTTC | 27263 GGGAGTGTAATTCAGGGAGTGTAATTCT | 38247 |
| 4622 CCGGCTCTAAATCCTGGCATTTTC | 16280 CCTGCCTCTCGCCATACTCATC | 27264 TGGTCAGCTCCGGCTCTAAATC | 38248 |
| 4623 CCCTGCTAGGAACAGTCTGATGAA | 16281 CGCACACCCTATTGGGAAGGAA | 27265 TACCGTCCTCCCTGCTAGGAACA | 38249 |
| 4624 ATCTGGGCCTCCTAAGGTCTTC | 16282 CCTCTGCTAGTCTCCTGAATGTTG | 27266 CCACTGCAGTTTACAGTGTGAAGCAT | 38250 |
| 4625 ATTGGCAGCACGAACCCAGACA | 16283 GCCGCAGTGGCTGATCCAT | 27267 GCCTGGGGAATGCTACTGATTG | 38251 |
| 4626 AGAACAGGCCCTAGAGCTGGAA | 16284 AGTTGAGAAGCAGGGACTTGAATC | 27268 GGACAAGGACTGTGTAGAGAGAAC | 38252 |
| 4627 GTCCAGCCCTTCACTAGATGTTAG | 16285 TGATTTTCCCAGGGTCTGTGTCT | 27269 TGTGGTGTCCAGCCCTTCACT | 38253 |
| 4628 TTGTTGGAGGGCGAGCAGTT | 16286 CAGCCACTCACTGACCTTGACA | 27270 GTGTGTCCGAGCACATTGTTG | 38254 |
| 4629 GGAGTTTCTCATTTTCTTCCAGGCAAT | 16287 AAAGCCGGCCACCCCAACA | 27271 GGGGCACGTGGAGTTTCTCATT | 38255 |
| 4630 GACCTTGGCAAAGTGACCTCATC | 16288 AGCTCAGCCACTCCAGACAAG | 27272 TGTAGTGATGGTGTTTGTGACCTT | 38256 |
| 4631 GCCTTCTGGAGTGGACAGGAA | 16289 AATCACCATGTTACCACCACCAT | 27273 GGAGGGCACAAAACTGCCTTCT | 38257 |
| 4632 GAGTAGGAGGTGAGGTGTGCTGAT | 16290 GCGTGGGCAGAAATCTTCA | 27274 TTAGCAGGAGGTGGGCTGAGT | 38258 |
| 4633 GGGATGGAAGGCTGGGGAATG | 16291 TCAGAGATTGGATTTCGGTCGTT | 27275 AACTGGACGTGGGGATGGAA | 38259 |
| 4634 TCTGTAGCAGCAGCAAATTGAGA | 16292 GGAGGTTGCCTCCTCTTCCTAAG | 27276 ATGCTACCCCTGGCCCTCTGTA | 38260 |
| 4635 TGCTCCCTCTGGGAAGCAT | 16293 ACAGGGCGGTGCTAGCTTGA | 27277 TCCCTCTGGCCCTGTGGTT | 38261 |
| 4636 ACAAAGTGGAGAATGGGCTGAAC | 16294 CCACCCAGTGCCTGAAAGTAAAG | 27278 GCTGCATCTTCACGCCTACA | 38262 |
| 4637 TGCCCGCAGCAGCTTCAT | 16295 CCCATGCTACCCTCACTCT | 27279 GCCCAGTTTTAGGGACCAAAGACCAT | 38263 |
| 4638 CCTTCTTCCTGCTACGACCTTCT | 16296 TGTTGAGATGAAGCCAGCAACA | 27280 GAGTTGGTCTCCAGAGAATACTTCCTT | 38264 |
| 4639 GCCCACACTCTTAACCTCTGCACTA | 16297 AAGGATGGCAGGACCAGTGT | 27281 ACCTCCAGAGCCCACACTCT | 38265 |
| 4640 CGTTGTGGGACAAGGTCTAAACA | 16298 CAATGTAAGCCAGTGACAAACTGT | 27282 GGGAGACTTCGTTGTGGGACAAG | 38266 |
| 4641 CCAGGGTTGAAGCAGGTTGT | 16299 CCGGAGCTCAGCAGATTTCA | 27283 CCGGGCCCCTTTAAGGAAGAAGT | 38267 |
| 4642 GGTTGAGCACTGTTCCACACA | 16300 GGGACAGGCTGCGACACTATG | 27284 GGGAACAGGTGTCCTTTCCAGGTT | 38268 |
| 4643 CTGGACTCAGGCAGTGCTTTGT | 16301 ACGTGGGTGACACCAGATGA | 27285 CCAGCAACTTAGGCTGGACTCA | 38269 |
| 4644 CTGTGTCCCAATTTCCCATTTCAGTTC | 16302 AAGCCACCGAGGCCTAACTCT | 27286 CCTCCTTATGCCACTGTGTCCCAAT | 38270 |
| 4645 GTCCTCTGTAGCTCAGACACTGTT | 16303 GGCCAACTCCCTCTCCCTACA | 27287 TCCGAGGCAGGCAACTCTACA | 38271 |
| 4646 GGTGGTTTGCTAAAGACCACCTGTA | 16304 AGGCCCAGGCAAGAAGGAAA | 27288 GACTCCATAATAAAAGTGGGTGGTTTGCTA | 38272 |
| 4647 TGCCCACACCTACTGCCATAC | 16305 AGCCCACGATCTGCAGGAA | 27289 GAGGAGCTGCCCACACCTA | 38273 |
| 4648 CTCTGTCTCCCAGTGGTCAGTCT | 16306 GGTGCCACCCCAGAAATCACA | 27290 AGCTCCCGCTGGCTCTGTCT | 38274 |
| 4649 TTTGAAAGCAGGAACCAAGAGAGTA | 16307 GCCATCCTTACAGCAGGCTTAG | 27291 GGAGGCAGCACCCTTTTTGA | 38275 |
| 4650 CCCCAGGCAATTGGGACAAACT | 16308 TCCTGCACACCTCCTGGACAA | 27292 TGTCTCCCTGTTCCCAGTGTCA | 38276 |
| 4651 CCCCTGAGTCACACCAGTTG | 16309 GAATCATACCTTGGCTTTGAGGTAGA | 27293 CAACACCCCTCCCCTGAGT | 38277 |
| 4652 ACACACATCTGTCTGTGTGATGA | 16310 TCCCTGCATGCCCGAATTT | 27294 GGGACAGATGGGATGAAAACACA | 38278 |
| 4653 CCCTTGGCCCCTATGACATCAA | 16311 ACCATGGCGCCTGCAAAAAG | 27295 TCAGAGGATGAAGGGGACATTTTC | 38279 |
| 4654 GGGCCTCCCATTGCCAACTT | 16312 AGAGGGACTCAGGCATCTGGAA | 27296 GGGTCCTGTGTGGGAACCTT | 38280 |
| 4655 CTGTTAGTGGCTTTGCTGTTTCAA | 16313 CAGCCAGCCCTTCAACAGT | 27297 CGCATTTGTGTGGCTCTCTGT | 38281 |
| 4656 GGGAGGCAGGAATTACTCCAACT | 16314 CTGACCAGGGCTGTTTTCTGAAG | 27298 CCTAAATGCATGGGAGGCAGGAA | 38282 |
| 4657 GTCGTTTGGAAACTGGCTTCTGA | 16315 AGAGAATAAACGCATGCGGAAGA | 27299 AGTACAATGGATCTGTCGTTTGGAA | 38283 |
| 4658 CAGAAAGAGAGAGGTTTGTCCTCTTG | 16316 TGGAGTTCCTCCACGCATTG | 27300 GCCTCCACTCCAGAAAGAGAGA | 38284 |
| 4659 CAACACCACCTCTCCATACCTTGA | 16317 CGTGGCCCAACCACAGAGATT | 27301 CCACCACCTCTGGGCAACA | 38285 |
| 4660 TGCAGCAAGTGCGTGCATTC | 16318 CTTCCTGTCCACCAGCTTCTTC | 27302 TCTCTGGGGCAGCTGAAGTT | 38286 |
| 4661 GCTGGGCCATAGCTCTATGTTTTC | 16319 ACCGCGCCTTGCTGTATCAT | 27303 CCCAAAGTGCTGGGCCATAG | 38287 |
| 4662 GTTCCACCTCTCCCTGCAAAGT | 16320 CAGAATTCCCGGACAGCACAGA | 27304 CCTTTTGAGAACCAGCTCAAATGTT | 38288 |
| 4663 GACTTTGGGAACACAGAGAAATGGTT | 16321 CATTCCTCAACCTCTCAGACCAA | 27305 AGAGAGGACTTTGGGAACACAGA | 38289 |
| 4664 GGAAGCGGTGAATAGACTGAAG | 16322 GAGTTAGAGATCAAGTGGGGAGATTAC | 27306 TCTGTCTGCAAGCGGGTGAA | 38290 |
| 4665 GCCCTGCTGTAGTGCCTTAGTT | 16323 AAGATGTGACGGTTGGTACAGTT | 27307 CACATCAAAGCCCTGCTGTAGT | 38291 |
| 4666 TTCAGGCCCGGCTATCTGT | 16324 CCAAATTCCAACCTGACCCTGGTA | 27308 CTGGGGCAAAAGACTGATTTCTTCA | 38292 |
| 4667 GGTGTGCTTGTGCTTGAGAGA | 16325 TGCCCAAATCCAGGCTGAAG | 27309 GCACCTTGGGGTGTGCTTGT | 38293 |
| 4668 CCCCAGCCGCAACCTGGTAAT | 16326 TCCTCTAAGGTGAAATCGCTCAAA | 27310 GGCAGACGCCACTTTCTACTCA | 38294 |
| 4669 CTCCCACTTCCTGTCCTACCA | 16327 AATGGCCTCGGGCAAAGATG | 27311 TTGGGGACGGGTCTCCCAGTT | 38295 |
| 4670 CTCCTCTCCTCCATTTAGCTCTTC | 16328 GAAGCTGAATAATTTGCCCATCCTT | 27312 ACAGAAAGCCCTGCAGCTCTAC | 38296 |
| 4671 CAGTTGCCTGCACCACCTA | 16329 CAGGTCTTTTACCAAGAGAGTTTTGCTTTC | 27313 GCATGCCCAAGGTAGACAGTT | 38297 |
| 4672 GGTTCCAAGTGATTGTGGAGTCA | 16330 ACTGACAGAGCTGGATCCAAAC | 27314 GTGCATGGTGGTTCCAAGTGA | 38298 |
| 4673 CCCTGGTCCAATGCTCCTCAA | 16331 ACAGCCTTAAGCGCCAAGAAG | 27315 GGTTTCATGACTCCCTGGTCCAA | 38299 |
| 4674 ACGTCACAGCACGAGAAAGT | 16332 GGCAGGAGCTGTGTCTTGAATC | 27316 TGAGCCAGGCAGGTGCTA | 38300 |
| 4675 CAGAATCACACAAGTGGGAGATGACA | 16333 GGCCAACCTGGCTGGATTTGA | 27317 TTGCCCCAGAATCACACAAGT | 38301 |
| 4676 CCCTGGACTCTTGGGCAAAT | 16334 TCACGGTGCAGAGGAGACA | 27318 GTCCCCACACATCCTCTTTGTT | 38302 |
| 4677 CCAGCCCCAAACTAAGAAACTGTA | 16335 ACAATGGCCACAATTCCTCACA | 27319 CCTCCCCAGCCCCAAACTA | 38303 |

| | | | |
|---|---|---|---|
| 4743 AGGAAGGACCCCATGGCTCTA | 16401 GCATTCGACCTTAGGTTTGGAAAG | 27385 GGAAAGGATGGGGCCAGGAA | 38369 |
| 4744 TCGTGTTTGATTGACCCATGTTACT | 16402 GGTGCCAGTGGACTATCTCTACA | 27386 CCAATGCTATGTCGTGTTTGATTGA | 38370 |
| 4745 GGGACCAAGTCAAACCAAGAGTCTTTC | 16403 GCCTCACACTTGGGACACAAA | 27387 CAGCTGCTAAGGGACCAAGTCA | 38371 |
| 4746 GCTATGGAAAGTTTTCTGGTGGAGTT | 16404 AAGCCTTCGCACTCAGCTT | 27388 GGACAGCTAAATCAGAGAGCTATGGAAA | 38372 |
| 4747 CCTCAGAGACAGATGCCATTGAATTA | 16405 CGTTCCATGAGCCAGACTCTTCT | 27389 ACAGTGAATCAGCACTCCTCAGA | 38373 |
| 4748 CTTCTGGAGGACTTGGGTTGAGA | 16406 CTTGCCACCTAGCCCAAATGT | 27390 ACTGATACCATCTTCTGGAGGACTT | 38374 |
| 4749 CCCTTTCTTGCCAGACTAACAGT | 16407 CAGCCCCGAACAGAGTTTTGA | 27391 GGGGTCCTTACTCCCTTTCTTG | 38375 |
| 4750 GCAAGGTGCTGAAGCTATTCAAG | 16408 GCACTACTGTCAGGCTGCAATC | 27392 AAGGGGCAAGGTGCTGAAG | 38376 |
| 4751 ACCAGCAGCAGAGGAGGATGTA | 16409 TCCAGCGGACCCTGAAGGAA | 27393 CCATTAATCCAGCAGTTCCTTGATAC | 38377 |
| 4752 GCCCCTTGAGAGTCTTGCAGGAAA | 16410 CCCTCCCATGGCCTTTCTATCA | 27394 TCCCAGTCAGCCCCTTGAGA | 38378 |
| 4753 TCCGTGTGTAGTCTCTCCAGTAG | 16411 GCCATCCTCAGGAGCGTGAAT | 27395 TCACCTGTCACTCCGTGTGTAG | 38379 |
| 4754 CACTTTGCCAGTCCCGTCTAA | 16412 GCAAGGACAGCTTAGTGATTAGGTA | 27396 TCAATGACATCCTAGAGCCACTTTG | 38380 |
| 4755 GGTGGTTGGGAGTCACCTACTGA | 16413 AGGCCCCTGTCTCCAACTCA | 27397 GGCTTTGGGCCTGGTGGTT | 38381 |
| 4756 AGCCTTGGCCGTGGGAGAT | 16414 GGAAGTCAGCATCAAACCCTTGACT | 27398 CCCTTGCCCATCTCAGTTACAAG | 38382 |
| 4757 ACATACCTTTGCGAGCTGGTT | 16415 GGCCAGCCCTAGTGAAGAAAAC | 27399 CCTGCCCATTCAACCCCATCTT | 38383 |
| 4758 GGCTTAGACCAGGAGTGGAATGA | 16416 TCTGCATCAGGCCCTCTAAGAT | 27400 GCTCAGAGAGCCACTGAAGGCTTA | 38384 |
| 4759 CGGGATAGGAGACTTTGGTTGGTT | 16417 TCCCTGCCTGAATGTTGGAAAC | 27401 GTGCCCGGGATAGGAGACTT | 38385 |
| 4760 CTGGAGCCATCACTGATACCTTT | 16418 CGCAGCGACAGCAGTCAGA | 27402 GGCAGCAGAGACCACCAGTT | 38386 |
| 4761 CCTGCTGTGAAAGGTGGTGAGA | 16419 TGAAGTGCCGAGCCCTGTGA | 27403 TGGAGGTCACCTGCTGTGAA | 38387 |
| 4762 GGCCTTGTAATTCTACGCACCAGAT | 16420 TGTGCACACCATGCACCATAG | 27404 GTGGGTGTTTAGGCCTTGTAATTCTAC | 38388 |
| 4763 CCAACGTGTCAATATGCTGTTGATT | 16421 TTCCCTCTCCCGGCAACAT | 27405 GCTCGGCTCCAACGTGTCAATA | 38389 |
| 4764 GGGGCTTGCATCCCCTTT | 16422 GAGGTGGAGAACGTGAGACACT | 27406 AGTGGGACAGCAGGGAAAGA | 38390 |
| 4765 GGCACTACCTCACTTCCTTTGT | 16423 GGTAGGGCTGGCTGGAGGAA | 27407 GGAGACTCATGTCAAATGTCCTGTCA | 38391 |
| 4766 GTGGTTTCTGGCTTTTGGAGGAA | 16424 AGTAGTGCCTCTGTCTTCTGTGA | 27408 GGCCCTATGCAGGTGGTTTCT | 38392 |
| 4767 CTCTCCCTCCCTCAAGTACACAGA | 16425 CTGGAGGAGAGGTAAAGAGAGGTAAA | 27409 CTTCCCAAGTTGCTGCACTCT | 38393 |
| 4768 ACCCAGGCATGTTAGTGTTTTCTA | 16426 CCAGAGCACCATTCCCCATAG | 27410 CCTGAGACCCAGGCATGTTAGT | 38394 |
| 4769 GCCTGTGTGGTCCCTCTTCTTC | 16427 GCTGTCATGCCTTGCTTCAGATTG | 27411 CCACCAGGCTCACAAATTCACT | 38395 |
| 4770 CTGAAAGGACCAGGCTAATAATGACT | 16428 GGATGGGCTCGGGACTTCCTAA | 27412 GAGAGGAGGACAGAAGTCTGAAAG | 38396 |
| 4771 TTCAGAGTCGGGCACTCCATAG | 16429 CCCAGTGTCAGGACTTGTTCATTC | 27413 TTGGGGAGGTGGGCTTTTCA | 38397 |
| 4772 GCTCTCGGAGAAAGACTTGAGTAA | 16430 GGCACACGGCCAAATTCAGA | 27414 GCCTCACTGGGCCCGATTTT | 38398 |
| 4773 CCAGGCCTCAGCCTGTGTT | 16431 CGACGGATGAGGCAGGTGTTT | 27415 CGAGCTTTGGATGCTCCCTTTC | 38399 |
| 4774 GGGAATGCATCTTCCCCAACTGT | 16432 TGGCAGCACCCTTTGGGTTT | 27416 GCCTATTTTCCTTTTGAGGGAATGCATCTT | 38400 |
| 4775 AATCTAAAGTCCAGAGCAGCAAGT | 16433 CCCTCGTTCCCTGCAATGTCA | 27417 CCGACTGGCATGCTGACAGAATCAA | 38401 |
| 4776 GGAGCCGAAAGAAGGCTTTTAGA | 16434 GCCAGGAGGTGGAGGTATGA | 27418 GCAAATCTGTTTGATATGGAGCCGAAAG | 38402 |
| 4777 TGGGGCACTGGAAAGTAAGTTG | 16435 CCCAGTAGTTGAGGTCTTCCACAAT | 27419 TCTAGCTTGGGGCACTGGAA | 38403 |
| 4778 GGGCCCTTTGTGACTGTGTTC | 16436 ACAAAACCCTGAAGAATCCCAGTAT | 27420 ACATCCTTAGGGGCCCTTTGT | 38404 |
| 4779 GCCAGACAATGTGAGGTGCTGAT | 16437 GTAGGCCTCCTGGAGTGGGTAT | 27421 GGTGTGGGCCAGACAATGTGA | 38405 |
| 4780 TGGGTGGGATGGGTAACA | 16438 CTGATTAGGTCCTGCCGTCCTT | 27422 CCAGAGTGGCTGAAGCACAGAT | 38406 |
| 4781 GCGAGACAAAAGGGGATATTCAAG | 16439 CCCATTGGCTGAAATAGGGGAA | 27423 AGACTTAGAGCTGCGAGACAAAA | 38407 |
| 4782 CGAGTAAGTCAGGTCTCCAGATC | 16440 GCCCTCCTGGTGTTTGTGAA | 27424 CCAGTGTCATGTGGCCGAGTA | 38408 |
| 4783 GGGGATGGCATCATTGTGAGA | 16441 CCAAGCCCTTCAGCCAGTTCA | 27425 GGAAACCATGCCAGGCTCTTTG | 38409 |
| 4784 CTGGGAACGACAGAGAATCACA | 16442 TCCTCACACCCTTGGCTGAT | 27426 CCCAGCATCAGCTGCTCATATGTAA | 38410 |
| 4785 GGATCATGCAGAGAGAGCTGAGACA | 16443 TGTTCCCAGAGGACAGGGACAA | 27427 GTTCCTAAAAGGATCATGCAGAGAGA | 38411 |
| 4786 GAGCCCGTGGCTCTGTCACT | 16444 GGCCAAGCCCTTACCTGAAGAT | 27428 TGGCTGGCAACTAGGGATGTGA | 38412 |
| 4787 CACTCCTTCTCCTGTGGGGATTTG | 16445 CTCACCCTTCCGAACTCTTAACAT | 27429 GTGGACAAAGTACTCACTCCTTCT | 38413 |
| 4788 CGGTAGATCTGATCCTGGAACTTCT | 16446 AATCGACACGCCCATTACTGT | 27430 CCACATGACCCTAAGACGGTAGA | 38414 |
| 4789 CCTTGCTGCTCATTGGCTTCT | 16447 TCCACAGGGCTCCCGTGACA | 27431 CCTTGCAGGAAGGTTTATCTTTTGT | 38415 |
| 4790 CTCTTCATCTTAGCCAGTCCACTT | 16448 TGTCCTTTCTAGGCTGTCTCTGTT | 27432 CAAGGGCCTCAGCCTCTTTGT | 38416 |
| 4791 GGCTTGTCCAAGGTCCATGATA | 16449 TGGCCCCACTCCTCAACAAAG | 27433 CTGGGCGGAGAGACACTAAATG | 38417 |
| 4792 TCCAGGGAGGGCTGGAGACT | 16450 TGCGGTCAGACGGGCTCAGA | 27434 ATCAGGGGCTGGTCCAACA | 38418 |
| 4793 GGGCCACGCAATTTTCCTGTGA | 16451 AGTTCCCCTGGGTTGCAGAGT | 27435 CGAACGCTACACCTAGGACATTG | 38419 |
| 4794 GTAGTGGGGATCTGACCTAGGAA | 16452 CATCCACTGCTGCGCTTTTTG | 27436 GAAGGCAAAAGTAGTGGGGATCT | 38420 |
| 4795 CCACCATCGGCCCATGTCA | 16453 GCAAGGCTGGTCTCTCTGCTT | 27437 TGCCTGCACCTCCACCAT | 38421 |
| 4796 ACGGGAGGGCAGTGAGCTT | 16454 CGTCCCAGGAGGTGGAAATCATC | 27438 GGCACCAGCTCTTCCATCTGTAG | 38422 |
| 4797 TGGTGGTGTGTGCCTGTAGTTC | 16455 GCAATCTTCCCACCTCAGCTT | 27439 GCTGGGCATGGTGGTGTGT | 38423 |
| 4798 CCCACACACAGAACGTGGAAAC | 16456 GGGCGCCTGCCATCTCCTTT | 27440 GCTGATGGCCCCACACACA | 38424 |
| 4799 GAAGAGCAGGAGGAGGCAAGAA | 16457 ACACTGGTCAGGTATGGATCACT | 27441 GGTGCCCACACAGGAGAGA | 38425 |
| 4800 GCCAAACTGGCTGGGTTACATC | 16458 CCAGAGCCACCTGGAGTAGGTA | 27442 GCCTGTCCTCAGGAGCCAAA | 38426 |
| 4801 GTGGGTAATGACAGCAACTGAGA | 16459 CATCGCTAAGTCATGGTGTCACT | 27443 CAAACAGGAGTCAGTGGGTAATGA | 38427 |
| 4802 GGCCCTGGGAAGACTTCAACAA | 16460 AGGGTGGAGCCTCCTCGTTTT | 27444 GGTGAGCAGTTTCCAGTGCAAGT | 38428 |
| 4803 CCAGAGGCCTTGCCAGAACATT | 16461 GAGGACCTCCCTCCTCTGA | 27445 CCTTGTCCTCCTAATGAGCTGACTGT | 38429 |
| 4804 AACCCAGGAGACTCAGGGTCTGT | 16462 TGGCTTCTCTCCCCACTGTGAT | 27446 GCCTGAGGTCTAAGGGAGATGAAC | 38430 |
| 4805 GCGGTTGTGAGAAACACACTGA | 16463 GCCTCTAAGTCCATTCTTTGGATTTG | 27447 TTCACTCTGCGGTTGTGAGAA | 38431 |
| 4806 ACTATCATCGCTCCCGAAGGAA | 16464 GGCTGGGCATGGCTGCTTAATA | 27448 CCCCACTACCTAGTTCCAGAATACTATC | 38432 |
| 4807 GCTGAGCCTGGACGCTTGT | 16465 CCTCAGTCCTCACAGGGAGATTC | 27449 TCTGGAGAGGTGGGAGAGGTTTG | 38433 |

FIG. 36H4

| | | | |
|---|---|---|---|
| 4808 TCCCCTTGCAAGACCGATTG | 16466 GTTTGTCTCCTCTCGCCTTCA | 27450 AGCAGAAGGCTACCGTCCAA | 38434 |
| 4809 GTTCTACTCGGCTTCTGGAAAGAT | 16467 CCCTGACCTGTCCTGGTCAT | 27451 GGAAGTAGTGGTCCCAGCATTG | 38435 |
| 4810 CACTCCCGGGTTTTGTGTGAAT | 16468 GGGCGTGCACCCGAATGAA | 27452 CACACCAGCATCTCTCCACAT | 38436 |
| 4811 ACTGCCCACCCCTCAAAAC | 16469 CTCTGGGAGCAGTGAAGGTTCT | 27453 CGAACAGGAGCCTCTTCTCACA | 38437 |
| 4812 GCTAGACCCTCCCTCCCAATGT | 16470 AGGAATGGCCTGGGAGCTTTG | 27454 GTCCTTTTCAATGGCGTTGCTAGA | 38438 |
| 4813 CAGAACCCCAGCGCGATCT | 16471 TCCGTCACCACAGTGGGGTTT | 27455 CGACAACAGACCCCTCTCCTTCT | 38439 |
| 4814 AGCGGAGCCTGGGCAATGT | 16472 AGTGCAGCGCAGCCCTCTA | 27456 CAGAGGCCTGAAATGAGGATGA | 38440 |
| 4815 GCCGGTGCCATTCGTATCCATT | 16473 TGTCAGGGCCTTGTGGGATTCT | 27457 AGGCAAGCCGGTGCCATT | 38441 |
| 4816 CGAAGTCCCAATGGCAACTTTCA | 16474 CGACGAAACCAAGAGCAAAGTGAAC | 27458 AGGCACCGAAGTCCCAATG | 38442 |
| 4817 GGTCGCGGATTGTGCTGTCTA | 16475 GCAGCAGCCCCTGGAATGTA | 27459 AGGAGGCAGGTCGCGGATT | 38443 |
| 4818 ACGGGGCCAACGAGGGGAAT | 16476 AAGTGCCCCAGCAAGCTGTCA | 27460 GTGGAGATCGAGGCTTGCTTCT | 38444 |
| 4819 CCAGGCCCAAACCCACTACAAA | 16477 TCCCAGTGGTCTCTTGGCTTGA | 27461 CACTGTGTTTCCAGGCCCAAAC | 38445 |
| 4820 GGAGTTTTGCACAGGGACTTCT | 16478 TCACAGGGTCACACGGAGTCA | 27462 GGGGAAAGCAGCGAAATGGAGTT | 38446 |
| 4821 CAGTGGGAAAGCCACGGACAT | 16479 GGTCGCATGTCACCCTGTGT | 27463 GCATGGAGACGAGTCAGTGGGAAA | 38447 |
| 4822 GGCATAGGGGACCAGGAAAGTCT | 16480 GGTACCAACCGATGTCTCTTTGCAT | 27464 TCTGGTGCGAGCTTTGCTT | 38448 |
| 4823 GGGTTTGACTCATGGGAGTGTGT | 16481 GTCACATGCCCACCCACAATAC | 27465 GCACTGAGCGTGTAGGGTTTGA | 38449 |
| 4824 CCCCTTCCTGGATTTGCTTCT | 16482 TCGTTCCCGACTGTGGTGAGT | 27466 CCAAAATACTCCCCTCCCACGTT | 38450 |
| 4825 GAGAGAACTGTAGTGGCGATTTCT | 16483 GCTGCTGGGAAGCTCTGTTTG | 27467 GCAAACCTCAGTAGAGAGAACTGTAG | 38451 |
| 4826 TGCCAAGGTGTCCTGTCTGTTC | 16484 TGGAGCTGCTGCCCTGTTAG | 27468 GCCAAGAAAAGACATTGGTCACTT | 38452 |
| 4827 GCGTTGAAACTGTGCTCTCAACT | 16485 CCAACCAGCCTGATGGTCTCTT | 27469 GGCCTCTTCAGCGTTGAAACTGT | 38453 |
| 4828 GCCCACATGTGTTACTGGTGGAT | 16486 CATATGGATTCGCTGCCGGTAA | 27470 CTGATCATGGCCCACATGTGTTA | 38454 |
| 4829 GCAGGCAGCCGTGAGCATA | 16487 GCATCAAACCAAACCAGACACA | 27471 ATAGCAGCACCAGGCCACAT | 38455 |
| 4830 CTCTGCCTCACCCATTCTTGT | 16488 GAGGCAGGGCCAGATAAATTCT | 27472 GTGCGCAGTTTGTGATTCTGA | 38456 |
| 4831 AGTTGAAGGCGCTGGAGAAG | 16489 AGGCTGTCCAAGAGTCCAAGA | 27473 CGTGTTGGGCTCAAAATGCTGTTC | 38457 |
| 4832 ACGCACACACCGGCATACA | 16490 GCACAGGCCTGGAGAGCAA | 27474 ACACCTGCCCACGCACACA | 38458 |
| 4833 CCAAATGGCCAGCTGTGAAGT | 16491 GGTTGGTTGCCTCTTGTTCCAT | 27475 CACCATCACAGCCAACTCCAAATG | 38459 |
| 4834 GGCTGTCCAGAATTGGACTTTATG | 16492 GAGCAGTGTGTGCTGTGGAT | 27476 GCTGCTGAAAATATTGGCTGTCCAGAA | 38460 |
| 4835 AGGCTGCCCTTAAGCACGTT | 16493 CGGCATCCAATCTGCTCTTAGT | 27477 GGTACAGCCAACCAAATTAGACAAG | 38461 |
| 4836 CAGGTCAACGTCTCATCTTCGTT | 16494 ATGAAGAAGAGCGGGAAAAGGAT | 27478 TGTCGTTCCAGTTCAATCACATCT | 38462 |
| 4837 TCTGCCAAGGGGTCACCAT | 16495 CCCAAGGTCGTCGCTACTTGT | 27479 CCGGAGTGGAATCATCCCTAGTTC | 38463 |
| 4838 GCATCAGTGCCCATTCACACA | 16496 TGGGCAGCGCTCTGCTTCT | 27480 ATGGTGGGCTCTGCATCAGT | 38464 |
| 4839 CCGAGTTCCAGCCATTTGTAAAGTTC | 16497 TCCCCTCCCAGCTACAGAAACT | 27481 CTCTTACCGAGTTCCAGCCATT | 38465 |
| 4840 GCCCTTCAGGCTTCTGTGAGTA | 16498 CCTAGAAGTACGTACCCACCAACA | 27482 GGCTGTAGGGAATGAAGGAACA | 38466 |
| 4841 GCTACACTTCCAGCTAGCACTTG | 16499 TGGAGGAGAAGGTGGCTGTTTG | 27483 ACTGTGATGCAGGCTACACTTC | 38467 |
| 4842 GGCTCACATGCTTTCCAGTGA | 16500 GGGAACGGTAGTGAGGATGAAG | 27484 GGCCAGTAGCATTGGCTCACAT | 38468 |
| 4843 CTGGCCAGAACTGTGTGTCAT | 16501 CTTTCCCAGCCTCGATTGCAT | 27485 CCCAGAAGCCTGCTACTTCCATTC | 38469 |
| 4844 CAATCCTCCCACCTCCAGAGTAG | 16502 CACAGTGGCAGGCACCTGTAAT | 27486 ACTCAAGACTGGACTCAAGCAATC | 38470 |
| 4845 AGCCATGCCCACCCACTGA | 16503 GCAGGGAGAAGCTCCCCTAGA | 27487 GCTCAGACTTGGGCAGAACA | 38471 |
| 4846 ACCCCACAATTTCCACTCATTCT | 16504 ACTGAGGGAATGAGGACTGGAT | 27488 CAGCTCAACAAAATTGACCCCACAAT | 38472 |
| 4847 CGGCCCTTGTTACATATCCAGTT | 16505 GGCAACGCAGGCAAAGTGT | 27489 CACACTCATCGGCCCTTGTTAC | 38473 |
| 4848 CAGGCCAGGGAGAGCTTTGT | 16506 GGCTCCCCTCTCAGAGCAAAA | 27490 GCAGAGAGGAGGCGAGTGA | 38474 |
| 4849 CCCAGAGCATAGAAGCCGATCA | 16507 GGACTGGAGTCTGTTGGGAGAGA | 27491 CGGCAAATGTAAACCCAGAGCAT | 38475 |
| 4850 CCACCTTTACCCAGGAGAAACTCA | 16508 GACGGCTCCGTCTGTTGAGAAA | 27492 TCCTCTCACTGTTCTTCCACCTT | 38476 |
| 4851 TGCTCTGATACACGAAAAGCATGT | 16509 GCACCTTTGCCTTAAGCATCATTG | 27493 CCCTGGAAGGTAATTTACATGCTCTGATAC | 38477 |
| 4852 CCAGAAACAGCAGGGGAATTGT | 16510 AGGGATAACATGTCTCGTTCAACTT | 27494 CCATGAGGCATAGCATTTACCAGAAAC | 38478 |
| 4853 ATGCCCCAGGGAAGACCATTC | 16511 CAGCCGTGCACTGTCTGAGTCT | 27495 GCGACTTTGAGCCCATCCTTCT | 38479 |
| 4854 GCGAAGCACCAAAGGGTGATGT | 16512 AGCTGTGGGTTTCCGTGTGT | 27496 AGCACTGGCGAGCACCAAA | 38480 |
| 4855 AGGCTTGGCCTTGCTTTCA | 16513 GGAGGAAGCCCAGCATTATGAAG | 27497 GTGTGCTTCAGCATGCCAGTTAG | 38481 |
| 4856 CCGGGCGTGTTTGACTTACA | 16514 CCTCTCCTGTCTTCGTAGTGAGA | 27498 ATGCCTTTTCCGGGCGTGTT | 38482 |
| 4857 CCAAAGGTGTAAGTCGCAGTCT | 16515 GCTTGAGCTGGGTTATTGTGTTC | 27499 TGAAACTGGAGAACCAAAGGTGTAA | 38483 |
| 4858 CTGGAAGGTCTGTGGGGTCTGTA | 16516 TCTTCCTTGGGCGTGGGAATG | 27500 CTGAGTCACCTGGAAGGTCTGT | 38484 |
| 4859 GCTCTGTGCTTCCTCATCTGCTT | 16517 GGCTGAGCCTCACAGTAACAA | 27501 GTAAGTGGGGCTCTGTGCTT | 38485 |
| 4860 CTTCATCAGGGCCAGAATCCTT | 16518 CAGGGACACAAAACCCCGATCA | 27502 GCAGGTTCAGTGACTCTTCATCA | 38486 |
| 4861 TCCATCTCCCACCACCTGTT | 16519 TGGGCCTAGGAAGGTTCAGT | 27503 TGAGTCCTAATCTCAGCTCCATCT | 38487 |
| 4862 CGCGGTAACTCCACAATCACA | 16520 CGCGATGACATGGAGGTGAA | 27504 CTTATCTCACCACGCGGTAACT | 38488 |
| 4863 GCAGTTGGCAAGACAGCAAGA | 16521 ACATCCTCAATCACAGACTGCTT | 27505 GGCAGCAATTGGTGAGAGACAAG | 38489 |
| 4864 CACTGGCTTGGAACATGAGGCTTA | 16522 TCTCCACAGGGTCCTGCTCAA | 27506 CCTGTTGACACTGGTTGGAACA | 38490 |
| 4865 ACAGTCCTCACTCCACGTCACA | 16523 CAGACTCTCTGCACCTCAGTGT | 27507 GGGCAGCACAGTCCTCACT | 38491 |
| 4866 GGCCATGGGATCTCTGTGATAACTA | 16524 GCTGCTTCCACATTACGTTTGAGA | 27508 GGTTTGTAGGCCATGGGATCTCT | 38492 |
| 4867 GTTAGCCTCTGACTATTCCTTACATCA | 16525 CTGGTCCAGCCTGGGAGTTG | 27509 CCGTGCCTGTGTGCATGTTA | 38493 |
| 4868 TGGTGCAATGCCTCCTTAAGTT | 16526 TGCGGTGGACAAGGGAAGT | 27510 GCTCACTCCCAGTTGGTGCAAT | 38494 |
| 4869 AAACGCTGCCTCCCTGCTCAA | 16527 CCGGCCTGGAGGGATATTCTTG | 27511 GACCCAAAGAAGCCAAGGTCAGA | 38495 |
| 4870 GTTCATTCTAGGAGGCAGTGGAA | 16528 TCCTGCAGCCAAGCTCACA | 27512 CTCACCTACTCTCAAGGTAACTGTTC | 38496 |
| 4871 ATCCCACAGGTGGGGAGCTT | 16529 GCCTCCAGGACTTTGAACCAA | 27513 CCACCTGTATGGAGCGGCAATA | 38497 |
| 4872 ACAGGAGTGCCTGGCTAATGA | 16530 GATGGCAAGATCCTGTCTCTACAA | 27514 GTCTCCCAAGTAACGGAGACTACA | 38498 |

FIG. 36H5

| | | | |
|---|---|---|---|
| 4873 TGGCCACACCACCCTAGCTT | 16531 ACACACAGGGAGAGGCCGTTT | 27515 TCGGTGCCCCTTGGCTTGT | 38499 |
| 4874 GCTCAAATCCACCCAGAGGTCACA | 16532 TGAGCGCAGACCTTCCTGAT | 27516 GAGGTAAAGCCAGGAGCTCAAATC | 38500 |
| 4875 CAAGGAGAAGACGGCCTGCAA | 16533 GCGTCCCTCGGCTTGTAA | 27517 GTGAAGTAAAGGGGCAAGGAGAAGA | 38501 |
| 4876 ACGTGCACTGAATACCGGAAAG | 16534 TCCCGCAGGTGAAGCCTCTA | 27518 CCGTCCAACGTGCACTGAAT | 38502 |
| 4877 AACCCACGAACAGCCTCACT | 16535 GGCCTGAAGCCCGGGATATT | 27519 AGCTCCGTCCTAACCCACGAA | 38503 |
| 4878 CGTCTGCTGCGCTGTTAGAAAC | 16536 ACGCGATGTCCTGGAAAACA | 27520 CTGCGGTGTAGATAACTGAGTGAAG | 38504 |
| 4879 TGTGACTGGAGGTGGCATCACT | 16537 CAGTCACCTGAGTGAAAGCTAAGT | 27521 GTGCAGAAGCACCTTGGTTGT | 38505 |
| 4880 CACGTGTGTTCTACCTGATGCTGAA | 16538 CCCAATCCCGCAGCTCTCA | 27522 GTGTTGTGTGCACGTGTGTTC | 38506 |
| 4881 GGAGAGAGGGTCTCACCTTGT | 16539 GCCAACAGCAGAGAGAGAACAGA | 27523 TTGCGTTCAGGGAGAGGAGAGA | 38507 |
| 4882 TTTCACCGCCGCACAGAGAA | 16540 TCTGCCTGTCCCCAGTCTTG | 27524 CCGGCCTTCACCTCTCTTTGAGT | 38508 |
| 4883 TCAACGCCCCGGGCCAATTC | 16541 ATGCCTGGGTCTCTTCCTGAGA | 27525 GGAGCTTTGAAAACTTCCGACACTCT | 38509 |
| 4884 CCTTGAAGTCCATTTTCACCAGTATG | 16542 CCCTGTGGGCTCCTGGTACA | 27526 CCACTTGCTGGAGTTCCTTGA | 38510 |
| 4885 ACACCCAATGAGCTTGGTTGA | 16543 CCAAACAGCTGGCCAGTGAAG | 27527 GGGTGGCATGAACTTTACACCCAATG | 38511 |
| 4886 ATCCAGCCTTCTGGGCCATTC | 16544 TGGGTTCCCATGTGGTGTGA | 27528 CCTGTTTGCAGATCCAGCCTTCT | 38512 |
| 4887 CCTCCTCCCCTCTTGCACAGTTA | 16545 AGGAGTGGCCAGCAGTGAAA | 27529 CCCTTGGATTCTGATGCCATCTCGTT | 38513 |
| 4888 CTCTCTAGTTCAAGCTCCTTGCTTGT | 16546 GAGGATGAGTGCCTGACTGTGT | 27530 CTGGGATGTTAATTCCCTCTCTAGTTCAAG | 38514 |
| 4889 CATGCTGGGGACAGACTCTCA | 16547 CCGAACCCACTTGCCCATTG | 27531 ACAGCGCCCTCTGCTATCCAT | 38515 |
| 4890 CCAGAAATGTGGCTTAGAGGAAGGAA | 16548 GTGCGCTCGGAAGGTTGAATAG | 27532 GGCCGCAACCAGAAATGTGGCTTA | 38516 |
| 4891 GCTGGGGTGGGATTGCTTGA | 16549 CACGGCTCACTGCAGCTT | 27533 ACATGGTGGTCCCAGCTACTCA | 38517 |
| 4892 CATTAGCAGCGGACAGGACCAA | 16550 GGCTCTTCAGAGTGATGGGACAT | 27534 GGGAGACAGCCAGGACAACTCATT | 38518 |
| 4893 GGAGACCGGTCTGTTTCTTCTCTTG | 16551 TTGTGGAGCCCCAGTCTCTGAA | 27535 TCCCTGGAGACCGGTCTGTTTT | 38519 |
| 4894 CAAAGGCACTGACAGGTGTGT | 16552 GTCTTACTTTCTCCGTCCCAGTAG | 27536 GATCACACCCAAAGGCACTGA | 38520 |
| 4895 TCCATTCCCCTACTCCCAGCAT | 16553 GTGGTGACAGAAAGCAGCACATC | 27537 CGTGCCCATTTGCAATCCATTC | 38521 |
| 4896 GGGAGCAAGAGTGGATCGTTCT | 16554 TCCTCCGAGCCACTGCTCAT | 27538 GAAGAAGAGATTCTGGGGAGCAA | 38522 |
| 4897 GTGAGTCTAGGCTTCCCAGCAA | 16555 GCCACAAGCCCGACCTTT | 27539 TGGGTTGGATTTGGGTGAGTCT | 38523 |
| 4898 CGCGTTCACAAATCGCTCTTC | 16556 GCCACCCTACGTCCTGTGT | 27540 GCTGCTTCGCGTTCACAAA | 38524 |
| 4899 CCCTTGTTTCTTTCCTCAGGGCTAA | 16557 GGAGTCTGTTGAAAAGGCTGGTT | 27541 CCTCCCTCGTTAACTTCCCTTGTTTC | 38525 |
| 4900 AACGCCCAGCTGAGGTTTGA | 16558 GTCCCCAGGGAAAAGCCATTGT | 27542 GCTGCAAGGGCTTCCTGAAA | 38526 |
| 4901 CTTTTCCCGCGTGCTGTGAT | 16559 AGGGGAGGTGATGCCTGTGATGA | 27543 TGAGGGAGGGCCTGTCCTTTT | 38527 |
| 4902 GTTATGTGGGAAGACCCCAACA | 16560 AGGCACCAGTGAGCTGATGT | 27544 CCCTGATTCTCAAGACTCTTTGTTG | 38528 |
| 4903 GCCTGGGAAACTTGTGAATGGAA | 16561 AGAGGTGGGCAGCACTGA | 27545 CCAGGGGCCTGGGAAACTTG | 38529 |
| 4904 CCGCTTGAAAAGCCACCTGCTA | 16562 CCCCGGCTGAGAGCAGACAA | 27546 CAGCGATGGAGCTAGTCTGTGA | 38530 |
| 4905 CTTCACCTGGAACCCAGAAACA | 16563 CAGCTCTCACCTGCGTTTTG | 27547 GGAGGTGTAACCAACTTCACCTGGAA | 38531 |
| 4906 GGCACCCAGCAACTGGATCTT | 16564 ACAGCCGCCTTCCCAAAACA | 27548 CGCATATAACAGGCACCCAGCAA | 38532 |
| 4907 GCCAACACAGGCAGGATTGA | 16565 CGGTCACTAGGCACCATCTAATTC | 27549 TGGGCCGTCTTTCCCTGAGA | 38533 |
| 4908 ATCTTCCTTGCCCTGGAGTCTA | 16566 TGGCACGGCCACGAACATC | 27550 CCACGTGTCTTCGTCCATCTTC | 38534 |
| 4909 TGCGGATGCGGTTTCCTTCT | 16567 GGAGTAAACCACCTGCCTCTCT | 27551 GGGGACCTTTGCTCCGTTTG | 38535 |
| 4910 GGAAGTTGGGGAAACAGGAGGATA | 16568 CCAACCCCAACAGAACAAGACCAA | 27552 CCCAGGAAGGAAGTTGGGGAAAC | 38536 |
| 4911 GCGAGGTTAGCCAGGGTTAG | 16569 ACAAACAGCCTTCCGTCTCTTC | 27553 AGGCTGTAGACGGCGAGGTTA | 38537 |
| 4912 CCACTTGGCAGTGAGGGTATTTC | 16570 AACCACCTGGCCCTCTGTAG | 27554 ACACGCCCCAGTCTCCACTT | 38538 |
| 4913 TGCCAGCCCCAGTCCTGTGA | 16571 GGGAGAGTGCCCTGTTTGTTGT | 27555 GCCCTGCAGAACTCCCAACT | 38539 |
| 4914 CACTGCAGCTTGAGCCAACA | 16572 GCGTTTGCACTGGGAGATGAAG | 27556 ACCACCCTCTCACTGCAGCTT | 38540 |
| 4915 GGGCGCTGTGACTTAGAACAAG | 16573 GCCCACCTGCATTTGGCTTT | 27557 AAGATGAGGGCGCTGTGACT | 38541 |
| 4916 GCAATGGCATCCTTGGGAAGA | 16574 CCCAGGTGCCAGGTGTCAT | 27558 GGGGAAGACGATGAAGCAGCAA | 38542 |
| 4917 TGGTCCCCTGTTGCTCACT | 16575 CCCGCCTGATTCTGGGAGTTTT | 27559 GGGAGGCAAGGGAGTCATCT | 38543 |
| 4918 AGCGGCGCAGTGAGTACA | 16576 TTGCGGGGTGTGCGGAGAT | 27560 AAGTGGCAGCGCCAGTGGAA | 38544 |
| 4919 CACACTGGCTCCAGGACACT | 16577 CGGGAGCTGCTGCTTGTTG | 27561 AGCCACACAGGACAGGACTTG | 38545 |
| 4920 CAGTGGCAGGTCCATGTTTTG | 16578 TGCTGCTCCCTGGCACAT | 27562 CTCAGTGCCCCAGGTAGTGATTTC | 38546 |
| 4921 GCCTCAGCTCCTCCTGGGTAA | 16579 GGTATGGGGAGAGGACCCTGAA | 27563 GCGAGTCGCTGAACCTCTCT | 38547 |
| 4922 GCTGTGGGTCTTGCTCTGCTTT | 16580 GCTTGCTGGTTGGATGTCAGT | 27564 AGGTCTTGCTGTGGGTCTTG | 38548 |
| 4923 CCCCACAGCAAGGACATAGGAA | 16581 TGCTCTGTGGGTGTCACATTC | 27565 AGTGCCTGGCATCCTGCTA | 38549 |
| 4924 GTTCCCCAACAAGGGGCATCT | 16582 GCCCAGAGCTCCATTTCACTGT | 27566 TGAGGCCTGGGGTATTTGAAGA | 38550 |
| 4925 AGCTGGGTGTGCCTTTGATG | 16583 TGTTCATGGCCAAAGGTGTGA | 27567 GCCCACAGAAGGTTGTTTCGTT | 38551 |
| 4926 GCCTTTCTCGTGACCCTTGT | 16584 CGGCCAGGAGAACCAGAATCTT | 27568 GCTTGGCCAATGACAGCCTTTCT | 38552 |
| 4927 GTGGAGTTGGCGGTGGATGTA | 16585 GTGCGTGTGTGGTGTTCTCT | 27569 ACCAGCCTCAATGTGGAGTTG | 38553 |
| 4928 TCCTAGAAACGTGACGTGTAATGTAG | 16586 GTACAAGAATTCCGACCCCAAGA | 27570 GCAGAAGTCTCCACACTGTCCTAGA | 38554 |
| 4929 CCCGGGCTCATTTAGTGTGTGT | 16587 GTGGTTGGGTGGGCAGATAGA | 27571 GCCTACATCCCGGGCTCATTT | 38555 |
| 4930 CCCCAGGCGTTTCTAAACAATCA | 16588 CCTACTGCTTGCTGCTAGTGT | 27572 GAAAACAACCCCAGGCGTTTC | 38556 |
| 4931 AATTTCCAGGGTGCGTGGTT | 16589 CAACGGTAAGACTGACCAGACA | 27573 GCTTCTCTGGGTCTCAAGACATAAT | 38557 |
| 4932 CCAGCCCAGCCTATGTGCTAA | 16590 GTCTTAGGCTAGCTAGGGCAATGTAG | 27574 CACCCACGTTTGCTGGACTTAC | 38558 |
| 4933 CCTTTGGTGAGTGAATTGGTCTTTGA | 16591 GTGGGATGCCCTTTACACATCA | 27575 GCTCTTCGTTGGTTCCAGCCTTT | 38559 |
| 4934 CCAGCTCCTTATAGGGGCTATTAAAC | 16592 AGCGCAGTCTGAATCAACAGT | 27576 ACTCTTTGTGAAACCAGCTCCTTA | 38560 |
| 4935 GGACAGGTGGTCTAGCTTGGAA | 16593 TCTTGGCTCCCACTCACAAAC | 27577 AACCCAGGGCGTGGCATTCT | 38561 |
| 4936 GCACCACTTGCTTGCTCAGT | 16594 CCCAGCACTTCCCTAAGCAGTA | 27578 GTGCGCTTATTGCACCACTTG | 38562 |
| 4937 CTCAACCAAAGCTCTTTAACACAGT | 16595 GCCTGGCCTCTCTCTTCTGT | 27579 GCCTAGGAGAATCTATACTCAACCAAAG | 38563 |

FIG. 36H6

| | | | |
|---|---|---|---|
| 4938 AGCTCTGGGACGGGCAAAC | 16596 GAGCTCTGGAAGCAGCATCTAAGT | 27580 CCCAGTGAATATGGGCCTGATG | 38564 |
| 4939 TGGAACAGCCCCTCTGTGTGTA | 16597 TGATGCAAAACAGGGAAGGAACA | 27581 GCAGACAGGAGGCTCTTTCCAT | 38565 |
| 4940 ACTTTCCCTGCACCTTTATACACTTC | 16598 GAGTCAGCGTCCTGTTCGTTAG | 27582 CAGTCTCACTTTCCCTGCACCTT | 38566 |
| 4941 CACAACCCACCCATCAGTCATTG | 16599 GACGAAGGTTGGGAGTCAGAAAC | 27583 CCAGCAGATTCACACTGTAGACACA | 38567 |
| 4942 CCAGAAACCATGCCATTATGCAA | 16600 CACAAGGTAAAACAGGCACTTCCTT | 27584 GAGAATGGCCAAGGTGTGGAA | 38568 |
| 4943 GAGCAGCCAATGCACAGTCA | 16601 GACAGACCCAAATTTCTGCCACAT | 27585 AGCAAGGTTGAGCAGCCAAT | 38569 |
| 4944 TGTTCAGACCTCTTGGAAATTGCAT | 16602 CCACCGTGCCCAGTCACATA | 27586 GGAGAGATGTTCTTATTGTTCAGACCTCTT | 38570 |
| 4945 CCCTGGCTTTGGTTTCCTTTCA | 16603 GGAAGAGAAGGTCTAAGCGGAAGT | 27587 ATCCCTCATCCCCTGGCTTTG | 38571 |
| 4946 ACGCACGGGAAGCTGAAA | 16604 CTCGCAGACCGTGCAACT | 27588 AAGGGAACGCGGTGGTTAG | 38572 |
| 4947 GAACCTTGACGCTAGAGCTTTGA | 16605 TGACTTGCAGCTCATGGAATTTTG | 27589 AGAGAATTAGGGTGAGGAACCTTGA | 38573 |
| 4948 CTGTTGGTCTGACATGCCCTGAT | 16606 ATCGTGGAGACTCGGCTGGAT | 27590 TTGCCCCTCTGTTGGTCTGA | 38574 |
| 4949 AGCTAGAATAGCCCCTGAGTGT | 16607 CTGACCGCTAGCCCTGTTAG | 27591 CCATACAGTGAGCTGTGGAGCTA | 38575 |
| 4950 GCTCCAAAGTGATAAGGAAGGATGA | 16608 GCTGCCACCATGACTTCTCT | 27592 GGGAATAAGAGTGTAGCTCCAAAGTGA | 38576 |
| 4951 GGATGCAGCAAAGGCAGATCTAAG | 16609 CCCCAGGCAGAGCCATATCT | 27593 CCAAAACGTTGGGATGCAGCAA | 38577 |
| 4952 CTTGCTGGATGCTCAGCTTGT | 16610 CCTCTGTCCATGCAATCCCAAGAA | 27594 CACCCAAATGTCACTTGCTGGAT | 38578 |
| 4953 ATCAGCCCAGTGGTATGTCAAG | 16611 TGGTGGAGCCAACGGATAGAT | 27595 CAGGAGGTTCTCAGCTCTGTTG | 38579 |
| 4954 GGAAGGCTGATAAGAGCAGTTTGTGA | 16612 CCCAGCTGCCTTCTCTCAACTT | 27596 CTGTGGAGAGGGAAGGCTGATAA | 38580 |
| 4955 CTGTCTGGACACGGAGCAGATAA | 16613 GGGTGCACATATTCCAGGTCAAC | 27597 AACCTTTCTTTCAAGGGCTGTCT | 38581 |
| 4956 TGGCACCAAGCCAAGGGATCT | 16614 CAGGTAGGAGGTGTTCTGGTCAAG | 27598 GACTGCAAGGATGGCACCAA | 38582 |
| 4957 CATAGATTGCCCCACTTCTAGGTT | 16615 GGGCCTGACCTGAGCCTAATA | 27599 CAGCCACCTGGAAGCTTTGT | 38583 |
| 4958 TCTCACCGCAGCCTTCCTA | 16616 CCTGGTGCAGTGGTATGCAA | 27600 TGACCTCCCAGGTTGAGGGAAT | 38584 |
| 4959 TGGGAGCTAGCCCACGTT | 16617 GACTCTAACCACTTATCACCTCCATTG | 27601 GCAGCAGATGAGATGGGAGCTA | 38585 |
| 4960 TACCCAGTCCACCTCCAACACA | 16618 GGGAGGATGGAATTCAGCCTTGT | 27602 GGCTCACCACATACCAGTCCTT | 38586 |
| 4961 GCTCTGGGAGAAAAGATAGGCAATG | 16619 GGTTGGAGCAGGGAAATCAGT | 27603 CAGCCAGCTCTGGGAGAAAAGA | 38587 |
| 4962 ATAGGCCGGTCTGAAGGAGGAA | 16620 ACCCCAAGCCACCCTCCAT | 27604 GTGTGACATGCCATGACTGAGA | 38588 |
| 4963 CTGCCATTTCTTTGGGACTGATG | 16621 ACTGGAGCAGCCTTGAGACA | 27605 CCATGGTTCCTCCTCTGCCATT | 38589 |
| 4964 CCTCTCCTTTGACATATTTCCTTCAGT | 16622 TCACAGGCCCAGAGTGTCA | 27606 CCTGAGAGCACTGAAACCTCTCCTT | 38590 |
| 4965 CTTGGTCAAGGTCCATTGGTTAGA | 16623 CCACAAGGCCGCATCTCATGT | 27607 CCAGTAATGATGAGGCAGATGTCTTG | 38591 |
| 4966 CTGGAGGATGAGGGGAGAGAACT | 16624 GCTGCACCTGTTGACCCATT | 27608 TGTTAGCCGGCTGAAGGATGA | 38592 |
| 4967 ACCCCATCTCTGCCACTGTT | 16625 ACACCCCAGGACACACCAAT | 27609 GGAACCATGCTTAACCCCATCT | 38593 |
| 4968 CCTTCTGCCTCCCCTTGAAAT | 16626 GTGGGCTTTGATGGGACTCA | 27610 CCAGATGGCTAGCATTGACCTT | 38594 |
| 4969 GTGCCTTTGAGACCTCCTGGAT | 16627 GCGACAACGGCCCCTCATTTA | 27611 GGCACTGTATGCCTAGTGCCTTTG | 38595 |
| 4970 CAGAGAGAGTCATGTGGGTATGTTT | 16628 CTTGAGTCCCTGCACCTTTAATTCT | 27612 GCTTGCCAAAGTCAGAGAGAGTCA | 38596 |
| 4971 AGTGAGCCCATGCATAACTGATAC | 16629 GCCCATGAACAAAGTAGCCATGA | 27613 GGGGAAGTGCATGATCCTGAGTGA | 38597 |
| 4972 GTCTTTGCTTGGCCTGCTGTA | 16630 GATTGCATGGCACCCAGTCT | 27614 TGACTCTCGGTTAATGTCTTTGCTT | 38598 |
| 4973 CTGCTGCTGTTAAAAGATGGGAACA | 16631 GAGGGAAGGGAAGAGAGCCTTA | 27615 CACATGACCACTGCTGCTGTT | 38599 |
| 4974 TCTAGCTAATGGAGAGGCTGAGAT | 16632 CCTTGACATCCCAGGCTCAAGT | 27616 GTGGCGCACATGTGGCATTT | 38600 |
| 4975 GGGGCAGTGAGTATTGTCTAATGA | 16633 CGAAGCCGAAAAATGGAAGCTATG | 27617 GGCATGGGGCAGTGAGTATT | 38601 |
| 4976 GCAGCTGTGCCATGTTGTGA | 16634 CCTGGCCAAGAGGCCAACAA | 27618 GGGTTGCATTGCTCCCTTATTCAGT | 38602 |
| 4977 GCTTCCTCATCATCTTCCGGTCTTTG | 16635 AGGCCCACAGAGAAGGTGACAT | 27619 GAGCTGGCTTCCTCATCATCTT | 38603 |
| 4978 TCTTCTGGAACAAGCCCAACAA | 16636 CCAGAAGTCCTGCTCTGCTTCA | 27620 GCATTCCTAGGAGGTCAATTCTTCT | 38604 |
| 4979 GGTTGTGAGGGGCAAAGCTTGA | 16637 GGCTGGGAGTCAAAATTAGGGTATC | 27621 CTTGGTGTAGACAGGTTGTGA | 38605 |
| 4980 GTCAGCTCCCTGGGCATA | 16638 GGACTGAAGTCCTCAGAAGCAAA | 27622 GGCTGAATGTACCCAGCCAAGTCA | 38606 |
| 4981 CCGTAAACCATTTGCACAGCACATT | 16639 GCCCTGGGATCCAGAATTCCTA | 27623 CCACTCCATCCGTAAACCATTTG | 38607 |
| 4982 CTCAGTTGGCCCTGTGGTAATG | 16640 CAGGAGTCCACCCCACTTTACA | 27624 GGTTGCACAGGCCTCAGTTG | 38608 |
| 4983 AGGCCACAGTGACCGAGTCT | 16641 CAGGGCTGGTCCACAAAGGAA | 27625 GCTATTTCCGAGGCCACAGT | 38609 |
| 4984 TCCGGAGCCGGGATCTTTAG | 16642 GGACAACCAGCACCCAAAGGAA | 27626 GGAGGTCTCAAAACCGGTCAGATG | 38610 |
| 4985 GGCATTGCAACTACCCTGTGTGA | 16643 GACAATGACGTGCCTCCACCAT | 27627 ACACAGAGCATTTTGGGCATT | 38611 |
| 4986 CCTGGGCTTTGCCTTCTTCA | 16644 ACCAGGCCAGGCACTAGGAA | 27628 TGATGGAAGGTCCTGGGCTTTG | 38612 |
| 4987 CTGCTCTATGCCATGGGTCTGA | 16645 AGCAGGGGAGCCCATTGATGT | 27629 TGCTTCCACCCCTGCTCTATG | 38613 |
| 4988 TGGCAGGCTTCCTCAACATC | 16646 CCCCGACCTCCCAAGCTACT | 27630 TGCTGCTGGCCCCTTCTT | 38614 |
| 4989 ACCTCCATTCAACGGATGAGAAAA | 16647 GGAGAAGTTACTTAGCCACACTGA | 27631 GCAAAATAGGCATTACCTCCATTCAAC | 38615 |
| 4990 GATAGCCCAGCCAGTGTTCTCA | 16648 ACATGCGTGGTGTCTCTAACAT | 27632 GCGTGGGAGGCCTGAAGAT | 38616 |
| 4991 GGAAGCCTCCTGCCAGATTT | 16649 GCAGCTGTTGCACTGTTTTGTT | 27633 ACACCGAAAAGGGCAAGAAAGT | 38617 |
| 4992 AGGACCTCAGAAGGGAGCAACT | 16650 CCTCGAGGAAGCCTCCCCTTA | 27634 GGTGGAGACAGTAGGACCTCAGAAG | 38618 |
| 4993 GGGAGGGGTTGCAAATTCTAACTCA | 16651 GCTTTATTTCCTGCACATCCAGGTT | 27635 GGGTAGGGGAGGGTTGCAAAT | 38619 |
| 4994 GGATGAAAGGCCTGGGGAGAAG | 16652 GCTTAGAAGCTCCACAGCTTGA | 27636 GAGATCTGCAGGGGTAGGATGA | 38620 |
| 4995 GGATGGCTGCTGCCCTCTTTA | 16653 AGTAGGGACTGTGGAGGACACA | 27637 AGTCCCCAGGCTGGCTGGAT | 38621 |
| 4996 CCATTTCATGGGGCATGACGAA | 16654 CACTGTGCAAGAACAGATGGTTCAGA | 27638 GCGTTTGCAGTTCCCATTTCA | 38622 |
| 4997 CAACATAGCCCCAAAAGACCTCAT | 16655 GCCAAGGTTCCAAGAGAGAGAA | 27639 ACAGAAAACCAACATAGCCCCAAA | 38623 |
| 4998 ACTTTGATTGTGTCACTGCTGTCT | 16656 GAAACACGGTCTCACTCTGTCA | 27640 TTGCCAATAAAAGGACAGTGAAC | 38624 |
| 4999 TGTGTCCCGGACGTGTCAAC | 16657 GCGGTTGCAGCTGTACTCTGA | 27641 CCAGAAGCCGGAAGTTGTGT | 38625 |
| 5000 GCTGGCTGTAGCAGAACTGA | 16658 TCGCCCCTCCATTGTCTTCT | 27642 GTGAATGACCAGCTGGCTGTAG | 38626 |
| 5001 CCCATACAATGTGGGGAGGTGAT | 16659 GGAGGGGCAGTGACATTCAA | 27643 CAGGACTCACCTTAGTCCCATACAA | 38627 |
| 5002 CCTCCCCAAGGGGAAGCATTTT | 16660 GCCCAAAGAGAGGGTGCTAGT | 27644 GAGAAGGGACCAAGCCAATTCA | 38628 |

FIG. 36H7

| | | | |
|---|---|---|---|
| 5003 TCTGGGAGCTTCTGCCTCATC | 16661 TGATTTGTGGGGCCAGAGAGA | 27645 TGGCCTTACATTACAGCCATTCT | 38629 |
| 5004 CTGGTTCACACGATGCAAGATG | 16662 TGGCCTTGGTTGGACACACT | 27646 TTCCACCACCACTCCCAGTGA | 38630 |
| 5005 CTGAAAGCTATGCGTGTAGTGCAT | 16663 GTGTAGGGTGTTAGTTGTCCACAGT | 27647 AGGTAGGGCCCTGAAAGCTATG | 38631 |
| 5006 GGAAAGAGGTTCAGGCTCTATGTGA | 16664 CCCAGCAACTGTAGCACTGA | 27648 CCCAGATCATATTTTGGGAAAGAGGTTCA | 38632 |
| 5007 GGATGTACCCCATGCATCCTAAC | 16665 TGAGCCAGGGAATGCCTGAA | 27649 CTGAAGGCACTAGGGAAGGATGT | 38633 |
| 5008 CCCACCTCAACCTTGCAAGTAAC | 16666 AGGGCATGGTGACACACAAC | 27650 GGGATTCTCCCACCTCAACCTT | 38634 |
| 5009 CCCAGCGTGAAGGCAAAAAG | 16667 GAAGGTCATCTTTCAGGGATTACAGA | 27651 CCCTTTGGTGATTCAGCATGGTA | 38635 |
| 5010 CAGTCAGAAGGAACAAAGGAACCAA | 16668 CCAGCCTGTCCGCCTCTAA | 27652 CAGGGAGTTGGTGTTCAGTCAGA | 38636 |
| 5011 TGAAAAGTGCATGGTCCTGTTGA | 16669 GTTGTGGAGGCGAGAGTCTGAA | 27653 CCCCAGAGTCTTTGAAAAGTGCAT | 38637 |
| 5012 GCTGGAACTCAGTCACAAGCAA | 16670 GTTGGCAACAGTTATTTTCCACCTA | 27654 GTGAAGCGATTTGCTGGAACTCA | 38638 |
| 5013 TGGCCTCAATTCCAGGCTTAC | 16671 TCCCTCAATCCTAGCATACAACAATC | 27655 CTCTCTTTCTCTCTGGCCTCAATTC | 38639 |
| 5014 GTGGTTGTAGTGACGAGTTTTGACT | 16672 GCTTCACCAAGCGTTTCCCTTGT | 27656 CCCTTGTGTTGGACTGTGGTTGT | 38640 |
| 5015 CAAGACAGCACAGGTATAGAGGAACA | 16673 AGCGTCTGCCTCACCTCTTG | 27657 GACCATACAAGACAGCACAGGTA | 38641 |
| 5016 GCTACTTCCACAATGACCAGGAATC | 16674 CCGCAGACTCAGCAAACTATTCT | 27658 GTGGTAGATTCTAGCTACTTCCACAATG | 38642 |
| 5017 GCGACCAGGATGACAGGTGTA | 16675 ACACTCTGCATAGCTCAGAACAA | 27659 TGTCAGAAGGCGACCAGGAT | 38643 |
| 5018 CACTTTGCCTGCATGAAGATTGT | 16676 CTGGAAGAAAACGGCTCTGATAAC | 27660 GAGAATCAACCACTTTGCCTGCAT | 38644 |
| 5019 CCCAGTTACATCTCCTTCTCCATTC | 16677 CCACTAGTAGCCGTGTGAAAGAT | 27661 GGGCTTCAGCTCCCAGTTACA | 38645 |
| 5020 TCCTCCGGGGTAAGGGAACA | 16678 GCCTCAACGTCCCCTATCAAGACT | 27662 ACCCCAAAGCGGCAAGAAGT | 38646 |
| 5021 GATCCAGGAGTGCTCCAGATTG | 16679 AACCCGCCACCGTTTGTCT | 27663 ACCTGGGCCTTTGTGGTGAT | 38647 |
| 5022 CTGCAGAGGATTAACCGGTCATTATCA | 16680 AGGGACAGTCTCCTAGATCTAACTATC | 27664 AGGGACAGTCTCCTAGATCTAACTATC | 38648 |
| 5023 CCCAGGCAGTGTTGACTACAA | 16681 GTGGGTGTCTCACCATTGAAGA | 27665 ACAAACAAACCCAGGCAGTGT | 38649 |
| 5024 GGCTGCTGAAGGATGACAGAT | 16682 CCATCAGATGAGTGCCTTAGTTCT | 27666 AGCTGGAGCTAGGCTGCTGAA | 38650 |
| 5025 CTCTCTCCACTGAAGTTTGTGACATTA | 16683 GAAACAGCAAGGTGTGTGCAT | 27667 CCAGAACCACTCTCTCCACTGA | 38651 |
| 5026 GCCTGGAGCTCTAGCAACTGTA | 16684 CCCATAGCCAGCATGTTTAGAGA | 27668 TGACTGGATCCCAGTGCTGTTG | 38652 |
| 5027 CATAGAGCACGAGTCCACACTT | 16685 GCAGCCAGCACTTTGTGTTTC | 27669 CGTTTGGCAAAACCTTAATCCACATAG | 38653 |
| 5028 AAGCGCAGCAGGAAGAGTCA | 16686 CCCACTCCAAGCACCAAACA | 27670 TCCTGGTCAGATGCCCACAAG | 38654 |
| 5029 ACCTTTGCCAGACATGGGATTG | 16687 TGCAGGTGGCCTGAGGTTTC | 27671 GGGGACATTCCATAGTCCATACCTTTG | 38655 |
| 5030 ATCTGGGAAGCCAGGGAGGAAA | 16688 TTGGCCCCAGGGGTGAGCATA | 27672 GAATGGGTGAGGGGAGACAATC | 38656 |
| 5031 GCTGAGGACACACCCATCTTTC | 16689 GAAAATCACCCACACCTCCAGAA | 27673 TGAAGGGCGTGAGGACACA | 38657 |
| 5032 CCTGCTCCATGACCACAGGAA | 16690 CGAAGCTGCTTTCACACACTGTGATT | 27674 TGGCCCATGCCTGCTCCAT | 38658 |
| 5033 TGTCCACACGTTGGGCTTAC | 16691 GTGCAACGAGTTACTGCCGATAATG | 27675 AGGGATGCAACCCGACTGT | 38659 |
| 5034 GAGCCTGACTCCTCCCACATA | 16692 CCCCAAGGGTCTAACCAGA | 27676 GCTAATACAACCTCTGAGCCTGACT | 38660 |
| 5035 GGAAAATCCACCCGTGAACAGA | 16693 TGGGAGTGACGTGCCACAAA | 27677 GGACAGCCAATCCAGATCACCTTCT | 38661 |
| 5036 GCCTGGTCACCTTCATCTGCTT | 16694 GGGAGTGAAGTGCAGTCCTGAAA | 27678 CCAGGAGCCTGGTCACCTT | 38662 |
| 5037 GAAGCTGGAACGTGGGTCAA | 16695 CCATATCTTCTCTCAGGCCCTATCT | 27679 GGTGAGGTCAAGAAGCTGGAA | 38663 |
| 5038 CCTGAGGTTAGGCACCTCCAA | 16696 TGGGTGCCACGTGTGATGGTA | 27680 TCTCCAGAGGCCTGAGGTTAG | 38664 |
| 5039 CCATGCTGCCATCTGGGTCAAA | 16697 AGTGGAAGAGCTTTGTGTGGTAAG | 27681 GCTTTCCACATCCTCCATAACCAT | 38665 |
| 5040 GAAAGGTGGGCTTTCCACACA | 16698 GTGGACAGCCAGGAAACAGTCA | 27682 CCCACAGTTCTCCAGTGTCAGA | 38666 |
| 5041 CTGCCTTGCATTGCGACAGA | 16699 CTGAGAAGCCGTCTGCATCCTA | 27683 AGGTGTCCCTGCCTTGCAT | 38667 |
| 5042 AGCTGTCCCGGGAACTTGAA | 16700 AGAGGAAAAGTATCTCGCCCAAAA | 27684 TCCGAATTCTTGACACCAGTCTTAG | 38668 |
| 5043 AGCCTTGCCTGTTGCCTTTC | 16701 TGCCCCGCAGGGGAATTAAAAC | 27685 GTGCAGCCTACTACTGTTTCCTT | 38669 |
| 5044 TTGCCTCTGGAGGGCACAGAA | 16702 AGGGCCAGGGCTCCAAAATC | 27686 GACGGAACCAAGATGTTCTCCAT | 38670 |
| 5045 GCCCCGGGGTCTTTGTGACATAAT | 16703 ACCATGAAGGCGCCACTGT | 27687 TATTTGCCCCGGGGTCTTTG | 38671 |
| 5046 CTCGGCTGCAGTGTCTCAGTAT | 16704 TTGCCCAGTGCGTAGCAA | 27688 GGCTGCCCTGCAATTATTGAACT | 38672 |
| 5047 GGGGAAGAAGCAAGCATCAGT | 16705 GAAAAGCAGGAGAGGCTCACT | 27689 GGAGACCAACTTTTGGGGAAGAAG | 38673 |
| 5048 GCACCAAGGGTCCATGGATGCTATAA | 16706 CACTGCACCCCGCTTCGATTTA | 27690 GATTCAGCACCAAGGGTCCAT | 38674 |
| 5049 GCCATGACCCAAGCAGCTACA | 16707 GTGGGGACTGGGCTCTCAAAAT | 27691 CCAGAGGAAGTTTGTGCCATGA | 38675 |
| 5050 ACACTTGTGGCCCTGAGTTC | 16708 ACCTCATTCCTCTGGACACA | 27692 CAGACGTTAGCACCCACACTTG | 38676 |
| 5051 TTGGGGCTCAGGCTCAGTGTT | 16709 CTGACACACAGAGGGAAAATCCTA | 27693 GGGCTTCAGGCATAGTTTGAATTG | 38677 |
| 5052 ATGGCACCTGCCACGTCAGAA | 16710 GGGATGCTTAGAGCAGGCAGTT | 27694 CCTCCGCACAAGTTGCAATG | 38678 |
| 5053 GGAGACAGGATGGAGGGTTTTG | 16711 CTTACGCACGTGGCAGAAATC | 27695 CAGCTAGCTCTAAATGAGTTTTGGAGACA | 38679 |
| 5054 AGCCCGTGGACTGAAGCTGAGTA | 16712 GGGCAGGTGTGCACTGTCTAAA | 27696 TACTGAGCAGCCGTGGACTGA | 38680 |
| 5055 CTAGGACCCACTGCAGCCATTAG | 16713 GGGAGGTGCAGTGCAGGAAAT | 27697 CCTGTTATACAGGGCCAGATGTCTTC | 38681 |
| 5056 CCCCTCTGGCCTCTTTCTTTGATG | 16714 CTGGACTTTGGGTTGGCACATT | 27698 TGCAGACCCTGTCTCCATCTT | 38682 |
| 5057 GTTCCCCGTTCTTCCCTTGTCA | 16715 CTCTCCTGCTCCTCCAAAGCAT | 27699 CCTGTGATGGTTCCCCGTTCTT | 38683 |
| 5058 ATGCAGAGCTGGGTGGCAGAA | 16716 TTCCCACCCACCAACCAGAT | 27700 GTGGCTCATGGTGGCAGTAA | 38684 |
| 5059 GAGGTTGTTCCAGGCTGATGT | 16717 CCAGGAATGCTTCCTGGCCGTTAG | 27701 AGGGATGGGTCAGAGGTTGTTC | 38685 |
| 5060 CCACCTGAAGATTGGCAGTTACA | 16718 ATGGGAAGGCCTGGGAGGTAAT | 27702 AGACAATCCAGTAATAACCACCTGAAG | 38686 |
| 5061 TCCACATCGCCTTGCCTTGA | 16719 CGCCGCACCAGGACTTGAT | 27703 GACAGGGCTTAGCTTCCACATC | 38687 |
| 5062 TTTGCCCCTTTCGGGCTGAAG | 16720 GGTGAAGAGCAGCTGAAGTGCTTA | 27704 CACCGGGGACTGGTCTCTTATTTG | 38688 |
| 5063 AACTGCACTGCTGCCCATGT | 16721 TGGTGGGACGTCAGCCTTCTA | 27705 TGCTGCAGGGGAGTTCTTCA | 38689 |
| 5064 GCCACCACCACAGTAAGAAGT | 16722 GCCTGACAGGAGTTTCTGTGGAA | 27706 TTCAAGACCTGAACACGAAGTGA | 38690 |
| 5065 ACTGCCTCCTACTTTTGACTATCTTC | 16723 GGTTGTCCAGGCCAGTTCACTA | 27707 GACTTAGAACAACTGCCTCCTACTTTTG | 38691 |
| 5066 TCTTGAGACTTAAGCAGCTACAACA | 16724 TGTTGAGGGCAGGGCTCTAA | 27708 GCTGGGTCCCTCACACTTCTT | 38692 |
| 5067 ACCTCCTACTTCATACAGGGGAAT | 16725 TGAGGTGGAAGCCAGGTCTCT | 27709 GCCCTCTGAAACCTCCTACTTC | 38693 |

FIG. 36H8

| | | | | | | |
|---|---|---|---|---|---|---|
| 5068 | CCAGCAAAGCCAGCTGTACTCA | 16726 | ACCTGGTCACCTGTGTGCTT | 27710 | GCCCGGTGTCTTTTCCCTTT | 38694 |
| 5069 | AACTCCAGGCAGAGCCAAGA | 16727 | AGACTCCCAGGGACCCAAACT | 27711 | CCCAGCAAGCTGGAGATAAAACT | 38695 |
| 5070 | CCCATTCCCATGTCTGGTCCTT | 16728 | GGCAGGGCTGTCACAATGACT | 27712 | GCTCTAAAATGCCCATTCCCATGT | 38696 |
| 5071 | GAGAGACACAATGCTTTGAACAGAA | 16729 | ACACAACTTAGTGCAGGCCAAA | 27713 | GGGCAGTCCAGAGAGACACA | 38697 |
| 5072 | CACCCCTCTTCAAGACTGAGGAA | 16730 | CCAACACCCAGGCAGCTGAA | 27714 | AATACCAGAAAACACCCCTCTTCAA | 38698 |
| 5073 | CAGGAAACCCACAGGCAGTTGT | 16731 | GCTGCCTTTGCCCCTGTCTT | 27715 | CCACTGCCGTCAGGAAAC | 38699 |
| 5074 | GCAAAAGATCACTCTGGCCACTTC | 16732 | TCCACCCTCGCCTCTCCATT | 27716 | TCTGCTCAGCAAAAGATCACTCT | 38700 |
| 5075 | TTGGGGCTGAAGCCAGGAA | 16733 | GAGGGCTACCAGTAAGAACCAGAGA | 27717 | GGCTGATATTGACAGCCAGGGTTTG | 38701 |
| 5076 | CAGTGGCAGTGGCAGTGA | 16734 | CCTGGGGCCAGACAACTGA | 27718 | CCCAGGCAAAGTATGTGGGTACT | 38702 |
| 5077 | TGAACCCCATTCAGGCAGGAT | 16735 | CCCAAATGCACTGAGCTGTCA | 27719 | CTCTTCTGTTAACCAATGAACCCCATTC | 38703 |
| 5078 | TGTCACTGCCTGCTCCTTCT | 16736 | TTCTTGGGCCAGTGAAGAGAAAA | 27720 | CGCAGCCAGTTGCTGTCA | 38704 |
| 5079 | TACCACAGGGCTGGTCTGAGGAT | 16737 | ACCAGAATCTTCACAGAGTTTGTCT | 27721 | TCAGGACAGTCATTTCTGCTCTAC | 38705 |
| 5080 | ACTGAGACACTGGGGTGCTT | 16738 | CAGTGCAATGCTTTCACCATGT | 27722 | TGAGGGATGGGCTTATCACAGA | 38706 |
| 5081 | ACAAATGCATCCTCCGCTTACA | 16739 | TTTCTGTGCCAGCTGGTTTTG | 27723 | GTTGTTTCTCCCACCTCTTCACAA | 38707 |
| 5082 | GACTAAATTGGCTAGAGGGGCAGAAG | 16740 | CCTCCCTGAAGTTGCCTTCTCA | 27724 | GTGTCCTGGAGACTAAATTGGCTAGA | 38708 |
| 5083 | CACAGGGCTGTGGCCATATTTTC | 16741 | TGAAGGGATTCCATTTTCTGGCTTT | 27725 | GCAAGTAGGGTCCATCTACTCACA | 38709 |
| 5084 | GGGTCCCTTGTATAACCCAAAACT | 16742 | TCAGTCCCTGGCCCCGTGAT | 27726 | CGGGAGGTTTAGTAACAGGAGGACAAG | 38710 |
| 5085 | ACATATGACTTTGAGTTCGGTGAGA | 16743 | GCAGATCTCTCTAGGCTTTGTGT | 27727 | GGTGTATGCCTCCATGACCTTGA | 38711 |
| 5086 | GCCTCAGGTAGGAACCTAAAGTCTCA | 16744 | ACCACTCTAGTGCCCCTGAA | 27728 | GCATATGCTCCAGCCTCAGGTA | 38712 |
| 5087 | CCTTCACTGTATCTGACGGGAAAC | 16745 | GAAGGCGAGCAGCAGTCA | 27729 | GGCCCCTCTGTTTCTGTCTT | 38713 |
| 5088 | GCGCGCGTAAGAACCATAGAGT | 16746 | ACAGAGGCGTCACCCGTCTT | 27730 | CGCATGGCTTATATAGGCGGTCTGT | 38714 |
| 5089 | GGCTGACTGGTCCCATCTTC | 16747 | CCCTGGGAAGTGACAGCTCAA | 27731 | ATCCCCAGCACGGCTGACT | 38715 |
| 5090 | GCTTTAGTCTGCATTTGCTGTGT | 16748 | AGAGGGTGCTCAGGTGTTTAGA | 27732 | CAGCAACTTTGCTTTAGTCTGCAT | 38716 |
| 5091 | TGTGTCTACCTTCGGGGAAAAG | 16749 | CTCGGAACTCCTGCCAAGAAG | 27733 | AGCCAGGCCAATCAGGATCAAG | 38717 |
| 5092 | GGTGGGTGGAGCAACAATTTTGGAA | 16750 | CTCAGGTTCAAAATCAGGCAGGTT | 27734 | GCAAGGTGGGTGGAGCAACA | 38718 |
| 5093 | GCCATCCAAAAAGGAGCTTAGATTT | 16751 | GCTGCCTCACTGTCTGATGT | 27735 | GCCAGGTCTTGCCATCCAAA | 38719 |
| 5094 | GGTCGGTGCAAGGATTGAATG | 16752 | GGCCCTGTTCGAAGCAGTTT | 27736 | TACCTCACAGGTCGGTGCAA | 38720 |
| 5095 | TCCTGGCCACTTAGCACACA | 16753 | GACTGGGAGCTCTTTGCTCAT | 27737 | GCATTTCTGGTTTTCAACGTGTCT | 38721 |
| 5096 | GCCCCTGGATCAGCTCCATTTT | 16754 | AGCAGTGCGGTCGGGATGA | 27738 | CCCCATGCTCCATGTGCAA | 38722 |
| 5097 | GAGCAGAAGTGTTGTTTGTCACAT | 16755 | GGAAATGGCACACTGGTTCTCA | 27739 | TGACCACTTGTTTACCACTGAAACAT | 38723 |
| 5098 | GGCAGACATCGCTTCAGGTA | 16756 | GCTGAGCGTTGGAAGCCATT | 27740 | GTCGTGACCAAAGGCAGACATC | 38724 |
| 5099 | GACCGCCTGTGGAAATGTGTGT | 16757 | CACCCCTGACATGTGTGGTACA | 27741 | AGAGATACACCTCCCAGCATGA | 38725 |
| 5100 | TCGCCAGCGTCAACACCATT | 16758 | GGACAAGTAGCGATCCACTGACA | 27742 | GGTTAGCCTCACCCACCTGTTC | 38726 |
| 5101 | GACAACACGGGCACATCTCA | 16759 | TTCCACCTGGCTCCTATCTCTT | 27743 | GCAATGAGCTCTTGATCCATCTGA | 38727 |
| 5102 | CTGGGGCCTAGGCTGAAGA | 16760 | CATGTATCTTGCGCAGGGTTTC | 27744 | GAGGGTGGATAGAACGGTTACACT | 38728 |
| 5103 | AAGAGGCTTAGGAAGGTTAAGAACTAC | 16761 | TGGGGTCCTGGGAGCCAAAT | 27745 | CCCAGAAGGTTAAGAGGCTTAGGAA | 38729 |
| 5104 | CGAACTTCGAGCCCACGTGAT | 16762 | CCGGAGTGGAAGGGCAACAATA | 27746 | GGAAAGGCGACCCCGAACTT | 38730 |
| 5105 | GTCAGCTCTAAAGCACTCTCTTTCA | 16763 | CTGATGCCAAGGCCGTATATCAT | 27747 | GCAGAAGCATTAGCAGTCAGCTCA | 38731 |
| 5106 | GGTGGGTACAGTGAGGTGAAATG | 16764 | CAGATGCCTGCTGCTTCGT | 27748 | AGGGCAGGTGGGTGTACAGTGA | 38732 |
| 5107 | GGGCTGCCAGCAACAACAAA | 16765 | GAGACAGGGTTTGCAGGAAGGAA | 27749 | GCAGAGGGCAGATGAAGGAAAG | 38733 |
| 5108 | GCCACCATAGCTTACCCACAGTA | 16766 | GGCTGGGGTCACTGTACTTTCCTT | 27750 | GAAGCAGAGCCACCATAGCTT | 38734 |
| 5109 | GGTCAAGGACACACAGAGATGT | 16767 | CTTCTTCCCCACAGACCACATTG | 27751 | GGGCCAACTTCTGATTCTAGGTCAAG | 38735 |
| 5110 | GGAAGCTCTTTCCTGTGAGAGTTAG | 16768 | AGCTGGGGAACCAGGATGAAC | 27752 | CCCAGGTAGAGTCACTGCTTCTGT | 38736 |
| 5111 | GGACCCCATTGATCAGGGTAGATG | 16769 | GGTTGTGACAAGACGCACACA | 27753 | AGACTTCCAGAGGACCCCATTG | 38737 |
| 5112 | CTCCCCACCACCTTCTCAATTTTTC | 16770 | CACTTCTTAGGCGCTTCCGGTTTC | 27754 | ACCCTCCCCACCACCTTCT | 38738 |
| 5113 | AGGCACCTGGCTGTGCAA | 16771 | CCGGGGCCCTTCAAACAT | 27755 | GCAGTTGACAGGAAGCAGAGA | 38739 |
| 5114 | CTCAGAGTCCCTGTTGGTGTGT | 16772 | CACCCACCCTTGCCAACCATAA | 27756 | TCCAAACAGACCTTCCCTCAGA | 38740 |
| 5115 | ATGGGGACCCATGCTGCTTA | 16773 | CCAAAATGATGGCAAGCAGCTACCTA | 27757 | ATCCAGTTGGCGCCCTTGT | 38741 |
| 5116 | TGCTATGGTCTGCGGGTAAG | 16774 | GTGCTCACCAGCCACATTGT | 27758 | CCCAAGAGGGGCTGCTATG | 38742 |
| 5117 | GGTCTGGTAACCTTTCCAAGGAAGTAAG | 16775 | CAACAAGTGCCACCCTCAGA | 27759 | GCCCTAATTAATGGTCTGGTAACCTTTC | 38743 |
| 5118 | CTCCGCATGCCACAGTCTGTTA | 16776 | GCAATGGTCATGGATGGAGCTT | 27760 | GGAGTCAGGTTGTTAGCACTGT | 38744 |
| 5119 | TGACCGGCCCATTGGATGA | 16777 | GTGCGGGGCCTCTGAACATA | 27761 | AGGCTGCAGGTCCTTTCTGA | 38745 |
| 5120 | GCATCCCCACTTGAAGAAATCAAAG | 16778 | GCTCCAAGACCAGCCATACCTA | 27762 | CCCAGCATCCCCACTTGGAA | 38746 |
| 5121 | CTCACCTCACTCTGTCAATGGTAAAC | 16779 | CTTTGCTGCTAGGTTGGGATCA | 27763 | CGAGCTCACCTCACTCTGTCA | 38747 |
| 5122 | ACTGTCCCCAACCCAGTTCA | 16780 | AGGGACAGCTGCCCAGGTT | 27764 | TGCCTCCCACCTCTACCCTATT | 38748 |
| 5123 | ACGCAGGTGATGACCACAGA | 16781 | GCGTGCACAGCTGAGAATCCTT | 27765 | TCATGATAGGTAGATACGCAGGTGAT | 38749 |
| 5124 | AACCCTAGGGCGGTGTGT | 16782 | TCGGTCCGAGGTCCCTTAGA | 27766 | GGACCGCTTCGGTGTGCAA | 38750 |
| 5125 | AGGACCCCAAAGCCCATGAAGA | 16783 | CCCAGGTCTGAGCCACTTACTCT | 27767 | TGGGCAGCAGGACCCCAAA | 38751 |
| 5126 | GGGTACCTGATGGCCTCTCTTTG | 16784 | GCCCCATGCCTATAACCTGCTA | 27768 | AGTGAAGCCCGGGTACCTGAT | 38752 |
| 5127 | CCTGTGCGTGGGATAGATAAGCAA | 16785 | CTATGAAGGCAGGGACTTCTGTT | 27769 | AACAGCCTGTGCGTGGGATA | 38753 |
| 5128 | TTGCTGCCCTGGGACTCA | 16786 | GTGGTGGAGGGAAGAGAAACTTG | 27770 | TCTGCCTCTTCCTGCTGGTT | 38754 |
| 5129 | AGAGCAGGAACACTGGAAAACTT | 16787 | TCCCTTGGCCAACTCCCTTCT | 27771 | GTCACAGTTAAAGAGCAGGAACACT | 38755 |
| 5130 | CAGGGGAGAGGGAGACAGTCAT | 16788 | CCCCTCTCTGACCATCCATATCT | 27772 | AGAGGCAGTGGCAGTCAAAC | 38756 |
| 5131 | GCAACCCCACACTTTCTCTGACT | 16789 | CCTTGGGCTGAGTGTGGTTAAG | 27773 | GCACACCCAAGGTCAGCAA | 38757 |
| 5132 | GCAGAGGGAGAAACAACCAGAAA | 16790 | AAAGATTGGCTGAGGCTTCTGT | 27774 | GAGTAGGATTAGGCAGAGGGAGAAA | 38758 |

FIG. 36H9

| | | | | | | |
|---|---|---|---|---|---|---|
| 5133 | CTGAATCATTGGAGGGCTGTGGTT | 16791 | ACGTTTTCCTCCGTGCCAAA | 27775 | GGAAGGGTTTGGCTCTGAATCATTG | 38759 |
| 5134 | GCTGGGCAGCAGGTTGTAGTAA | 16792 | CAGAGCACATGACCCAAAGACT | 27776 | GCATATGAGGGGCCAGGGTTTC | 38760 |
| 5135 | CCCAGAGGAGCGGTAGTCAAAA | 16793 | TCATCATGGTGGGTCTCTGAGTA | 27777 | CCCTGTATGGCAGGGAGAAAGA | 38761 |
| 5136 | CCCCTACCATAGCATTTGCCTCCTT | 16794 | CAAATACAGCCCCAGGTTACTGT | 27778 | GAGCCTCCCCTACCATAGCATT | 38762 |
| 5137 | CAGTGCAAAGGCCTGGAACA | 16795 | GCACAAAGGTTCATGGACAGGAAAGA | 27779 | CATGTGAATTGTGGTCAGTGCAAA | 38763 |
| 5138 | CGTTGTAGGGCAAGACCACAGT | 16796 | CCAGCCAGGCAGTCATAGACAGA | 27780 | GGGGAAGGATTTCCCGTTGT | 38764 |
| 5139 | CAGGGTGTTTGTTATCCTCTCTGACT | 16797 | TAGGGGACGGGACAGTTGTAG | 27781 | ACCCTCACAGGGTGTTTGTTATC | 38765 |
| 5140 | CCCACCTGTCTTTTGATCGCATT | 16798 | GCATGCTCACGTCAAACTCGATA | 27782 | GCCTTTTAACACCCACCTGTCT | 38766 |
| 5141 | GACTGGGACTCGCAAGCAAACT | 16799 | TGAGGCCAAAGAGGGAAATGATTCT | 27783 | GCATGGGGCAGGAGTGTAAAGA | 38767 |
| 5142 | TCGTACAGCAAAAACCTGACCTT | 16800 | GCTGCTCCATCTTGTCCAGAAC | 27784 | GAGACCTGAGCTGGACTAGAACTT | 38768 |
| 5143 | GCACTTTTGGAACCCAGCCTTT | 16801 | TGGATGCACACATGCAAGAAAGA | 27785 | GCCTCCAGCAACAATGAGCACTT | 38769 |
| 5144 | GCTCAGGCACCCGATCTTG | 16802 | GGCAGAGGACAGGCTAAAACT | 27786 | ACGTGGGCCACCAGAAAG | 38770 |
| 5145 | GCTTGGGCTTCACCCAACAA | 16803 | CCCCAACCAGGGATGTTGCTT | 27787 | CCTCGGGCACATGCCTTTAGAA | 38771 |
| 5146 | CGGGGCCCTTTCAGGAACTAC | 16804 | AGGAGTTCTTCCCACTCTGTTGT | 27788 | GAAATAAGTACCGGGGCCCTTTC | 38772 |
| 5147 | ATTCAAGGAACAGGGGACCAAAT | 16805 | AGCTGTGTCCCTCCATAAAGAAAG | 27789 | ACAAGTGCGTATCATTCAAGGAACA | 38773 |
| 5148 | TGTTTAGGCAAGGAGCCTGTAG | 16806 | AGGCACCAGTGCAAGTCAAG | 27790 | GCAGGTGGTGGGCATTCTTGTT | 38774 |
| 5149 | GCCACAGTTCATACCTACACGAA | 16807 | CTCTCAATTGCTCTCGAACTTGTTG | 27791 | TGCCGGGCCACAGTTCATAC | 38775 |
| 5150 | TCTCTGCCACCCAAGATCTCTTTA | 16808 | CCTCCTTGCGGTGGAGAAATGA | 27792 | CCACCTGGTAGCAAGGATGGAGAT | 38776 |
| 5151 | GGGGAAGTTGCACGGTCAAAAA | 16809 | CCCTGGACCCTGCTGATTGTTT | 27793 | CCAGTTGGCTTGGGGAAGTT | 38777 |
| 5152 | CACCCCAGCTGTAGCATGATGA | 16810 | GGCCCAGACATTGCAAGGCATAG | 27794 | TGGCAAACACCCCAGCTGTA | 38778 |
| 5153 | TCCCTATCCCATAACTCGCTATTGA | 16811 | AGGCCTGCATCTGATGGTATCT | 27795 | CCCAAGTGATCATCCCTATCCCATA | 38779 |
| 5154 | CGAAGGCCTTGGACCTTCCTT | 16812 | AGGAGGGCTGTGTCCTTGAGA | 27796 | GGGCGGGGATGTGAATCCTAAA | 38780 |
| 5155 | CTCCAGGAACAACTTGGGTCAT | 16813 | GCCAAGAATTAGACCTTGCATCCTT | 27797 | GTCCTCACTTACATGACTCCAGGAA | 38781 |
| 5156 | GCATATGCAGAAATCACATGGCAAAG | 16814 | GCCTCCTGCCTTTCCCTCTT | 27798 | GGAGCCTGGCATATGCAGAAA | 38782 |
| 5157 | GCGAGACTGGTTAGCACGGTTA | 16815 | CCAGCAGCCGAATGAGATTGGATA | 27799 | GTGGTCCTGAATCTAAAGCGAGACT | 38783 |
| 5158 | CCTCAGCTGCAGCCTTCAAA | 16816 | TCAGTACCGAGAGGCGATGGAA | 27800 | GGCCCTAGCCTTGGCTTCA | 38784 |
| 5159 | CGTTGTGCATTCCTCTGCTTGT | 16817 | ATCTCTGGCCTAGGTGGTTCA | 27801 | CTTCTCTGCACGTTGTGCATTC | 38785 |
| 5160 | CGTCATGCCGCCAGTCTTG | 16818 | CTCTGGCAGAAGTGTGAAGAAGTAAT | 27802 | TCTGGCCTGCACTACTGAAATAAG | 38786 |
| 5161 | GGAGGCACAGCTACTTCCCAAA | 16819 | TTGGGCCCTCTGGCTCTAAA | 27803 | TGTATACAGGGAGGCACAGCTA | 38787 |
| 5162 | CATGCCTTGCTGTGTTGCAT | 16820 | CGCACATGTTGGTGACAACTTT | 27804 | GCCCAGCCACACTAAATTGCAT | 38788 |
| 5163 | CCCTTCCTTTTTCTACCTTGTGTGT | 16821 | GGGAGTAGCTGGAATGGGTGAT | 27805 | CACTGACCATTCCCCTTCCTTT | 38789 |
| 5164 | CCCACCTCTCCCAGAGTATGTCA | 16822 | TTGCCCTCAGGCCTTCTCA | 27806 | ACTCTAGGTGGTCGGTGGTGTT | 38790 |
| 5165 | GCCTCAGTCAGCTTCCTCCAA | 16823 | CCAACCGGAGAGCAAAAGGGAAA | 27807 | CGGAAAAGGAGGCCTCAGTCA | 38791 |
| 5166 | ATGGGGAAGGAGGCCCAGGAA | 16824 | CGTGACGGTGTGGGTTTCCAA | 27808 | GGTGGCTACAGGTGCAAGGAT | 38792 |
| 5167 | CAGCCAAACTTCTGCATGACTCT | 16825 | TCCCGGGCTTCCAGAACAAC | 27809 | TGGCAGCAGCCAAACTTCT | 38793 |
| 5168 | AGGCTGAACAGCTGCAGAGA | 16826 | CTCAGCAGAGAGGAGGCCTTAGA | 27810 | GCCAGAGCTGAGCAGTCATCA | 38794 |
| 5169 | GCCGCTGACATGCTTCCAAA | 16827 | CAGGCCTGTGGTGGGTTTTTGT | 27811 | CCACAGTATCGCCGCTGACAT | 38795 |
| 5170 | TGGGCGGAGTGCCAAGTAATG | 16828 | CCATGGCTCCCATTCTGCATGT | 27812 | AAAGCCTCCGCCTCTTGTTG | 38796 |
| 5171 | CATGCCTTCGTGATTACTTGCATGA | 16829 | AGGCAGGCGTAGGGCAGTTA | 27813 | TGCTCTCCCTGACACCATGT | 38797 |
| 5172 | GCCAATTGGTGCAAGAGATCACA | 16830 | CTCCCCTCTCACCCATGCTT | 27814 | AGGGGAGCCAATTGGTGCAA | 38798 |
| 5173 | AGGTGTGAAGTGACCACAAAGT | 16831 | ACCCAGTTCAGAGCCTCCTT | 27815 | GCAGAGGTCAGGTGTGAAGTGA | 38799 |
| 5174 | ACCCCTCATTCTGCGCACTT | 16832 | TTTCTATAGACTTTCGCCAGTGGAA | 27816 | CAGGGAAATCCTATAACTACCCCTCATTC | 38800 |
| 5175 | TCCTCTGTACCTGTCCCCTCTTC | 16833 | GCAGATGGGTGTGGAGAGCAA | 27817 | CCTCCTGGCTACTCCTCTGT | 38801 |
| 5176 | CAAGCAACACTCCCACCTTTG | 16834 | GACTCATGCCTGTATCCTCAGCTA | 27818 | GGTCTCAAACTCCTGGGTACAAG | 38802 |
| 5177 | AGGGCCGACCGTGGTTTTC | 16835 | CAACTTGTGGGTGCGGGTAT | 27819 | GCATGCCCATTGAGTCTGCTACT | 38803 |
| 5178 | CTCCATCCAGTGCTTAAAGCTGAT | 16836 | GAAGGCTGGAACCATCGAAGT | 27820 | AGTCCCTTGTGGTTTTTACTCCAT | 38804 |
| 5179 | GAGGAAGAGGCTAAATGTCTAGAGAAG | 16837 | CTTGTTCCAACGGGTCAGCAT | 27821 | GCAGGAGGAGGAAGAGGCTAAATG | 38805 |
| 5180 | GCACTAGGACCTCCCAGTACTCTT | 16838 | TGGGTGCTGGAGACCTTGTCA | 27822 | GGGTCGTGGGCTTCATCAGT | 38806 |
| 5181 | CACATAGGCAGCACAGTCATGGAT | 16839 | GGCTCCTGGGAAGCACCTT | 27823 | AAGCCTGGCCACACACATAG | 38807 |
| 5182 | GTGCCTGCCAAGAGAACATCT | 16840 | GCTTCAGGCCAGCTTCAGTAGT | 27824 | CTGTTGTGGCACATGAACTTTTCT | 38808 |
| 5183 | TCCCTTTGGACAACAGGGTAGT | 16841 | CCAGGTTCCAGGCACGACTT | 27825 | GTCGTCCTCTCAGTATTCCCTTTG | 38809 |
| 5184 | ACACTCGCAGGCCACTGA | 16842 | ACCAGCAGCCAGAGGAGTCA | 27826 | GCCAAAGGTAGCAACATTGACACT | 38810 |
| 5185 | GGCCCCAGGAAGACTAGTCAGAT | 16843 | GGCTCTCCCACCCCAGTTTAC | 27827 | CCAAATTCAGGCCCCAGGAAGA | 38811 |
| 5186 | GCCACCTCTCACTCTCTTGATCT | 16844 | TCACTGGCTGAGGGAGACA | 27828 | CACTTAGCAGCCACCTCTCACT | 38812 |
| 5187 | GAACAACCTTCCAAGTTGGTCTCA | 16845 | AAGAATCCCTGAGGCAGTAACATC | 27829 | AAATGCCAGGGGAACAACCTT | 38813 |
| 5188 | GATGATGTCATTAAGGTGGGGAATTTG | 16846 | CCTTCTGCCTATGTGCAGTTCT | 27830 | GGTCGCCGTACATGTAATTAGTGA | 38814 |
| 5189 | GCCTAGAAGATGCTGCCCCTTAG | 16847 | CCACCCAGCCTCTCCTTCACTT | 27831 | GCAACCATAACAGGGCCTAGA | 38815 |
| 5190 | TGGGCAGAGATGAGGACCAACA | 16848 | GCCAGCCACTGTGCCACTAT | 27832 | TCCCCGTGGGCAGAGATGA | 38816 |
| 5191 | GGAAAGGGGCAGCAAGAATGAGA | 16849 | GCACCCAAGCCACAAGACAA | 27833 | GGGGAAAATCCTCTGCTTGTGGAAA | 38817 |
| 5192 | GCTCTTCCGCCATGGGATAATG | 16850 | TGGCACAGGCATCTGGTGTAG | 27834 | TCCCTTGCCCTTTCTGCTCTT | 38818 |
| 5193 | CCAACCCACTGCAACAACTGCTA | 16851 | TCCTCTGGGTGCCAAACAGT | 27835 | TCCACCCAACCCACTGCAA | 38819 |
| 5194 | TCCTGGCCAGCAAAGGCAAT | 16852 | GCCCTCGGGAAGAAATCAAGA | 27836 | TGGTGGCTGCTTTTACAATCTTTTG | 38820 |
| 5195 | TCCAGCTCAGTCCCTCTTGT | 16853 | CGGGGTGACATTATTGCCTAAGT | 27837 | GGACCACAGAATCCAGCTCAGT | 38821 |
| 5196 | GGTTAATGGCTGCCCTCCTACT | 16854 | GCATGCTGGCTGCTGACATAG | 27838 | CCCACTGGTGAAACCTGGTTAATG | 38822 |
| 5197 | TCAGCTGTGCCCCACTAACA | 16855 | GTGCACAGGCCTCCTGGATTTA | 27839 | GGTGAGGCCAGTTTCACTTCA | 38823 |

FIG. 36H10

| | | | |
|---|---|---|---|
| 5198 CAGGTGTGTCATCTCCCTGGTT | 16856 CGGCAGGCAGGATGGGAAT | 27840 TGCCCCACAGGTGTGTCAT | 38824 |
| 5199 CTTCTCGAAGGCTATCCTAACTGTTT | 16857 TTGGCAGGTGGCTGCCATTGA | 27841 TGGAGGATCTTCTCGAAGGCTAT | 38825 |
| 5200 TGGAGGGAGCGGCTGATTG | 16858 AGCCATCATGCCCAGTGCAA | 27842 AGCTCAGACCATTGCCTCTTG | 38826 |
| 5201 AGTAGTGGGGCAATGGGGAGAA | 16859 GTCTCAAGAGACTCATATGCCCTGGAT | 27843 CCAGCTTCAAAGGGGTGTTTCT | 38827 |
| 5202 AGCCCATAGCCCTGTGGTTACT | 16860 GGCCTGAATTCACACAGGCATT | 27844 ACACAGGTGCAAGCCCATAG | 38828 |
| 5203 GCTGTGCCTGTTGTCAGCAATG | 16861 CAGTGGCCCACCAACCTCAT | 27845 ACCAAGGCTGTGCCTGTTG | 38829 |
| 5204 CATGAGTGGCCACCCTGTTTG | 16862 CCAAAAGGCATGGGGTAGGGATT | 27846 CACCGGCTCTGCCAAAACAT | 38830 |
| 5205 GCCCTCAGCTTCCTGAGCTA | 16863 TCCCCTGGCTGCTCTGAGAAAT | 27847 TGTCTCGGCCCTCAGCTT | 38831 |
| 5206 CTCTGCTTGCTCTCTGTGCTT | 16864 ATGCGCTTGGTCCCTTCCTT | 27848 CCAACCTCATAGCCTGACACTTTC | 38832 |
| 5207 TGGTGAAGAGGTCCCCTAAATTCT | 16865 TGGGCCATCCACAGCTTTC | 27849 CCTGCTTCTTTGCCCAGATTTTG | 38833 |
| 5208 TGGCTGTCCTCCAAATTGGTTATC | 16866 GGCCGGAAGGAGACCAGACTA | 27850 CCAATGAATGGCTGTCCTCCAA | 38834 |
| 5209 ACTGGAGGCAGCACCTGGATT | 16867 TTTTGGCCCCAGCTGGACTCT | 27851 GGTTGGGTGACTTTCCCAGACT | 38835 |
| 5210 CTGGAGAGCTTTTCTCTACTGGAGCTA | 16868 TGGCTGGCATCAGCCAGATTTC | 27852 CAGCTTCTGGAGAGCTTTTCTCT | 38836 |
| 5211 CCTTGGCCTCTTACCCTTCCTT | 16869 CCTGTCCTGACACCATCCAGTAA | 27853 AGTGACAGCCTTGGCCTCTTA | 38837 |
| 5212 CCTTCTCAGCGCTCCTCCTT | 16870 CATCAGAGCAGAGAAGCAGTTGAT | 27854 TGCCGGGATCCCTTCTCA | 38838 |
| 5213 GCTCCTTGCACTCCCATCTT | 16871 CACAGTGTTGATGGCATTGTCTCT | 27855 TGATGCCTGCACAGCTCCTT | 38839 |
| 5214 GAGCCCAAAGCGGCCAATG | 16872 GCCCATGCCTCTTCTGCTTGT | 27856 TGAGCACCAAGGAGCCCAAA | 38840 |
| 5215 GACCAACCCAACTCTCCCCATT | 16873 TGAGCCAGCCCAGAGTTCAGT | 27857 CCAGTGACCCAGGGACCAA | 38841 |
| 5216 TCGCGCAGAGGCCACAATTA | 16874 TTTGGCGCCAGGAGTAGCTT | 27858 GGGCAGCACTTCATCGTTCT | 38842 |
| 5217 GATGCAGGAGTGCCTGTGGAAT | 16875 TGCCTGCTCAGCCTCATT | 27859 TGGGCAAGGGCATGTGGTAA | 38843 |
| 5218 ACGGTGGCTGCCTTCTCCTTT | 16876 GCAACAGACACCAGCACATC | 27860 GGCCAGGAAGCTTGAGGAAGAT | 38844 |
| 5219 AGGCTCGGGGACACTCAA | 16877 GGACTAAAAGAGAGATCCAGGCTAAC | 27861 CTGCCAAAGCACTTTTGGGAACAT | 38845 |
| 5220 CCTCTGAGAGTTGCCTGCACAA | 16878 GCCCAGGCACCTCCACTCATA | 27862 AACCCTGCCCTCTGAGAGTTG | 38846 |
| 5221 TGCCCACCTCCCCGCTTTCT | 16879 TGCCGTCAGCCCTGGAAAAA | 27863 CACTTCAAAGCCCTCGTCCAT | 38847 |
| 5222 CCAAGCCAGAGGGAATTGTCTATC | 16880 GCTGGCCGGAACTCAGCTT | 27864 AGCCCAAGCCAGAGGGAAT | 38848 |
| 5223 TCGTTGACCCTGCCATGAGT | 16881 GAGGAGGGCCAGAGCAATATC | 27865 CCTCTTGATCCTTTGGACTCGTTGA | 38849 |
| 5224 AGGGGAGGACACAGAGTATTTCA | 16882 AGGCAAACAACCTCACCATTTAGT | 27866 AGAGTCTGTAGGGGAGGACACA | 38850 |
| 5225 GGGAGACACCAGTTAAGTGGCTAA | 16883 GCTTTGGGAGGTGTGGCATA | 27867 CGGCCTAGGGAGACACCAGTTA | 38851 |
| 5226 GACACCTAGCCGTGACTTCTGA | 16884 TGGGTAGGCCCACAGCATCT | 27868 CGTGGTCCAACAGTGACACCTA | 38852 |
| 5227 CAAAGCAGGCAGCCATCTCA | 16885 GCCAGGAAAGGGACATCAAAGT | 27869 CCATGAAACCCACAGCCTCTAA | 38853 |
| 5228 TGGACAGAGTGCCCCACAGAT | 16886 CAGAAGCGGCATGCCTTGAT | 27870 TCCCAAAGCAGGTGGACAGAGT | 38854 |
| 5229 GAGCTCCCATGTTCTTTCTTGGAT | 16887 AGCACCCAGCCCTCACACT | 27871 TTTTCTGTTGAGCTCCCATGTTCT | 38855 |
| 5230 TCTGCCCTGTGAGGAGGATGAA | 16888 CATGTGCTACCCATGGTGTTACT | 27872 TCCAAGAGTCTGCCCTGTGA | 38856 |
| 5231 AGAGCTGGGAGGGCAGTGA | 16889 GGCTGCCTATAACCAAGCAATCA | 27873 GGGTATCAGCACCAGCTCTAACA | 38857 |
| 5232 GCACAGGAAGGAGGTGCAAA | 16890 CTGGCCGGCACCACTCTTTTAT | 27874 GACCCAGAAGATGCACAGGAA | 38858 |
| 5233 GCCCAAATGGGCCCCTCTAC | 16891 GGGGTCCAGCTGAACTTCTGA | 27875 TCAACCCCAGGAGCCCAAATG | 38859 |
| 5234 ATCTGTGCATGTATGGCTTCAAAC | 16892 GTGAAACCTGCTGGAGGGATT | 27876 TGCCATGGGTGATTCTTCATGT | 38860 |
| 5235 ACAAAGACACTGCCGTTACTCA | 16893 GCTTTGTCCCTGGCTCAAAACCTT | 27877 GGGACCCACCATAAATAACAAAGACACT | 38861 |
| 5236 GCCTACATGTATGGGAAGGGAGCTA | 16894 CCATATATCCCACGCCAGGCTCTT | 27878 GTCTCTGGCTTCCTTGCCTACA | 38862 |
| 5237 GGGTGGATAGAAACCAAGGCATA | 16895 CCTGTGTCCTTTTGCAAATCAGT | 27879 TGGGTCTCAGGGTGGATAGAAAC | 38863 |
| 5238 GTGTCATAAACCCTTACTGGGGAGAA | 16896 GGGGCCTCCAAAAACACAAC | 27880 GCTCCTGATGTGTGTCATAAACCCTTAC | 38864 |
| 5239 TCCCAGGGAGCTCTGCTTTG | 16897 CCTCAGGATGACAGTGAATACAACTGAA | 27881 CCAGACAGCCTCATACTGCAA | 38865 |
| 5240 CAGTGTCCCAGGCCCTTGTAG | 16898 TCCTCTTGCTGCAGTGTGATT | 27882 AGAGAGAGCTGAGGGGTACAGT | 38866 |
| 5241 CCTGGAGCCTGAGATTGTGGGATT | 16899 CTTCTAAGCCCACCCCAACACT | 27883 GCATGCCTGGAGCCTGAGAT | 38867 |
| 5242 GGCTTACGGGTAAGAACAGGACAAA | 16900 CTGTGTTAGCAGGGATCAGGTCTA | 27884 GGAAGAGTTGTGGGAGGCTTAC | 38868 |
| 5243 GTGAGTGCAGCTTCAGCGGATT | 16901 AGCGCTGGCAGGCAGGAAT | 27885 GCAGCTGTGAGTGCAGCTT | 38869 |
| 5244 CCACCATTGCCCTGCTTCAGA | 16902 ACTGAAAATAGCTCAGGTGCAACA | 27886 TCCTTCTTGCCTCCCACCATTG | 38870 |
| 5245 GCTTCCCTCCAGTTCCAGTAAGAA | 16903 CAGTAGGACTCTTAGGCCTGTGGTT | 27887 AACAGAAGCTTCCCTCCAGTTC | 38871 |
| 5246 CCAGATAACCCTCACAATAGGTTTCT | 16904 GGAGGAGGCTGGTGTTCATAAG | 27888 TGGTGACCAGATAACCCTCACA | 38872 |
| 5247 GAAGCCTATCAGGAGCTTTGTGAGTT | 16905 GTGGCCACAGCAGTGATGAT | 27889 TGCAGGAACAGGGAAGCCTATC | 38873 |
| 5248 GCCCCTACTCAAGGGTGCACTAA | 16906 TCTTGCCCTCCTCATGGCTAA | 27890 CCCAGTGGATAGCCCCTACTCAA | 38874 |
| 5249 GGCCTGAGACGAGAGCATGT | 16907 GTCCCCTCACTGTTCCTGGAATG | 27891 GGGAATAACTAATGAAAGGGGCCTGAGA | 38875 |
| 5250 CCAAAGTGGTTTGGGGCATTTC | 16908 GTCCCAGTGCCATGAGAAGTTG | 27892 GGGGTCAGAATCAAGTTCCAAAGT | 38876 |
| 5251 CAGGACCCCTTTCGTCTCCAT | 16909 AGGGCAGACCAGGAGAAGTGTT | 27893 CCTAGACTCCCAGGACCCCTTT | 38877 |
| 5252 AAAAGAGGCCCTGAAGGGATTAC | 16910 TGTGGTATTGAGACTGGCCTGAT | 27894 GGACAAGCAGGCCCTGTAAAAG | 38878 |
| 5253 CACCAACATGGACCACTCAGCTAT | 16911 AAGAGGCACCACTCCTCCTT | 27895 CACTCACCATTTAGGGACACCAACA | 38879 |
| 5254 GGCTCTAGCCTCAGCTCAAAGT | 16912 TGGGATGGCAGCCTGCAGTTGTA | 27896 TCCTGGTTGCTCTGGCCTCTA | 38880 |
| 5255 AAGCCCTGGATGTGGAGTCA | 16913 ACCCCTCCCCTCCTGAAATCT | 27897 TCCCATGAACACAGTATGGTAGAAG | 38881 |
| 5256 GAGCCCCACACTGGACACT | 16914 CACCTGATCCGGCCAGCTT | 27898 CCTTGGGTCTCGCAGACTTC | 38882 |
| 5257 GCAGGTAGCAATACAAATCCAGTTCA | 16915 TTCTGCACCCTACCCTGTCT | 27899 GCTTGTCTACATTGCAGGTAGCAATACAA | 38883 |
| 5258 GGGCATTATGTGCTGGGGATTG | 16916 CTCCCACCCCACACACATTTCA | 27900 TGGCCTGCCACACAATGACT | 38884 |
| 5259 TTCAGCCGGTGGTCCTGACA | 16917 AGCGGGAAGCTCCTACTCAA | 27901 TGTGCAGAAAGGAGACGCAAA | 38885 |
| 5260 TCAGGCGACCATCAGGTGAA | 16918 GAGGCAGTTAACAAGCACTTGACT | 27902 AGCACCCTGCTGCCAAGAA | 38886 |
| 5261 TAATGGCCACGGCGGGATA | 16919 CCTCCCCGCATCCTTTCTCA | 27903 CCGGGGTGCATAAGTGAGGCTAAT | 38887 |
| 5262 CTGGCCAAATCCCACCCAAA | 16920 AGGACAACCAGAGGTCACTCTT | 27904 GCGGTAAAGAAGCTGGCCAAATC | 38888 |

FIG. 36I1

| | | | |
|---|---|---|---|
| 5263 GGTTTTGGGAAGGGCAGTGGAAT | 16921 CACTCCCTGCCAGCAAAACATTG | 27905 GGTGGGATTGTCATTAGTTCTTACAGGTTT | 38889 |
| 5264 CGAAGGCACCATGCCAGTGTT | 16922 TGCGGGCACTCGGAAACAT | 27906 AAGGAGAGCGAAGGCACCAT | 38890 |
| 5265 CCTGGGAAAGACGCTACCTTGT | 16923 GGATGAACAGCAGTCTCAGTGGTT | 27907 CTCAAACCAGCCTGGGAAAGA | 38891 |
| 5266 ATGGGCTTGTGGTCCTCTCT | 16924 GAGGCTGCTCTCCCAGTCA | 27908 TCAGGGAAGGGATGGGCTTGT | 38892 |
| 5267 CGAGCTGTCAACGCCGTAATTC | 16925 ATGGGAGCCCGGGTTGTAAG | 27909 GGCACAGGCTGACCGACTT | 38893 |
| 5268 CCTCAAATGCAGGTCTGAGCCAT | 16926 GCCAGGCCACACAACATGATA | 27910 TAGCTCAGTGGCCCCTCAAA | 38894 |
| 5269 GGCAAGACCGTGCCAGAAAG | 16927 CGCAACAGAGCAGTCACATCT | 27911 GGCCATTGGCTGGCAAGA | 38895 |
| 5270 CCTCCTTTTGCAGTAGAAGTTGACAAT | 16928 GCCTTTGGACGGCGAGGAGTAA | 27912 GGCAGCCTCCTTTTGCAGTAGA | 38896 |
| 5271 GAGGCCATAGTGAGCTGTCATC | 16929 TCTTGCTCTCACAAGGCCAAA | 27913 GCCCAGGAATTTGAGGCCATAG | 38897 |
| 5272 CAGAGTGAGTGTGGGCACGTT | 16930 CACACATGCACCAGCTCAAACA | 27914 TCCCTCCTACCAGAGTGAGTGT | 38898 |
| 5273 CTCCAGGAAAGGGCTCTGGTAAG | 16931 AGCCAACAGCCTACCCAAAC | 27915 CCTGAGAACATGGCTCCAGGAAAG | 38899 |
| 5274 GGCTCAAACAATCCTTGTGTCTCA | 16932 ACACACCTGTGGTCCAAGTATC | 27916 GCTCACTGCAGTCTCAACTTTTG | 38900 |
| 5275 GTGTTCCCATAGGTAAGGCATTCA | 16933 GTGCCATTCCCTTTCCCAGTTT | 27917 CCAGCTCTCAGTGTTCCCATAG | 38901 |
| 5276 CCTTTATGTCTGCAGGTGTCAATC | 16934 AGGCCATCAGCCTGGGAAGA | 27918 CCTGTGAAATAACAGCTGACAATCCTT | 38902 |
| 5277 GTGCCTTACCCGTGTCTGAA | 16935 GTCTATGAATGCCTCACAACCAGATAG | 27919 GCCTGATGGAACTGTGTGCCTTAC | 38903 |
| 5278 GTTGGAGTGCACTGAGCTTCTTG | 16936 TTGTGGAAAGCCCTGAAAGTCT | 27920 TGTGTCTCCTGGAGTTTATCTAGTTG | 38904 |
| 5279 GGAACCACTACACCAAAGTTGTCCTA | 16937 ACTGCAGCGCCTGTAAGTTG | 27921 GGGATCGGCCTACTGAAGGAA | 38905 |
| 5280 CCAGGAGTAATGCTTCCAGCCAAA | 16938 CGGAGGGACTCCTCACACTAAC | 27922 GGGCACCAGGAGTAATGCTT | 38906 |
| 5281 TTCCAAAGCAAAGAGACACCTCTAA | 16939 AGATGCCGTTATTGGTGGAAGAA | 27923 CCCTGTTACCATTTTCCAAAGCAAAG | 38907 |
| 5282 GCTCTGTCAAGTACGACTCCAGGTT | 16940 ATGGGCCAGGCACTCTGCTATC | 27924 GGCAAGGGGCTCTGTCAAGTA | 38908 |
| 5283 GACCATCACACCAGATTGCTTTGT | 16941 GCACTGGACGACTGCTGGTTT | 27925 TCAGGGCTACCTGACCATCACA | 38909 |
| 5284 GCCCAGAGAAGCCTTTTAGCATTTACA | 16942 GGCTCCTGGCTTTTGGCTTCT | 27926 CCTCTCTCCTAACAGCCCAGAGA | 38910 |
| 5285 CAGCTTTGGGCCCTAATGATCACA | 16943 GGCTCAAGGGCAAGCATGTTC | 27927 TGACAGGTAGGCCAGCTTTG | 38911 |
| 5286 CTGGCAGGATGAGTGTTGTTGT | 16944 CAGAGGGCACGGGTGTTTGT | 27928 TCCCACTTCTGGCAGGATGA | 38912 |
| 5287 TGACGCGAATGGCTTACTT | 16945 GAGCCAATTAGCAGTGAGAGAACA | 27929 CCAACCCACCTATTGAGAAAGGAATTG | 38913 |
| 5288 CAGCTTTTGCCAGGAGCTCAA | 16946 CCCATCCACAGGTCACTGAGGTA | 27930 ACTGGAAGGAGGGAACAGCTT | 38914 |
| 5289 GCTGTAAGGACTGTGCCATGAGA | 16947 GGAGGGCCACTGTTTACCGAAT | 27931 AGCCCTGCTGTAAGGACTGT | 38915 |
| 5290 GAAGACAGCCCCAAGAAGCATTT | 16948 ACACTGCCTAGCACATGAAAGA | 27932 AATGCAGAAAGTCATGGTGTGAAG | 38916 |
| 5291 CTGCTCTTCCCCATCATTCACT | 16949 CTGGTCAGGCAAGGAGAAAGT | 27933 CACCAATTGCCACTACTGCTCTTC | 38917 |
| 5292 CCTGCTGCAAACCTGTGTGAGA | 16950 GCCAAGTGGAAACAGGATATGAGA | 27934 GCTTGGGTTATGCCTGCTGCAA | 38918 |
| 5293 TTTTGGGAGGCGGGTTCTGT | 16951 CCCTGCAGCTCACACAGCAAT | 27935 CTGCACTCAGGACTTGGAGTTTTG | 38919 |
| 5294 ACTCTGGACAGCAGCACAAG | 16952 GGCATACACCCACACCATCCAA | 27936 GGCTCTAAAACCGCAGGGCTGTT | 38920 |
| 5295 CAGGGAGCCAGAATCTCTGAAG | 16953 CCCATACCAACTCCATCTCCTATG | 27937 GACTAACAACAGGGAGCCAGAA | 38921 |
| 5296 GCTGAACGGAAGGACAGACA | 16954 GCGAACACCCGTCCTTCAT | 27938 ACAAGGCCCCTCCTGCTGAA | 38922 |
| 5297 GGAATCCCGGGACTGGAGAGT | 16955 CCTGCCCGGTTGGATGTCA | 27939 CAGGGGCTCCAGGTTAGGAAT | 38923 |
| 5298 AGGGCCCTTCTGCCCAGTGA | 16956 GATCTGGGGACGAGGTCCTAAA | 27940 TGCACCCCATGAAGGTTTTGT | 38924 |
| 5299 GCCACTTTCACTTCCACACCTTGA | 16957 TCCCATGGCCGGGATTCAT | 27941 GGTGAGTGGTGCCACTTTCACTTC | 38925 |
| 5300 GGCACCCCAGAAAAGTCTAGTT | 16958 CGCACACATGCACACA | 27942 GGGAGTGGCACCCCAGAAA | 38926 |
| 5301 CCGCCTTTTTGATGGTGTCATATTT | 16959 GACCTGACTTGCCATCTGGAGAA | 27943 GCCTGCTTCACCGCCTTTT | 38927 |
| 5302 CCAGTTTCTCCCTCGCTGTT | 16960 CTCAGCCTCCTACTTCTGCTTTTG | 27944 TGCCTCGAAGAGGTTTGGTATC | 38928 |
| 5303 GTGATGCTGGGCTGTGTTTAC | 16961 GCTGGGCTTAAGAGGCTGAA | 27945 AGGCCGTGGAGGGACGTGAT | 38929 |
| 5304 GGCTTCTTCAGGCGTGAGATT | 16962 CAGAGGCAGGTCATCTGGTGTA | 27946 GCCAAAGGCAATTCATGTGCAA | 38930 |
| 5305 TTCGCTGCTGCTCCTGGAAA | 16963 GGGCAAAATGTGTAGACGGCACTAC | 27947 GTGCTCCCCTCAGAGTGAGATT | 38931 |
| 5306 GACAGTTGAAGTAGAACCTTCCACAA | 16964 TGTGGGACCAGGGTTTCTCT | 27948 CCTCTCCCTCTGAAGCAAGACAGT | 38932 |
| 5307 GCCCAAAATCATGCGTTCAGCTA | 16965 GCAGCACCTCGCATGTAACAAAC | 27949 ATGGCACAGGGGCCCAAAAT | 38933 |
| 5308 CAGTGATCTGAGGCAATGTCTGT | 16966 GTCATAAGCCATTGTCTGCTCTGT | 27950 GGGCTTGGAGAATATACAGTGATCTGA | 38934 |
| 5309 GGCCAGTCGCAATCATGTAGA | 16967 GCTACTCCTCTGGGATGTAGAGT | 27951 AGGACATGGATGTGATGCTGATG | 38935 |
| 5310 CCTGGTCGGGTCTGTGTTACT | 16968 CATCTCCTCAAGGCTATCTGTTTTGA | 27952 CTGAACAGCCCAGGCAAAATC | 38936 |
| 5311 CCTGCCTAACAGCTGATTGAAGTCT | 16969 TCCCTCCACCTGGCACTCATTT | 27953 GGTGGAGGAATCCTGCCTAACA | 38937 |
| 5312 GTTCAGCCACTTCATGCCATTTT | 16970 CAGTTGGTCTACGGCCTTTTAATTTC | 27954 CAAGCTGTAGTAGTTCAGCCACTT | 38938 |
| 5313 AGAGGAGTTTGCAGAGCCAATC | 16971 TCTCAGAGCCTCCCTTTGCAT | 27955 GAGCTGGGTTCTGAAGGATGAAG | 38939 |
| 5314 GACCAATAAGGGCTGTGGACTCA | 16972 GCCACCTTGTGAGCGTGAAA | 27956 GGAGAAGCAGAAGATTCGACAAGA | 38940 |
| 5315 GGCAAGTCAGTCAAGTGGGAAGT | 16973 GAGTCCTTTGAGCCGTGTGT | 27957 GACGCTGGCAAGTCAGTCAA | 38941 |
| 5316 CACAGAACCCACTGCTTGCTTGT | 16974 TGGTACCTGAGGGCACTACCAT | 27958 TGCCCACTTCCCTTCACAGA | 38942 |
| 5317 CCACAGAAATGAGGCAGTTTGTCT | 16975 CCAACAGGACGTGCAAATAAAGTCA | 27959 GGTGGAAGAAAGAACCACAGAAATGA | 38943 |
| 5318 CGCCATTTGGGTGCTTGTTG | 16976 GCCCAAAGGCCGCTCAATTT | 27960 TGCTTAGCCATCATCGCCATT | 38944 |
| 5319 GGAAGAGAAGCAGGTCCTGAAGTCT | 16977 TGGGTCTAGCCTCCCTACTGT | 27961 TCTTTGGTTCCCTCTGTTTTAGGAA | 38945 |
| 5320 GCTGACACACCCTCAGCAAT | 16978 GTACCTGAAAAGTTCCAGCAAAACT | 27962 GGAAGGGTGTTGCCCTGAACA | 38946 |
| 5321 CCAACTCTGCCTCCACAGGTAAC | 16979 GCAGCTAGAGAAGCTATCCGGTTT | 27963 GTCCCATTGTTTCTGCCCAACT | 38947 |
| 5322 AGAGGAAGCCGAAGGCCAGTAA | 16980 CGCTGGGACCTTGCGTAAAGAA | 27964 GGACCAATGAGCAGAAGAGGAA | 38948 |
| 5323 GGAGAAGTGTGAACTGCTAAGACTA | 16981 CCCAGGCCTGTTGAGAGCTA | 27965 CAGTTTCATGTACTAGGAGAAGTGTGAAC | 38949 |
| 5324 GGAGTGTAGGGTATGAGGTAGGGATCAT | 16982 CTGCTGGCATCTCCAGCTTCAT | 27966 GCAATGACTGGAGTGTAGGGTATG | 38950 |
| 5325 CAGCCATAGTTGCACCATCAAG | 16983 CACCTAAAAGCACTCACACAGCTACA | 27967 GAGGCTATTTAGACCTTCCAGCCATA | 38951 |
| 5326 CAGAAGCTGCCACGAATTCAGA | 16984 GTTGTCGGCGCCTAGTGGAA | 27968 CCTGGCCATTTGCTCCAGAA | 38952 |
| 5327 GGGCCATTCACTCTCCTCTACT | 16985 CAAATCTGCGGGAGGGGTATG | 27969 CATTTGCCAGGGCCATTCACT | 38953 |

FIG. 36I2

| | | | |
|---|---|---|---|
| 5328 GAGTAGCCCTCTTCCAAAACTGAAG | 16986 CTCAATTTGCTAACGTCACTGTGT | 27970 CATTAATGCCTGAGTAGCCCTCTTC | 38954 |
| 5329 CTGGCTGTGAACTTCTTAGGAGCTA | 16987 GCCACCACACTGCCAATAA | 27971 TCTCCCCACTCTGGCTGTGA | 38955 |
| 5330 TGTCAGCTGTCGCACCCATA | 16988 GGGAAACACGTCTGCAGCTCAA | 27972 CACCTGGAAGCCAGAGAATGTCA | 38956 |
| 5331 CCAAGGGATCGGTGTAGTAGCTTTC | 16989 CCCTTCCTCCAACCCCTCTTCA | 27973 ACAACCCAAGGGATCGGTGTA | 38957 |
| 5332 GTTCTGGAGAGGGCTGTCTTCTA | 16990 ACAGGGAGCAACCCTGTGT | 27974 GTGTCAGTAGGGTCCGGTTCT | 38958 |
| 5333 CATGGATGGGGAGTGGGATGT | 16991 GGGCTGTCCCTCTGGTCTGA | 27975 ACCTGTGAGTGCGAGTCCAT | 38959 |
| 5334 GCCACATTGCTGGCCACTTT | 16992 GGATGTGTGCTGTAGTGATGTGT | 27976 TCCCATCCAAGGCAGAGGTACT | 38960 |
| 5335 GCCCAAGCAACTTTCGAAACAA | 16993 GGAATGGACCCATCACAGACACT | 27977 CCTGCTGCCCAAGCAACTT | 38961 |
| 5336 CACAGCCAAGCATACCTCTGT | 16994 GCCAGGTGCAGTATGGGAAAG | 27978 CCCCTTTTATCCTATAAACCCTCACA | 38962 |
| 5337 GAAGTCAGAACTGAGAGTGTCCAT | 16995 ACCTGCTGCAGAATTTTGTGAGA | 27979 GCTGTTTACAGAGACCTTTGAAGTCAGAAC | 38963 |
| 5338 CATCCCATCGGTCCCTTCCAA | 16996 CAAGGAGACCTGGACTCTGCTT | 27980 AGCCAGGGCTGTCTGCAT | 38964 |
| 5339 CCATGAGCTCACATCACTGTCAAG | 16997 TGCTGTTTTCCTGTAGCACCAT | 27981 CAGCGAACCATGAGCTCACATC | 38965 |
| 5340 GGGTCTTGTGGGAGAGACATTC | 16998 CTCTGATGTGCTTGGGAATTCATTT | 27982 CCCATGAGAAGCCTGGGTCTTG | 38966 |
| 5341 ACAAGGGTACCTGATAGTCCAAAC | 16999 AGATGGAATGGCAGGTGAAATCT | 27983 GAGCTTTAAAGAACAAGGGTACCTGAT | 38967 |
| 5342 GCCGACACATTGCGGTTTT | 17000 CTTGTGCCCAGTTTTAGAGAACAAAG | 27984 AGGGACACAGAGCCGACACAT | 38968 |
| 5343 GAAGAGTCATTCCAGTCTGTGCTTAG | 17001 GCATGCCCAGGTTTTGGTCTTG | 27985 CACCACTGAGACAAAGAAGAGTCATT | 38969 |
| 5344 TGGGCAGTAGCCCCACTCA | 17002 ATGACCCTCCCCGACCAAGA | 27986 GCGCCACTAACCATGTCAGA | 38970 |
| 5345 CTCAGCACCGGTCTCTTCTTTG | 17003 AGGCTGGAGGGCTCACCTT | 27987 GGCGTCCAAGCACATGAAGGAA | 38971 |
| 5346 GCAGGGTTCATGGGTCCAAA | 17004 TGCTGCCCAGAAGCACTGA | 27988 GCTTACTAGTGAGGCAGGGTTCA | 38972 |
| 5347 CAGAGAACAGCAATGTCCCAGATG | 17005 GTCAGGGACCCAGGTTGAAAA | 27989 GCTGCCACAGAGAACAGCAATG | 38973 |
| 5348 CGCCCCTCAATGGGAGTAGTTA | 17006 TACCCTGCCTGGCCCAAATA | 27990 AACAGCAGCGCCCCTCAAT | 38974 |
| 5349 CGCCTTACAGTCCCTACTTCTTC | 17007 GGTTGCCAGTCTGATTGTGGTA | 27991 TAGGTCTGCCCGCCTTACAGT | 38975 |
| 5350 AGCTGAGCTCTTCGCCAGGTA | 17008 CAAGCACCCTGGAGGAGATGAA | 27992 GGAAACCAGGACAAGCGTCACT | 38976 |
| 5351 GCCTCAATGGGCTCATCTTTGAGA | 17009 GTCCACCTCACCACAACTCTGA | 27993 TGCAAGCCTCATGGCCTCAA | 38977 |
| 5352 GACCAAGGCAAGGAGACAAGA | 17010 CTCATCCTAGAGCTTGAGCACTCATC | 27994 ACATTGAGAAGGAACAAGGAGCATT | 38978 |
| 5353 CCTGAGGGCTCAGCATTTGT | 17011 GCAACAGGGCCTTTATAAGGGAAT | 27995 GGGAGATTTGGGAGGCGATTAAGT | 38979 |
| 5354 CCCCAGCCCTTCTCCAGTTAAT | 17012 CAGAGTAATGCATGCAGGGAAGA | 27996 TGATCTGACCCCAGCCCTTCT | 38980 |
| 5355 GGGGAGTGTAGACAGCACCTGAT | 17013 CCCAGTCACAGGTGGGGAGTT | 27997 AGCAGGGTGGGGAGTGTAGA | 38981 |
| 5356 CCATGCACAACCAAAGAGCCTTCT | 17014 CATAGGTAGTGCCATTTGAGCTGAT | 27998 GCCTGCCTCATCTCCATGACAACCAAA | 38982 |
| 5357 GCAGCCCTGGATTGAGTTGACA | 17015 CCTGAAATCCCATCGTGTGGCTTA | 27999 GGGTCAGCAGCCCTGGATT | 38983 |
| 5358 ACAAATCTCAGCCCAGGGACTA | 17016 GGTCCCATGTGGAGTCTGTTACTTC | 28000 GGCTTTGGCCTTTTGCTCATACA | 38984 |
| 5359 GGAAGATGACCGTAGCGGCTTTT | 17017 CACTTGGCCTGGCTTGATGTGA | 28001 GACAGTTACCCTCATAAATGGGAAGA | 38985 |
| 5360 GGGCTGCCTGTTTGAAGTTGGAA | 17018 GACTGGGCACAGTGTTGGTA | 28002 AAGGTCAGGGCTGCCTGTTT | 38986 |
| 5361 CTTAAGGCAGCAGGATGGTCAA | 17019 TGTAGAGGGCCTTTCTCTCACT | 28003 TCAGGAGCCAAGTTTATGCTTGAT | 38987 |
| 5362 GTGAAGAAGCCCTTGTGTGACTGA | 17020 CAGTTCTGGGCGGAAACAGTGA | 28004 GCCCCTCACAAAGCCTCATT | 38988 |
| 5363 CCCGGAGGCAGATTAAGGAAAAG | 17021 AAAACGCGCCATTTCAAGGAA | 28005 TGATGCCCGGAGGCAGATT | 38989 |
| 5364 GGCCAGGACAAGGTGTGTCA | 17022 GGAGCCCAGTGAGCTTCATC | 28006 TTGGGAGTAGAGGCCAGGACAA | 38990 |
| 5365 TGGGAGGCATCGGTGACAAG | 17023 CAGGAGGCTTGCCCTGTGT | 28007 GCCCCTGTTTATTCCTCCCCTGAT | 38991 |
| 5366 GGCTCAGCCAGGCTTGGAA | 17024 CCTTTTCTCCTCTGCCTGTGGTA | 28008 GAAGGGCCTGTTTTTCCCAAGA | 38992 |
| 5367 GGCCACCATCTCCTGTTCTAAG | 17025 GACCTTGTTTGTCTGTATCTGAGCTAT | 28009 CATCCAGAGAGGCCACCATCT | 38993 |
| 5368 GCAAAGCGGCAGTGTCAACT | 17026 GCACAGCATGTTAAACGCTAATTTC | 28010 GCCTTCACTTAAATGTCAGGCAAA | 38994 |
| 5369 AGAGGGTCCTTCCAGGCACAT | 17027 CTCAGGCAGATTGACAGGTGTGT | 28011 ACCTCTGGGGAGAGGGTCCTT | 38995 |
| 5370 CTTCCCATGGTTCACCAGAAA | 17028 GCCCATTCCCACCATTGGATTTG | 28012 GGCCTGGCTTCCCATGGTT | 38996 |
| 5371 ACCGCCCCTGAACACTTCCTAT | 17029 TGAGGTGTGGGGCAACTTGT | 28013 TTGATCTCACCGCCCCTGAAC | 38997 |
| 5372 CGTTCCTTACCCTGGCCTTCAA | 17030 CAACCCCAAGTCAGACTCATCAAC | 28014 CACTGGGACACCTACGTTCCTTAC | 38998 |
| 5373 CCCTCTCCTCCCTATCAGCATT | 17031 CCAGGGAGGATGGCTTCTGAATTG | 28015 ACGGTCAGGCCTTTCTCGTACA | 38999 |
| 5374 ACAACCTGTTCAGTTGTCTGTCT | 17032 GGTACAGGTGTGCAAAGCAGTGAT | 28016 CCTTCATTCCAGTGTGATACAGAACAAC | 39000 |
| 5375 TGCTCCCTCTACAGCACAAAG | 17033 GGGGCACAGCACCAGTTCA | 28017 GGCCAGATGATTGCTCCCTCTAC | 39001 |
| 5376 CTGACTCTTTGCATTGTTGTGCTA | 17034 CCAGGCTGGTGACAGACAAAC | 28018 CCCGATTCCTGACTCTTTGCAT | 39002 |
| 5377 TGTCCTGTGCCGAGGAAGA | 17035 TGCCTTGTTCACCCTCCACTTG | 28019 CCATTCAGCAGGTCCCAAGTTT | 39003 |
| 5378 GTCCTTAACCACGTTCTTGCTGTT | 17036 CCGTCTGGCAGGACCGTATC | 28020 CTTCAGGTTGTCCTTAACCACGTT | 39004 |
| 5379 GGCCAGTCCTGCCATTCTTCTT | 17037 GGGAGAGGCAGAATTCGGAAA | 28021 GCCTGGGTGCAAGGCTCAA | 39005 |
| 5380 TCATGGAGCCCCTCACTCTCATC | 17038 TGCTGTTCCAGCCGGACCTT | 28022 GCGAAGGCCACCACCTCAT | 39006 |
| 5381 CGTGTACTTACTGAAGAAACCAACCTA | 17039 GAGCACAAGGAGGCCGTTTT | 28023 GAGCTCCACGTGTACTTACTGAA | 39007 |
| 5382 GTAGGCAGGTAGAAATGTTTGGATTC | 17040 TGGTCCCGGCTCCATCAGA | 28024 TCCTTCATGTAGGCAGGTAGAAATG | 39008 |
| 5383 GGAACTTATGGGTCAGATCTGGAAA | 17041 ACCCTGATGGTTTGCACCTTT | 28025 GGGGAGGTTTGAACTTGGCTGGAA | 39009 |
| 5384 ACACAAAAGCACGCATGTCAAC | 17042 GTCTGGCTGCCCTGGTCAAA | 28026 GCCAAATAGCCTCTAAGTACAACACAA | 39010 |
| 5385 CATCCACCTAGACCAGGGATCA | 17043 CACCGGCCCACTTACTCTCTTAC | 28027 AATGCTGCTGTGGGCAGAA | 39011 |
| 5386 CATATACCCACTGACTCCCTGAAAA | 17044 CTGGGTCCTGGAATTCTGATGTT | 28028 TCAGAGAGTCTGAAACGAATCACAT | 39012 |
| 5387 ACCCTTCTCCTGTCTTGACAATC | 17045 ACCTGTGGGACTACCTGAGGTCTA | 28029 TGCCCAGGTCATTACCCTTCT | 39013 |
| 5388 ACAGAAGGGACGCCTCTACA | 17046 GCGGCAGGTGAATGAGTGT | 28030 CCTCCTACCCACAAGCACACA | 39014 |
| 5389 GGAGGGCACCATTTAAGCAGTAG | 17047 GGCCTCATAAATTAGAACCCTGGAT | 28031 GGAACGAGGAGGGCACCATTT | 39015 |
| 5390 GGGCACCTCATTCGTAACTCTTTCT | 17048 CAGAGGGCAGAGCGCTGAAT | 28032 TGGGTGTTCTCACCCAGTTACA | 39016 |
| 5391 CAGGGTGTTCTTGCTACAAACCAAA | 17049 AGTCATCCTCCCCACCACCAT | 28033 CCATCCTCAGGGTGTTCTTGCTA | 39017 |
| 5392 AGGCCTGCCTTGGGTCACA | 17050 CCTGAGCCATCCTGGAAGCTTTAC | 28034 GCTGGAGCGATACTCGCTTTTC | 39018 |

FIG. 36I3

| | | | |
|---|---|---|---|
| 5393 GAACAAACCGTGTGGGCAAT | 17051 GCACGGGCTAGAACTCTCACTTC | 28035 TGGGGTGGAAGAGTGAACAAAC | 39019 |
| 5394 AGGCAGGGGAAACGAGAGAA | 17052 GAGCAGGAAGCCTGAGTCTTGA | 28036 GGCTGATGCGACGTGAGTGAAA | 39020 |
| 5395 CAGCCTTACAGGTGAGCCTTTC | 17053 CTCCTCTGTTCCCTTTTGTGGAT | 28037 GGCAGTTTGTCCAGCCTTACA | 39021 |
| 5396 AGCTGCTAATGTCCAGTGTCAA | 17054 AGGACAATGCCCTAGAAGCAAAT | 28038 TGTCCACACAGAAGCTGCTAAT | 39022 |
| 5397 CGAGTTAGGCCACCAAGCAA | 17055 GCAGGGTCTGGTTTGCATTTGA | 28039 TTCCAGGTGTCAAATACACGAGTT | 39023 |
| 5398 CTCAGTGACTAGGTTTGGGTCTGTA | 17056 TGCCTCCACTCCAACTTCTTTAG | 28040 GTACAGTGCTCAGTGACTAGGTTT | 39024 |
| 5399 TGGGAGAGGAAGGTGCAAGA | 17057 CTCCTGCAGTGTCACCTTGTTG | 28041 AAATGGCGCTGGGAGAGGAA | 39025 |
| 5400 AGACTAACTGCCACCCTTGAGA | 17058 GGCCAATGCACGTACTATTGCTT | 28042 GGGATGCTTCCTAATGCTTCTTTAAGACTA | 39026 |
| 5401 GGAGCCATGAAAGGGAACTCAAAG | 17059 AACCTGCACACCTGCCAATC | 28043 TGTCCTCAAGGAGCCATGAAAG | 39027 |
| 5402 CACCATAGCTCCCTTAAATCCAGAA | 17060 TGGAGCGAAGTCATGTCAGTCT | 28044 GCTCTACGATACACCATAGCTCCCTTA | 39028 |
| 5403 GTGAGGGAGGTAGGGTTTGAAG | 17061 GGAGGGGCTACGATAGAAGCAAAC | 28045 CCTGAACAGGGTGAGGGAGGTA | 39029 |
| 5404 CTGACTTTCTTAGCCACCGTACA | 17062 TGCCTGGCAATGTTAGATAAGGAT | 28046 GCTGGACAATTTTCTAGGTGCTGACTT | 39030 |
| 5405 TCACTCCCGGAGGAAGACAAAG | 17063 CCGCCCTCTCTCACCATGT | 28047 GGCCTCAGCCTGCTTTCACT | 39031 |
| 5406 GGTGAGTGGCAAGAAGGAATCGAA | 17064 TGGCATCGCCATCCACCCTAA | 28048 GCTGATGGATTGACTGGCTGTGA | 39032 |
| 5407 ACTCCCCTCCTTCCCAGCTT | 17065 CCCCTGTGTTTGTCGGGTGAT | 28049 AGAGGCCCTCACCATGTAAGA | 39033 |
| 5408 GGTGAGGAAAGAGTGGTCCCTGAA | 17066 GGTTGCCAAACTGTCCCAACT | 28050 GCTCTCAGTAAAGGAGGGTGAGGAA | 39034 |
| 5409 GGAATGGCTGCAGAGTTGTGA | 17067 GGCACAGATTCTGGTTAGAATGGAA | 28051 CAGGATTCTGAGGTCATGGAGGAAT | 39035 |
| 5410 CTCTTCACCAGGACCATGTACCTAGAA | 17068 CATTTCCGCTCACAAGCCATT | 28052 CTCAGCTCTTCACCAGGACCAT | 39036 |
| 5411 CCAGTTAGTGTTCAGGCTTTTGACA | 17069 GACTCAGCCCGGAATTCGTT | 28053 GGACATCGACCCCAGTTAGTGTTC | 39037 |
| 5412 TCCTCCCATCGGCCATCA | 17070 CCAAGGTATGGCAGGAGTTTGT | 28054 CCCAAAGTGCAAGGCTGTCA | 39038 |
| 5413 TGGGGATAGCATGTCCTTGACT | 17071 TGCAGTGCTGCTCCATGTGT | 28055 GTCCCATGTTTGGGGATAGCAT | 39039 |
| 5414 CAGAGCTCGTGAGTGATGTGCTT | 17072 ATCCTAGGGCCCCGTAAGTCA | 28056 TGGGTGCCTCATTCTGAGTACA | 39040 |
| 5415 GTGCAAATGGCCAGAGACAAG | 17073 CGTGGCTTGGAAGAGATACATTTCA | 28057 AGACCTTGGACTTGGTGCAAA | 39041 |
| 5416 TCGGGCCCCATAGGCAACA | 17074 TCAAACCCCACCAACCCTACA | 28058 ACTCTGCCTAGTGTCCATCTTTCT | 39042 |
| 5417 TCTGAGTTCAGTAGGAGACAGTGA | 17075 CCCAGGGTTGGGGTTCCTT | 28059 GGTACCAACCACCGATTTCTGAGTTC | 39043 |
| 5418 GTCTCAAAAGCCTGAGGTCTGA | 17076 CCCATCTTTTCTCCAGGCACTT | 28060 GTCAGGGTGCAAGGTAGCTAAG | 39044 |
| 5419 GCCAAGTCTTACTGGCTTGACA | 17077 CTGCCAGCCTTGAACTCTGT | 28061 GGTTAGGCAGGAAGCCAAGTCT | 39045 |
| 5420 GCATTGTCAAGACCCTGCAATTCTTC | 17078 CCCACAGCATCGATGACAAAC | 28062 GCAGGGAGAAGCATTGTCAAGA | 39046 |
| 5421 CCACAGCCTTAGTTCCACCCTTGT | 17079 ACCAGGCAGCTCCATGTTG | 28063 GGTTTGACCCCACAGCCTTGT | 39047 |
| 5422 ATGAGACAGCCACCTCTCTAATTG | 17080 CAGGACCCAATAGAAGTCGGGAATA | 28064 GCCCTGGAATGTGGAGTCTATC | 39048 |
| 5423 ACCAGCCCATCCAGTTCAGA | 17081 GGTGCACCCAAGCATAAGGTTT | 28065 GAAGTAGCCACTCTTTGCTTCCAA | 39049 |
| 5424 TCTATCTGCCCCTCCCTCAAG | 17082 AGATGTGGGAGGAAAGGATGTTC | 28066 CCACCTTCTCAGGTTGCATCTCTATC | 39050 |
| 5425 GCTTTGCACAGGGGTAGGAT | 17083 GGTGCCTCTGGAGTTGTGAAGT | 28067 CCCCACAGAGCAGTGAGAATAACA | 39051 |
| 5426 TGGCCATCCATATTTACCTGCAA | 17084 GCCAAGTTTCCCAGAGAATGAATC | 28068 GCTGCACATTTGTGCTGGATTG | 39052 |
| 5427 GCCTCCGCCTATGCTGGAATTA | 17085 GCCAGATAAGGGCCGAGTTC | 28069 CCATCTTGGCCTCCGCCTATG | 39053 |
| 5428 ACCAACCCGGAAGCCCTGTA | 17086 AGGACAAAATGCATTCAGGACACT | 28070 GCTGGTTCTCTGAGCTGACACCAA | 39054 |
| 5429 GAGGATGAAAAGAAAGCCAAGTTGT | 17087 CCAGTTTGTTAGCCTCAAAGCAA | 28071 AGGCCTCCACAGTGGTAAGA | 39055 |
| 5430 GAGATGCCTTGTGGGAAGAAGT | 17088 TCGGCTTGACCTACCTGCTT | 28072 CGGCCTGGAGATGCCTTGT | 39056 |
| 5431 TGCCCCTTGTGGGACAGTGA | 17089 AACCTGTCACCTGGGACTCA | 28073 CCTTTGACCCCACAGCCTTGT | 39057 |
| 5432 GGGTGTGAGAGCGAGGTTTT | 17090 GGTTTGACCAGGCATGTCACTCA | 28074 GCATACTAGAAGGCTAGGGTGTGAGA | 39058 |
| 5433 TCCCGGGGCACTTTCCACTT | 17091 TGACTGGCTGCACGCTCAA | 28075 ATGGCCAGGAGGCACCTT | 39059 |
| 5434 CCTTGGGGATTATGAGCTTCCATT | 17092 ATGGCCTCCGTGCCTCATC | 28076 TGAGGGGCCTTGGGATTATGA | 39060 |
| 5435 TCCCTCATCTGAAATTGTGCATGT | 17093 CCCAGGAAACTCTAGAGGAGGATT | 28077 TTCAGGGAGCTGTCCCTCATCT | 39061 |
| 5436 GAGGATGTTTCATTGGCCACAGTCT | 17094 TCATGCAGGGCCACTCTTTG | 28078 GTGACTCGCATAGAGGATGTTTCA | 39062 |
| 5437 TGCACAGCACGGTGTGGTT | 17095 CTCTTTGCCAACTAGAGACACAACTT | 28079 CCCAGGCAACTGCACCAATG | 39063 |
| 5438 GCTTGTAGCCCCATGTAGTTCA | 17096 GGAATATTGGCTCAGGTCCAAGAA | 28080 AAGAGGGGCCTCTGCTTGTAG | 39064 |
| 5439 AGGCCGCTCCTTCCAGATATGA | 17097 CCCCGCCCTTGAAGTGGTCTTT | 28081 AGACCTCAGGCCGCTCCTT | 39065 |
| 5440 GAGGCAGCAGTGCTTTGGTT | 17098 AGGATGGACCCCACTGACACT | 28082 TGGTCTCCCATCCCCTTCACA | 39066 |
| 5441 GGTTCCTACTGGCGAGTGGATAGA | 17099 GAGGGCCCCTAATGTCTCTCTT | 28083 GGGACAAGGAAGAAGAGGTTCCTA | 39067 |
| 5442 GCTGATGGGCATGGGAGATGAA | 17100 GCTGTATCTCAATCTTTTCCAGGAAGT | 28084 CGGCAGGCACAGGATTGAA | 39068 |
| 5443 TCCCAAGGAGCCAGGAACA | 17101 GCCTCCTCCCAGACAAATCCAA | 28085 AGCAGCAACTCCCTCCTTCTTC | 39069 |
| 5444 CCAAGATACTGATCGTTGTCTGAACT | 17102 GTGCCTGGATGAACCCTGTTTG | 28086 CAGCAGCTCTGTGAATTTCTGTGA | 39070 |
| 5445 GTAAAAAGCTGCAGGGAGTACAGT | 17103 TGAGCTGCTGTTGGGACTGA | 28087 GGGTCCCAGGCAAGCAGTGTAA | 39071 |
| 5446 ACACCTGGCATTATCAAGACGTAA | 17104 ACTGCGCATGCTCGAAATCT | 28088 CCAGACAGAAAACACCTGGCATT | 39072 |
| 5447 CAGGTTTGGTTAGCGGAGGACTT | 17105 CCTCACCTCATGCACACCCTTT | 28089 GGGTAGATAACGAGAGCAGGTTTG | 39073 |
| 5448 GTGACAGTAGGGCCTGAAGGAT | 17106 CCTGGGGATGAGTAGCAACCAA | 28090 GGCACCTGTGTGAACATGGTAGT | 39074 |
| 5449 TGGTGTGGGACAGTCCATT | 17107 ATTGACCCCACGGTGTCTTC | 28091 GCATAGGTCTCCTTCTCCAAGTCGTA | 39075 |
| 5450 TGGGACCTAGGTGCTGGTGTT | 17108 GTGGAGGTCTACGTCCTCAGTTG | 28092 TGCTAATGCAGGGTGGGACCTA | 39076 |
| 5451 CCCCATCTGAGGCCCTGAA | 17109 CTGTGCAAAATCCTTCCGTCTTG | 28093 AGGCCCTGTTTACCCCATCTGA | 39077 |
| 5452 TCTGGGCCTCTACGGCTTGTTA | 17110 GCCAGAATACCGAGGTCTTGGTTAG | 28094 CACCACATTTCTGGGCCTCTAC | 39078 |
| 5453 GATCGGGAAAGAGGGTCTGAAG | 17111 CCATAGTACGTGAAGGCCCCATT | 28095 GGGTTGAAGTGGAGATCGGGAAAG | 39079 |
| 5454 TGTCAATGGTGATCGGAGGTTTC | 17112 AGGAGAAAATGGTGCTTGTGAA | 28096 GCAGGAAAGCAGAGTGTCAATG | 39080 |
| 5455 CCTGCCACTTGCATCCATCTCT | 17113 CACCAGCCCCAAAGCACAAA | 28097 TTGATCCAGCTCCTGCCACTTG | 39081 |
| 5456 CAGTGGGAATATACTCTGGCATGT | 17114 AGCAGGAGGAAAGCAGGTCTTG | 28098 AGTAGGGCCACAGTGGGAAT | 39082 |
| 5457 GTCCTGTAGTGAAATAGCCAGATTCTA | 17115 TGATTGGCAACACTGTAGGTGAT | 28099 TGACACTGGGGAGTCCTGTAGT | 39083 |

FIG. 36I4

| | | | | | | |
|---|---|---|---|---|---|---|
| 5458 | TCAACCTGAGAGGTCCCGAGAT | 17116 | AGTCTGAGCATCCCTTGTCTGA | 28100 | GGGAGAGGGAGTTCAACCTGAGA | 39084 |
| 5459 | GGGCTGATCTGCTGATTTCCTTGA | 17117 | TGCAAGTCCAGTGCTGCTT | 28101 | CCACACTTACTTTTAGGGCTGATCT | 39085 |
| 5460 | GGAGAAGGCAGCCTCTACACTA | 17118 | TCCTCCCCAGTCCCCACATTTT | 28102 | GGAGTGCGAGTCCAGGAATGTT | 39086 |
| 5461 | TGGCCAGGGGTCTGTCACT | 17119 | GTGGGAGAGGCAGGTACTTCAGA | 28103 | ACCCCTCCTTGGACCATCTGT | 39087 |
| 5462 | AGGCCTCTGTGCCACTCTTTG | 17120 | GCTCCCAAGCCACTGGTAAAGT | 28104 | ATGCTAAGGCAGGCCTCTGT | 39088 |
| 5463 | GTCTGCCCTTGACACCTCAAAGA | 17121 | GGCTTGGAGAAAGGGCTGAGAA | 28105 | GGATGGGAGTCTGCCCTTGA | 39089 |
| 5464 | GAAGGAGAAGTGGGGACTGGTT | 17122 | ACCAGCCCCAGAGAGACATT | 28106 | GCACAGCTCAAGGGAAGGAGAA | 39090 |
| 5465 | CACAGCCAGCACTAGAGACAATC | 17123 | GCACCTGGAAAAGGGAGTGTGA | 28107 | GGTCCCTGCAGCTTTCATCA | 39091 |
| 5466 | TCCAGCCTTTGAGTCTTTGTCAT | 17124 | ACAGGGTCCCCATGGTCATCAA | 28108 | GGAGCTCTTCCAGCCTTTGAGT | 39092 |
| 5467 | CAGGCACACTGAGATGCCCATA | 17125 | CCAGTGCCCCTGCACAGTATT | 28109 | TGTGCAGCCAACTGCGTTTC | 39093 |
| 5468 | CCACTTTCACATCCAAGAAAACTGT | 17126 | CAGCACGGTGTGACTGAAATG | 28110 | AAGAACCTACCACTTTCACATCCAA | 39094 |
| 5469 | GCTTCCCAGCACACACTAAGA | 17127 | GGTCCAGAACCCTTCAACACCTA | 28111 | TTGTTTTACCCTCCCCTTGCTT | 39095 |
| 5470 | CATGTGGCCTTTAAATGTCTGGATAAG | 17128 | CTTTGGCAGGGAGGCAGAAA | 28112 | CCCAGGCACTGGAATTCTCCAT | 39096 |
| 5471 | GGAAAGGCTGTGCAATGGATAC | 17129 | AGGGTGAGTTGGGGACTGAA | 28113 | GGAGGGATTGGCATATGTCAGTGTAAG | 39097 |
| 5472 | GACCTCACCAATGCGAAGGAA | 17130 | CACGCTGCAGGCACAAAACT | 28114 | GGCTGGAAGTTTGGGTGTGA | 39098 |
| 5473 | CGAGCAGGCTGAGGGAAGTCT | 17131 | AGGGGAAAGGTGAAAGCTAAGTAAG | 28115 | GCTCCAGAGTTTCACCACACA | 39099 |
| 5474 | GTGCGAGGACATAAACCCAAGT | 17132 | GCACTTAAGAGCTGAGCCTTGTGA | 28116 | AGCGACAGTGCGAGGACATA | 39100 |
| 5475 | CATTCACGTTTGCTAGTTCTCTCTTC | 17133 | GGAGCAGCTACGTTCATGTCT | 28117 | GTTTCCCATCGTTGATACTTGCATTC | 39101 |
| 5476 | GACTTCCAACCTGGACTTAGACAT | 17134 | TCCACATGCCTCAAAAAGACACA | 28118 | CCCTCAGCTCACAAGAACCTGACT | 39102 |
| 5477 | CTCGCAAAATCCTCAGATCCTTTGT | 17135 | GGATGTGTTTGTGAGCCGACAAAG | 28119 | AGGACCCCTTTCCCTAGAGTTC | 39103 |
| 5478 | GCAGACCATGGGGCTCTACTTAC | 17136 | ACCCCTCGGAGGACGTGTCA | 28120 | AGGACACCAGGAGCAGACCAT | 39104 |
| 5479 | CTCCCACCCACATAAGCAAAGACT | 17137 | CCCAACACTGTCACCCATCAT | 28121 | TGTGGAACCTCCCACCACAT | 39105 |
| 5480 | CACTTGCAGCCGACTTTGGTA | 17138 | GAGGACAAGGGAATGCACGTA | 28122 | CACAGGCTGGCAGTTAAAACAGA | 39106 |
| 5481 | ACCTCCCTATGTAGTGAGCTGTTAG | 17139 | TGACAGACCCACTGAGGTGACT | 28123 | AGGTTTGAGAACCTCCCTATGTAGT | 39107 |
| 5482 | GCAAAGGTCTTCATGGGCAAGTCT | 17140 | GCTTGGCAGTAGGACAGACCAAA | 28124 | CCCAGGCTCTAGCAAAGGTCTTC | 39108 |
| 5483 | GACCAGAGCTGGCAAATTCTACA | 17141 | AACTGGCCTCACTCTGGAAAG | 28125 | GGTTACAACAGCTTGTAGGTCCTTGA | 39109 |
| 5484 | GCCTGGAATGTGATCCATCAATGTT | 17142 | GTTCCCTTTCTCCTCTACCTAGCAT | 28126 | AAAAAGAGGGCCTGGAATGTGA | 39110 |
| 5485 | GGGGAAGAGAGGTTAAGGAAGTGTTT | 17143 | GCTGAGCTCAAGCCCTCTATCT | 28127 | AGAGCCTGGGGAAGAGAGGTTA | 39111 |
| 5486 | GGCTACTCCTCCCAGTCTGTTGT | 17144 | AGGAGGGAGTGAGCAGGAA | 28128 | CCTCTGTCGAGGATAGAATGGCTACT | 39112 |
| 5487 | CCACCCTGTTGGATTTACTTTCTTCA | 17145 | TGAGGACTTCCCCTACCACTCT | 28129 | GCCTTCCACCCTGTTGGATTT | 39113 |
| 5488 | GGAATCATGTGGGGTGGAATCT | 17146 | TCAGGTCCACCAGTGTGAAAC | 28130 | CCTGCAAACTGCAACAGGGAATC | 39114 |
| 5489 | AGTGAGGGCCTTACACAGTGA | 17147 | GGGATGTCGAGGTGCTAGGTT | 28131 | CTGGATGCTAATGTGCAGGAGTGA | 39115 |
| 5490 | GAGGAGAGACAGCAGTGTTTGTAA | 17148 | GGGACCATCCCTGACTCTTACATT | 28132 | GGGAAGAGACCTAGAGGAGACA | 39116 |
| 5491 | GCTGCTGTGATTGGGGAGTTG | 17149 | ACCCGGCCATCTTTGGTACA | 28133 | GGGATTCACTGGCTGCTGTGAT | 39117 |
| 5492 | CTCCCCTGGTACTCTGGAATTGA | 17150 | GCTATAGAGCCGTCTGCATCCAA | 28134 | GGCCTTACTCCCTGGTACT | 39118 |
| 5493 | GTGCAGGTAGAAGAACTGATTTCTCA | 17151 | CCATGGTGCCAGAAGGTCTTGA | 28135 | GCCAAATTCTGTGCAGGTAGAAG | 39119 |
| 5494 | CCGCTGTGTTGCTTGCTTTCT | 17152 | GGCTGGACACGTTCAAGCTTAC | 28136 | TCACTTCCACCGCTGTGTTG | 39120 |
| 5495 | ACTGTCAAACGGCTGTGCTT | 17153 | AGGTAGATGGCAAAATCTGTGAA | 28137 | CCATCAGTGTAGTTCCTAACTGTCAAAC | 39121 |
| 5496 | AGTCAAGCAGGAGGACTTGGAT | 17154 | GATGGAGCCTGAGGCATTAAACA | 28138 | GGCCAGAAAGACTGCAAAAGTCA | 39122 |
| 5497 | GGACAAGAAGCCCATTTTAAGCAT | 17155 | GGCCATGGGACAGCATTTCT | 28139 | GGCAGGAACCACCTGGACAA | 39123 |
| 5498 | ACTCCGACCAACCCAGACCAA | 17156 | CAGAGCAGAACCCCATGCTTTG | 28140 | ACAGCACCAGACTCCGACCAA | 39124 |
| 5499 | CTCCAATGCCATTAGCTCCAGAAC | 17157 | GAAGTCCTTGCTGCTGGAGAAGA | 28141 | ATCTGACCTCACTGCTCAATG | 39125 |
| 5500 | GCTATGTGCCTCTTTGGGGTTAC | 17158 | ACAAATCTAGGGAAGGCAATTTGTCA | 28142 | CTGGATTTCAGGCTATGTGCCTCTT | 39126 |
| 5501 | AGACAGTGCTGACTCTGTGAGTA | 17159 | CCACTGTCTCCCTTCCTTGAATG | 28143 | CAGACTTAAGCCAGAGCAATTACACA | 39127 |
| 5502 | GGTCTGCTGACTCCTCATCTCTTC | 17160 | GAACTTGGCTGGGAACCAGGAT | 28144 | CTGCTGTGTGCCTGCAATG | 39128 |
| 5503 | ACTCGAAATCATGGCTGATTCTGT | 17161 | ATGGAGCCCCACTACCGAAGTA | 28145 | GCTCCACCATCCTTACCTTAACTCGAA | 39129 |
| 5504 | CACCAGCAACTACAATGGCAAA | 17162 | CAACCAAAGTGGCAACGAACT | 28146 | GACCCTCACACCAGCAACTAC | 39130 |
| 5505 | GCCCTGACTCAACTTCCTTCTGT | 17163 | GGGCATGGTGGAAAGCTTGA | 28147 | GGTTTCCATGCCCTGACTCAAC | 39131 |
| 5506 | GCCATGGGCTGTGATCTCACTTA | 17164 | GCATGGGAGCCAACAGTCAGT | 28148 | CCAGAATGCCATGGGCTGTGA | 39132 |
| 5507 | CAGTGCAGGCAGGATGTATGTGT | 17165 | GCCACCGCACCTGGACTATTT | 28149 | CAGCAAGTCAAAGGCACACAGT | 39133 |
| 5508 | CTCTCCTGCCTCATGGAGTTGT | 17166 | CTTTATTGGGCACCATCTCACATC | 28150 | GGCCCTGGGGACATACTTAATC | 39134 |
| 5509 | TCCTATCAGCACCCGCTCAGAA | 17167 | CGTTCCCTCTCTCTCCAACTTTTAG | 28151 | TGGCTGCCGCCTTCCTATCA | 39135 |
| 5510 | GGTTGGAATAAAGGGGCACAGCTT | 17168 | TGTCGCGATGCCGAAGAA | 28152 | GCTGGAAGACTGGGTTGGAAT | 39136 |
| 5511 | CCCTCCCACTTGGTGTGTTATAGA | 17169 | GCCCCATTGCCTACCTTTCAGA | 28153 | CGTAGGCCTGGATAACTCCAAGA | 39137 |
| 5512 | GGAGATTGAACAGTCCATCGAAACA | 17170 | TGGCTCCAGGTCCAGCATCA | 28154 | CCTCCCAGCAGGAGATTGAACA | 39138 |
| 5513 | GGGGCGTTAACATTTACTGAGCAT | 17171 | TCCAGCAGGTGCCTGACACA | 28155 | GCAAAGCCTCTTCCATCTGCAT | 39139 |
| 5514 | GAAGTCCAGTGGATATTCCCTCATT | 17172 | ACCCTCAACATCTGCTGTCAGA | 28156 | GAGGCAAAGGAAGTCCAGTGGATA | 39140 |
| 5515 | ACTCGCCAGTCCCTTCCTAAT | 17173 | GTGTGGGCCAAAGGTTGTAGA | 28157 | GTGGGACACAGGGAACAACA | 39141 |
| 5516 | ACCACATTTGACTCAGGGTGTT | 17174 | CCAAGAAAATCACGTTTGGGAAAGA | 28158 | CCCACCGCTGGTGTTTGGAAAA | 39142 |
| 5517 | GGCCCAGTGATTTCCTTTGACA | 17175 | CCACCAGCCATCCGTGTGT | 28159 | CTGCACAGGCCCAGTGATTT | 39143 |
| 5518 | GAAGGTCCAACGCACATCTTG | 17176 | GTCTGCAGGGCAGAAAGTGA | 28160 | ACACCAACCAGGAAGGTCCAA | 39144 |
| 5519 | AGCGCCCCTTCCTGTTTCTA | 17177 | GTGGTGTGCAGTGAGTGGAT | 28161 | TGGAAACAGGTCCCCTGGAA | 39145 |
| 5520 | CCACTCCCTGTGGGTTTGGTTATC | 17178 | GCACCCACAGCACCACAT | 28162 | GCACGGCTGCTGGGTTATG | 39146 |
| 5521 | AGGCTGGTGGCTGGAATCATCT | 17179 | GCACCAACTAGCTGACCTGTGA | 28163 | GGCATCAGCAGGGGTGATTTGA | 39147 |
| 5522 | GTGTTGCCTCTGGCCCTTATC | 17180 | GGGAGGGTGGAAGGAAAAGACA | 28164 | CCTTTTTCTCCCAATTGCTACTGTGT | 39148 |

FIG. 36I5

| | | | |
|---|---|---|---|
| 5523 CAACTTGCCCTTTGGGTCCTA | 17181 GGGCACCAGTAATCCAAACTCAA | 28165 GTGCACCTTCTGTGTGTGAATAG | 39149 |
| 5524 TGGTAGCACAGCAAAAACTGCTA | 17182 CCACCCAGTCCTGAAGCCATT | 28166 ACAGAGTTTGGTAGCACAGCAA | 39150 |
| 5525 GTAATCCTTACAGCCCTCCGGATA | 17183 ACTCGGCTCCTATCGAGTGCAA | 28167 CATGCCAATGCCTTCACCTTTG | 39151 |
| 5526 CCTGATGGCCCAAGAGGTATGA | 17184 GGGAGCACTGCCATCCTTTGT | 28168 AGGGACCTCCTGGTCCTGATG | 39152 |
| 5527 TTCCCCATAACCCGGCCACAT | 17185 CAGGCTTGTGGAGAGGATGTCA | 28169 CAGAGGGTCCTTCTTCCCCATAAC | 39153 |
| 5528 GTCTGTCTTAGTGACCCAGGTATTC | 17186 ATGCCAGGCCAGTCCTGTACTA | 28170 GGGGAGAGACCAAGTCTGTCTTA | 39154 |
| 5529 CTGCCCAATGTGGAACTCTTCT | 17187 CCCAATGGAAACCCTAGAACACA | 28171 GGGTGTGTCCATTTCTGCCCAATG | 39155 |
| 5530 GGCTAAAGGCTTACTGGCATAGGAT | 17188 GCTGGGTCAACAGCTCTTTCA | 28172 GGTGGGACAGGCTAAAGGCTTAC | 39156 |
| 5531 GGCTGCTTCAAGGCAATTGGAA | 17189 GGCCTCCAGGAAGAAAGCAA | 28173 GGCTAAGACCCTGAGCTCCTAGA | 39157 |
| 5532 TCTCCAGGGCAGACACAGTTG | 17190 TGTCCCCAGGCTGTCTCTCA | 28174 GGACCCAGAGGTGCTTTCATGT | 39158 |
| 5533 GGAGCGGCTTGATGACATAGA | 17191 GGCATCCTACAAACTTCCCTTGTA | 28175 TGCAGAGGAGCGGCTTGA | 39159 |
| 5534 CCCAACTGTGATATTAAACCACCTTCT | 17192 ACACCCAGCCAGTGTCTCA | 28176 AGTTGCTGGCCCAACTGTGA | 39160 |
| 5535 TTCTCTGGCATCGCCTGTGT | 17193 GCCCGGGTCCAGGTTACTTC | 28177 ATCGCCGCCATCGTCTTCTCT | 39161 |
| 5536 ACTGACCAGCTGCCTATTTATGTAAG | 17194 GGGCATGGCTGTGTTCCAGTAA | 28178 CCAAAACTGACCAGCTGCCTAT | 39162 |
| 5537 CCAAGGCGGCATCAACCAAA | 17195 GAAGACCACCAGGACCATGATT | 28179 CCCAGGGAGTGCGTTTTCTTTC | 39163 |
| 5538 CTGAGGCTGGAGCGAAGAAAAG | 17196 TCTCCCGGCTTCAACCCAAA | 28180 CGAGAGCAAGAGAGAAAGGAAGTCTGA | 39164 |
| 5539 TCACTGGGACACAGACATGGTA | 17197 GCCACCTTCCTCTTCCCCTTAG | 28181 GGAGGATCGTGTCCCCTTCACT | 39165 |
| 5540 TGCTTGAACCCCATCCTTTATGT | 17198 GGAAGCGAGCTTGGAACTTCT | 28182 GGCATTCCTCAATAGTTGCTTGAAC | 39166 |
| 5541 ACCTCATTGTCCCTCCATCAGT | 17199 CTGTGGCTGTCCCAGCAGATAAAG | 28183 TGGCGAGCACACCTCATTGT | 39167 |
| 5542 GCTGAGGAGTTTAAACCTGCCAGTAA | 17200 GGCTGGAATGCAGTGGTACA | 28184 GGTTGGCTTGAGCTGAGGAGTT | 39168 |
| 5543 TGGGAGGTTCCTCTCACTAATACA | 17201 GACAGCAAGGCAAGCTGAGAAC | 28185 CCCTGATCTAAACCAGTGGGAGGTT | 39169 |
| 5544 TGCACCCTAGCCCAGTGTGTT | 17202 GTAATCCCAGCCAGATCACACTTTCTT | 28186 AGTTCCGGGCTTTGCACCTA | 39170 |
| 5545 GTCTCCATGTCCAGGCTGTTGT | 17203 GTCAGATGGCCTCTGCACCTTA | 28187 GAGAGATGGTGTGTGTCTCCATGT | 39171 |
| 5546 CCTCAGGGGTTTGCAATCTAATACA | 17204 AGTTCTCTCAAACATTGGCCTATT | 28188 CCTCTGCCCTCAGGGGTTTG | 39172 |
| 5547 GCTTTGGGAGAACAAACTCTCATTAC | 17205 AGAGACCTGCTCTCAAGGCATTA | 28189 GCCTTGCTTTGGGAGAACAAAC | 39173 |
| 5548 TGGGAACCAATGGGCTTTCAT | 17206 TGCCTTGGCTGACCTACAAC | 28190 CCCTCTCAGCAAGGAGTGCTAT | 39174 |
| 5549 CACCTGAAGGGTTGCTCTCACAA | 17207 AGAGGCTGGCAGAGCCTACT | 28191 GTCAACGTCACTGCACCTGAA | 39175 |
| 5550 GGAACTGGCAGCTTGGTTTTC | 17208 GCCCGACCTTCAAGCCAAA | 28192 GGTCGTGGACTTAACCTGGAACT | 39176 |
| 5551 CACCTAACAAGAGTCCGAGGATAC | 17209 TGGCACACACCCCAAAGCTA | 28193 CCCAAAACTCCCTGAGCACCTAAC | 39177 |
| 5552 CAGAGCCAAAGGGACCATGAAG | 17210 GAAGTCCAGTGCCCCTCCAA | 28194 CGAGTTCATGAAAAGCTAGGACTCAGA | 39178 |
| 5553 GCTTGGAAACCAGGGTGGGAAT | 17211 CCCTGCAGGTAGGAGGGACTAT | 28195 CAGAACAGGCAGCTTGGAAAC | 39179 |
| 5554 GCATTGTACTCAGGGTGGAGAA | 17212 TGTGAAGATGGCTTGTCCCTTT | 28196 CCCGTGATGGGTAAGGCATTGT | 39180 |
| 5555 CGATTCCCACCCCAGGAATGA | 17213 AGCTCCAACCTCGCTGAGT | 28197 GCTGAGTCAGGGATGATCCGATT | 39181 |
| 5556 CACAGGAGCCACCTACTTCTGTGA | 17214 TGCTGGTGACCCTGAGTCAATG | 28198 TTCTTGTCTCCTTCAACCTAACACA | 39182 |
| 5557 GTCGGCAGAATTGGTACTTAACCTT | 17215 TTTCGGGCCTTCCCGCTAAA | 28199 GCCTTTGTCGGCAGAATTGGTA | 39183 |
| 5558 GGTGGGATGATAGCATGAAGGAA | 17216 CAAAGGCTGCAGACAGATGAAG | 28200 AGAGGGTGGGTGGGGATGATA | 39184 |
| 5559 CCTGAGCAGTGATCCCTTTAGTAAG | 17217 GGCACAGAGGCTACACACAT | 28201 TGGACACACCTGAGCAGTGA | 39185 |
| 5560 CTCCATGCTGCCTCTCTGAAAC | 17218 CCCCAGGTGAATACTGTGCCTTCA | 28202 TGTGCCCTCTGCCCTCTCTTCT | 39186 |
| 5561 GGCAGGATGACTGCTGTCCAA | 17219 GGAGGAAATCCCAGCACTGGTT | 28203 GCAAATTGCAAAAGGGCAGGAT | 39187 |
| 5562 GAGTGATGCCACAGCTCAAACAAC | 17220 TCTATGGAGACTGCCAACCGTTA | 28204 GGGACTCTGGAGGCTAGTGAGTGATG | 39188 |
| 5563 CCCTGGCTGCTTCCACAGT | 17221 CCCACCCCATGCTTGTCAAC | 28205 ACGCCTGAGCTCCTGGTAA | 39189 |
| 5564 TCAGCGTGCTCAGTGAAACA | 17222 TTTCTCCCTTCTCCATTCCACTATG | 28206 CATAATTAGAGGGCACAATGGGTTTC | 39190 |
| 5565 CACATCCTTGGGCATCACTGT | 17223 ACTGGCCTGGAGAAGCTGAT | 28207 GGAGGTTCACTTAATTGCCACATCCTT | 39191 |
| 5566 TCTGTAGGCTGTGTGGTCAATG | 17224 CACAACCAGAGAACTTAGCACATGA | 28208 CTGTAGGTCTTATTTCCAGCTCTGTAG | 39192 |
| 5567 CCACAGCCCTATACTCCAAGCATCT | 17225 TGGAGTGTTTGAAGAGCAAAGCTA | 28209 CCACTTTTCTCCCACAGCCCTATACT | 39193 |
| 5568 AGTGTGGCTCTGCTTAAAGGTT | 17226 GCCTCCCCTCTGTCAGACTTTTC | 28210 GAGAGGCATACAGAAGAGGTAAGTGT | 39194 |
| 5569 CAGGCAGGTCTTTCCCCTCTTT | 17227 TCGGCCAGCACTCCACAGA | 28211 TCTCTCCCAGGCAGGTCTTT | 39195 |
| 5570 ACCAGATGCTTTTAATCCCTGTGAA | 17228 GACCCTAAGGAAGTCATAGCCCATA | 28212 GTGCTCCTGAACCAGATGCTTT | 39196 |
| 5571 CCACCCAAGGGTTTTCACTCCTTCT | 17229 TGGCTGGGTAGGGCTGCAT | 28213 TGTCCACCACCCAAGGGTTTTC | 39197 |
| 5572 GGCATGAGGATAAAACTACTGCTGCTT | 17230 GCAGTCACACTTCCTCCAACA | 28214 CCAGTCTCTGAGGCATGAGGAT | 39198 |
| 5573 AGCACTGGCAAGGGAGCAA | 17231 CTGAAGGATGCTGGAAGTGGAA | 28215 CTCCAACTGCCTATTTCTCCTGATAC | 39199 |
| 5574 TGCTTCAGCCCTCTGCCTACA | 17232 CTTCAAAGCCAGAGCTCCATTTC | 28216 GGACAGCCATCTCTCTGCTTCA | 39200 |
| 5575 CAGCCTTCCTTCTTACCCGTTCATA | 17233 TGGATACCTAGCACCGTCCTTCT | 28217 TGAATACCTAGCAGCCCTCCTTCT | 39201 |
| 5576 CCAGAGCCCCAAGTGGATGTA | 17234 CACAGTGAGACACAATGAACACAA | 28218 CCAGAAGAAACCCGTCTGCTTGA | 39202 |
| 5577 AGGGCCAAATTGTCCTTCAGAAA | 17235 CTTGGGTAGGCCTAGGTGTTGA | 28219 ACAAACACATCTGAGGGCCAAAT | 39203 |
| 5578 GGCGACTCGATGGGAAAATTG | 17236 GCAGACACGGCATTGAGACA | 28220 GGGATGAAAGGCGACTCGAT | 39204 |
| 5579 GGAGCAGCTAAGAGAAGTAGAAACA | 17237 ACACCCCACCTCATCAGTCT | 28221 GCTATCTTTACGGGAGCAGCTAA | 39205 |
| 5580 GCACTGTCTAGGACACTGGCAAT | 17238 GGCAGCGGGTAGCTTGTGT | 28222 GCCTGTAGTAGATTAGGCACTGTGTAG | 39206 |
| 5581 GGCCCATTCCTTCCCGAGAAAA | 17239 GCAGGGACCGGAGCCTTTAT | 28223 CCCACCTGGCCCATTCCTT | 39207 |
| 5582 GGCATTGGTGAGAGTGCCATTTG | 17240 CCACCAAGCCTGCCAAAATTC | 28224 CAGTGGTGGCATTGGTGAGA | 39208 |
| 5583 TCTGGCCTGCCTGTCAACAAA | 17241 TGCTGTGCCCAGGGGAATGT | 28225 AGCCACACCCCGCTATGCATCT | 39209 |
| 5584 TCCTTGCCCTCCCAAGCGTAT | 17242 CACATACTCTGTGCTTCTCACTTTCT | 28226 CAGCAGAGCAGGCATAGACACAATCCTT | 39210 |
| 5585 GCAGCTACTAACATGTGACACACAA | 17243 TCTGAACCGCGCTGCATTTG | 28227 GAGGACACACTGCAGCTACTAAC | 39211 |
| 5586 GCTATAACCTTTGGTTTCCTGTCAGTTC | 17244 TCTTGGCAGGCAGAGTTCCTA | 28228 GACACCATCGGCAGGGCTATAA | 39212 |
| 5587 GTTCCTAAGGAGTGATGTGTGGATCA | 17245 CCTGCACCCAGTCCTTTCTTTAC | 28229 TGGGTCCAGGACAGTTCCTAAG | 39213 |

FIG. 36I6

| | | | |
|---|---|---|---|
| 5588 TCCAAGCAGGAGACAAAATTCACT | 17246 CTCTGGTCCATGAACTCATTTCCATTTG | 28230 GAGAGACTTTCCAAGCAGGAGACA | 39214 |
| 5589 GGCGAAGAGCCCAGTCATCA | 17247 GCAGTGTGGATCAGCCTGTACT | 28231 ATAGAGGCACAGGGCGAAGA | 39215 |
| 5590 GGTGCTTGGAGCATCCTTCAGAAA | 17248 CTCAGCAAGAATCAGTGACTTTCCAA | 28232 ACTCAGGGTGCTTGGAGCAT | 39216 |
| 5591 GCACCAGAAGCCCTGAAATCAAC | 17249 CCATTCCACAGCCAGCACAGA | 28233 TTCGGGCAGCACCAGAAG | 39217 |
| 5592 GGAATTTCCAGCTGTCCTGATCT | 17250 GGAGACTTAGACCCATTGGGAACA | 28234 GATTAATCCTCCCTGCCTGGAATTT | 39218 |
| 5593 CAGCATTCATCCCCTCTAAACGAT | 17251 CAGCTGTCTCTGCTTCCAACA | 28235 CCATGTGAGGACACAGCATTCATC | 39219 |
| 5594 CTCCAAATCCAATACCCCATGGAA | 17252 GTGAGAATTGGCCTGCACAAAC | 28236 CCTCTTTCTTCTTCCTCCAAATCCAA | 39220 |
| 5595 GCTCAGACAGCATGAGAGTAATACAGT | 17253 CAGTGCATAGGTTTCACCAGGAA | 28237 GACCTGATTGCTCAGACAGCATGA | 39221 |
| 5596 GCCCTTTCCTCTTTTGGCAGTAG | 17254 GGATGGGAGATCACACAGACCCTAT | 28238 GGGAGTAATGAAGCCCTTTCCTCTTT | 39222 |
| 5597 CCCCTCACACATGGAAAGAGATTTG | 17255 CGGAGCACTCACCATTCTAGACCTT | 28239 CCCAACCCCTCACACATGGAA | 39223 |
| 5598 CAAATGCAAAGGTTCTGAGGCAAA | 17256 CCCCTGTCTCTTGGTTGTTCCTT | 28240 GGCAGAGAACAGCAAATGCAA | 39224 |
| 5599 GCACAACCCCGGAACTGAAAGA | 17257 CCAGCTTACTGACTTGTAAGGATGGTT | 28241 GCAAGCAACAGGTGCACAA | 39225 |
| 5600 CCCTGAAACCCCACACATTGCAT | 17258 TGTGAAGGGAAGCTTTGGAATCA | 28242 CAAGTCCAGGCTCCCTGAAAC | 39226 |
| 5601 GGGAGACAAGGAGGCAACACAA | 17259 CACATGGATAGTTCAGTCTCCACACA | 28243 GGGCGAATCACTGGGAGACAA | 39227 |
| 5602 GGGAACAAAATGTTTCCCAGTCAAG | 17260 GTCTGCTTCCATGAACGTACAGA | 28244 CACACAACCTCCATGTGGGAACA | 39228 |
| 5603 CAGCCTAAAAGCAAAGCCAAGTAAG | 17261 GAGACCTTGTTCCCTTTATGCATCTT | 28245 TGACGTTCAGCCTAAAAGCAAAG | 39229 |
| 5604 GCCACCTACCCACCCACTCA | 17262 GAGGCATAATCCCAAATCTCTCTGT | 28246 AGGCAGTGAGAAGCCACCTA | 39230 |
| 5605 GGCAATGCGAATGAGTTCCTACA | 17263 GTGTTATGTGTCAAGCCTTCTGTTC | 28247 GGAACAAACTGTGGCAATGCGAATG | 39231 |
| 5606 CACCACCAAAAGGCTGATAAAGTGAA | 17264 GTCTGTGAGAGAACATTCCGTGAATCAAT | 28248 GCTATGGAACAAAAAGACACCACCAA | 39232 |
| 5607 CCTGAGGCTCCATGCTTTTAATAACT | 17265 CCTGGTTCACATGCTGTGGTGTA | 28249 TCCATCCTGAGGCTCCATGCTT | 39233 |
| 5608 CACTTTGATCTCCTTATGCTGCTAGT | 17266 GCCAAGGTGGGTGTGCATCTT | 28250 GGCTGGGTCACTTTGATCTCCTTAT | 39234 |
| 5609 CCTTTGGAAACTTATAGTAGCCAGAGTTTG | 17267 AGACAGCCTCGGTTCTGGAAT | 28251 CCAGGGGAAGAATGACATTGACCTTTG | 39235 |
| 5610 CTTCCCACTCTGGTTTATAGGGAAGA | 17268 CTCTAGGCCAGGGACTTAATTACACA | 28252 GATCACTCTTCCCACTCTGGTTT | 39236 |
| 5611 CCTGGGTAATAACTGAGATGGAGTCA | 17269 GGGGTGTTGCATCTGTGCAT | 28253 TCACTTAGGCACTCCTGGGTAA | 39237 |
| 5612 CCCTTCATAAGTAGCGTCACTCAA | 17270 GCAGGAAATAAAGCAAGGGGATTTG | 28254 TCTCAGAAAGGCCTTCCCTTCA | 39238 |
| 5613 GGAGGTTATTCACAGGGCTTCAGA | 17271 GCTCATTGGCTTCCTTACTGTGA | 28255 CTGGCCGCATAGGGAGGTTATTC | 39239 |
| 5614 TCAGACCCTAGCTGTTTCACTACT | 17272 CCTGAAGCACTAGGCTGTCAA | 28256 TCTGAAGTCAGTCAGTGTGTTC | 39240 |
| 5615 CTCACCTGTACTTTCTACTCTTCAT | 17273 TGCATTGCCTGGTATGAGGAATTAG | 28257 CCAGTGTCAAGGCTCACCTGTA | 39241 |
| 5616 GCTGCTCAAGTCTAAGTTGCGAATTTCT | 17274 CTGGTTTCGCTAGAGTCTTGTTC | 28258 GAGAACTGCTGCTCAAGTCTAAGT | 39242 |
| 5617 ATGCACTAGGATTGCCTTCTGTT | 17275 GCACGGAAAAGCAAAAGCTGATAAC | 28259 TCCAAGCCATAAATGCACTAGGAT | 39243 |
| 5618 CCACAGTTAGGATCCTTTAAGCTTTTC | 17276 TCAGAGAACGGCACCGGAGAT | 28260 AGGGCTGCCACAGTTAGGAT | 39244 |
| 5619 CCCTGTCTCACTGAAGAGCTGTAG | 17277 GAGAGCCTGATGACCACAGGAA | 28261 AAGGGCCCTGTCTCACTGAA | 39245 |
| 5620 CCCGGCTCATCAGTTTGTGCTA | 17278 GAACCTGAAAGGCATTGAACGTAACA | 28262 GCAGCATCTACCCGGCTCAT | 39246 |
| 5621 GGGCCACTTACTCAAAGCTTCTTG | 17279 GTCAATATGCATGACCAGGACCTAGA | 28263 TGACCACTTCAGGGCCACTT | 39247 |
| 5622 CCTGTTCACATAGATCCCAGGTCAAG | 17280 CAGGTGGCTAGAGTAGCTGCAT | 28264 GCCAAAGGAGCCCTGTTCACAT | 39248 |
| 5623 AGGGTAAAAAGTCCAAGTGTGAGT | 17281 CCTTCCTTGGCGTGCAGTAGAT | 28265 GTGAGAGACAGGAAGTCAAAGGGTAAA | 39249 |
| 5624 GCCCTTAGACGAGGTGAGTTC | 17282 CCCCTGTCGCCAATGATCCTA | 28266 GGCTGAGGAAGCAGCCCTTA | 39250 |
| 5625 GTTGCACTACAAGGTAGATTGGGTTA | 17283 GATTGGCCTACTGCATAATTCCCTAT | 28267 GGTCGTTAGTCAGTCTGTTGCACTAC | 39251 |
| 5626 AGCACAGGAAGGGGATTCTTTG | 17284 GGTGGAACTTTCCTTACAGTCAGACA | 28268 TTGCCCCTCTGCCTCTCCTAAA | 39252 |
| 5627 GGCTAACCTGACAATTACCTCAATG | 17285 GCAGGAGGGAGATTTGTGGAAA | 28269 CAGTGAGGAGCAGATGGCTAAC | 39253 |
| 5628 CCTTAGCGGGGAACCTAATTTTTC | 17286 TGTGAACTGTTAGGAAGCTGTCTTT | 28270 GGTGGGCTGCTGTAGCCTTA | 39254 |
| 5629 CTGCCTGCTATTTCCCAACTGT | 17287 CCCGGCCACAATGGCATCT | 28271 CCGCTGGAACTGCCTGCTATTT | 39255 |
| 5630 CCTGGCCACATGTGTCTGAAC | 17288 GCAACTGGCTCCCCTTCTCT | 28272 ACCTGGATCCCTGGCCACAT | 39256 |
| 5631 CCCGTCCTACCTCTAAACACAGA | 17289 GCTTTGTCCTCCACCTCCTAAG | 28273 GCTTTCAAGCAATCCCGTCCTA | 39257 |
| 5632 CCTTCTGCTTTTCCACCATGTTAAG | 17290 GCAGCAGCCTTCTGGTGCAA | 28274 GTCCTGCTTGTCCTTCTGCTT | 39258 |
| 5633 CTCTGTAGTGCTCCCCACATTG | 17291 GGTTGGAGATAAAACACGTGTAGGATTG | 28275 CACCTTCTGTGCCACTCTGTAG | 39259 |
| 5634 ACGCCCCGTGATACTGTTCCTA | 17292 ACAGGCGGAATGTAATATCGTTCT | 28276 TGCACACGCCCGTGATA | 39260 |
| 5635 TCTGCGAGCACTTGAGGTTTC | 17293 GCCCAGCCAGTGAGCTTATTC | 28277 GCCTGACTTGCCGATGCTTCT | 39261 |
| 5636 GGCTGGGTTGAGAAGCATGA | 17294 GCCCCTTGGAAATCAATACACTTTG | 28278 TGCTTCTGTGGGCTGGGTTGA | 39262 |
| 5637 CATGGCTGAAGAGGACCATGT | 17295 ACCCAGGAATTCATCACAAAACTGT | 28279 TGAAACGGATCATGGCTGAAGA | 39263 |
| 5638 GGGCACAACACTGAAGCTCTGA | 17296 CCCTGACTGAGAACCAAGGACTGA | 28280 CCTTGTAGAGGGGCACAACACT | 39264 |
| 5639 GGGTAGATTCAGAAAGCAGCTATGA | 17297 ACACAAGGTAACAGTCTTTCACAGT | 28281 GCTCCCCTGTAGGGTAGATTCAGA | 39265 |
| 5640 GCAGGTGAGTGTACTGTGAGCTA | 17298 CCAGCTGGTGATGGCAGATA | 28282 AGCTGTTTTTGCAGGTGAGTGTA | 39266 |
| 5641 CAGGCAAGATGTACGCCTTCAA | 17299 GGCCTCCCCTTTCTGCTTCTT | 28283 CGGGCACAGGCAAGATGT | 39267 |
| 5642 GCAACAGGAACCATGAAGAGCAGAA | 17300 AGCTCCCAGCTGTGCAGTCTA | 28284 CCAGAGAAGCAACAGGAACCATGA | 39268 |
| 5643 GGGACATGCTGACAAGGACTGT | 17301 GTGGCAGATTGATTCCCTCAGAT | 28285 GTTTTGTTAGCCAAGAAAGGGACAT | 39269 |
| 5644 GGGCCCTGTAAAGGAGAGAAATTG | 17302 GAACCCTCCACTGTCCTTGTTAG | 28286 CTCATTGGATTGGGCCCTGTAA | 39270 |
| 5645 GTGGCCGAATCCCACCAAAA | 17303 GTGAGGATGACCAGAGGTCTCTTT | 28287 GTGGTAAAGAAGGTGGCCGAATC | 39271 |
| 5646 ATACACAGAGCCGCCCATCA | 17304 CGCGGGAAATGCGGGAAAT | 28288 CATCGTCTGCCGGATACACA | 39272 |
| 5647 GCCATACCTGAAACCACGTTTAC | 17305 GACTGACCACTGATACTTCCTGTTAAATCA | 28289 CGGCCTCTGAATTTTGCCATAC | 39273 |
| 5648 AGGTGTAGCTCCGGTCGAA | 17306 TGCAACTTTGCAGGTAAAGAGAT | 28290 CCCAGAAAGAAGGCGAGGTGTAG | 39274 |
| 5649 CCTGCCTCCCAAACTCCAGTAGA | 17307 GGGATAGGCGAAGAGTAGACAGA | 28291 AACAGAGCCTGCCTCCCAAA | 39275 |
| 5650 CTTAAGGCCTGGATGTCTGTTTGA | 17308 CAGGTGGATTGCAAGACAGGAA | 28292 CTGCTGACTTCTTAAGGCCTGGAT | 39276 |
| 5651 CCCATTGTCCAACAGGGCTTTTC | 17309 TGGGGCTTTTGTAAAGCGACAT | 28293 GAATCTTCCCCATCTCCCATTGT | 39277 |
| 5652 CAAGGCTTCCTTTTCAGTCCTAGT | 17310 AGGATAGAGAGGGGCCAAATGT | 28294 CCCTCACCAATTCAAGGCTTCCTTT | 39278 |

FIG. 36I7

| | | | |
|---|---|---|---|
| 5653 | CCGTCTCACTGCTGTCTTCTGT | 17311 AGGGAAGGACTCCCAGGGAAAA | 28295 GGCCAAGATGCCGTCTCACT | 39279 |
| 5654 | AAGCCGAACGAAATAGGAAGGAA | 17312 GAAAGTGCGGATGGAATGGAATTG | 28296 CATCTTCTCAAAGCCGAACGAAA | 39280 |
| 5655 | GGGCAGCAGCAAAGAAACTTG | 17313 CTGTTGAGATGAAAAGGGAGTGGAT | 28297 AAGCGAAGGGCAGCAGCAA | 39281 |
| 5656 | GCCTAATGAGATTTAAGGCAGGGACTCA | 17314 CTTTGGGCAGACCTAGAGCAA | 28298 CCCCTTCATCCTCATGCCTAATG | 39282 |
| 5657 | GGGGATATCCTGTGTGTGGTTGA | 17315 GGAAGCCACAGACCCTCAAAT | 28299 CCAAGCCATGGAAGTTTGGGGATA | 39283 |
| 5658 | GTGGGATAACACCTTTCCCCAAA | 17316 GCTAGAACATCATACATCGAGGCATAC | 28300 GGATTTGGACTCTCTTAAAAGTGGGATAAC | 39284 |
| 5659 | GCCCATGCGATGGCAGCAAA | 17317 GCCTGAGCTGCATTCAGACATAGT | 28301 AGGACAGTGGCCCATGGAT | 39285 |
| 5660 | GCAAGATTCATGCCGCAGACA | 17318 GCCTGGGGAATTATAAGGAAGGGATT | 28302 CCACAGCCTGGCAAGATTCA | 39286 |
| 5661 | GTCGTTGCTGTCTCTGCTTTAGT | 17319 ACTAACCCTCCCCCTCCAGTGT | 28303 GGTCCCTTGTCTGGTGTCGTT | 39287 |
| 5662 | GCAGTGATTCTCACACCCTACTGT | 17320 CGCAAGTCTGCATTCCAACAA | 28304 CACAGGGAGCAGTGATTCTCACA | 39288 |
| 5663 | GGAAACGTAGGAAGGTTCTCTAGTGTGA | 17321 CTGGGAATCTAGTTAGGAAGGCTGTA | 28305 TTGGTGAGAGCTGGGAGGAA | 39289 |
| 5664 | CCCATCACTGCCTCATGTGTTC | 17322 CGACTTCACCATCTTCCTTCGTCTCT | 28306 GGAAAGCAGTGCCCATCACT | 39290 |
| 5665 | GCCATTCCAATTTATGGGCAGTCA | 17323 CCATTCAGAGCTCTTGACTCAATGATAC | 28307 CTGAGTCTTGTTGGGAGCCATT | 39291 |
| 5666 | AGGAGCTGGCATAAAGTTGAACA | 17324 GAGCAGAGAAGACACCTCATATAGCTT | 28308 CTTCTCTGAAAAGGAGCTGGCATA | 39292 |
| 5667 | GCGAGGGAGGATGAGAAATAGGTTGT | 17325 TAGTGGCGAGGAGGCGAGTT | 28309 GGTGTTGATAGCGAGGGAGGATGA | 39293 |
| 5668 | GGTCAGCCTGTGTTCAGGATCT | 17326 GAGTCTGAAGCCCACAACTATTTTCA | 28310 AAGGTGGGTCAGCCTGTGT | 39294 |
| 5669 | GTGGGTGCCAGACATGTAGATCAAG | 17327 GCAAGCAGCTGGCAGTTGAA | 28311 CCCTGTGGGTGCCAGACAT | 39295 |
| 5670 | GCAAACTTCAGGGGAAGATCACT | 17328 TGCCTGGTTACCTCCCATTTAC | 28312 CAGGCACCAAGAGCAAACTTC | 39296 |
| 5671 | CTGGTACTTACCCTGTGCCAGAAG | 17329 GCACAGACAACCTTGGTAGTAAC | 28313 GGGTACAGGTGACAATTAGCCTGGTA | 39297 |
| 5672 | CTGTAACACCTGGGAAACCTGATGTAT | 17330 TCAGAGGGTGAAGAGGAAGTTTTC | 28314 AGAAAGTGGCAAATGGCTGTAAC | 39298 |
| 5673 | AGTGCTTTCTCAGTATCTCCCAAAAG | 17331 GTGATGGGCTGATGGTACCTCTT | 28315 CTCCTAGTCCAGTGCTTCTCAGT | 39299 |
| 5674 | CCCCATTTGTAAGCCGGGAACA | 17332 TGATCCCAGGACAAACACGATT | 28316 GGCCGTAAATAAACCTCCCCATTTG | 39300 |
| 5675 | GAAGTCAGAACGCTGCTTGTTC | 17333 CCACACCACGGTCTTGTCTTAG | 28317 TGCAGACTCAGTATGAAGTCAGAAC | 39301 |
| 5676 | ACCTGTCCTTTGAGCTGTGCAT | 17334 TGAGGCACTCCCGCCTTTGA | 28318 ACCCTGGGACAAACCTGTCT | 39302 |
| 5677 | GTCTGCTTTGAACCGAGTCTTTG | 17335 CTGAGAGGACATTTGATGGGTCTAA | 28319 CCCTTACACAGTGTCTGCTTTGA | 39303 |
| 5678 | GGCTCAAACAATCCCACTGCCTTAC | 17336 GTGGCGGTGAATGCCTGTAATC | 28320 CCTTCACCTGTAGGGCTCAAAC | 39304 |
| 5679 | GCTTGAATCTCCCACTGACATCAA | 17337 CAAGTATCTGGACAAGCTGATAAGGAA | 28321 CATGGGCTTTTGTGGCTTGAATC | 39305 |
| 5680 | CTCCCCGCATGTGCATGACTAA | 17338 GCCAGTGGATTCTGCGTCAA | 28322 AGATGTGTCTCCCCGCATGT | 39306 |
| 5681 | CACACTGACCCTTGCTTCTTCA | 17339 GCATTCCAGGATGGGAAAACCATA | 28323 CACCAGGCTTCAAACACACTGA | 39307 |
| 5682 | GTCACCATGTAATTTCCCAATGGTT | 17340 GTCTTTCCAAAGTTTCATCCACACATC | 28324 GTGGCCCTAAAGTCACCATGT | 39308 |
| 5683 | GCAGCACAGGCTTATTTCTTGACA | 17341 CCCCACATACTCTCTGTGTTATTGAGATG | 28325 GGGAATATGGCAGCACAGGCTTA | 39309 |
| 5684 | GAGTGGATGAACCCAGCAAGTTC | 17342 CCAGTGTGACATGACTAGGATGTTG | 28326 TTTAGTAGTAGCTCAGAGTGGATGAAC | 39310 |
| 5685 | GAAAAGCTCTCACTTTCCCTGATCT | 17343 TCTGACACTGAGTTGGGAAGGAA | 28327 ACAGGCTCTGCTCCACTAGA | 39311 |
| 5686 | GCTGATGCCTGATCTTGAGCCCTAA | 17344 CTGGTTCTGCTAACATTGGTGTCAAC | 28328 GCAAGGCTGATGCCTGATCT | 39312 |
| 5687 | GTTGTGTGATGCTCACAGACTGA | 17345 GGGGCAAGGGCTGCAAAAGTAA | 28329 TCACATGGGCATGTTGTGTGAT | 39313 |
| 5688 | TGGGGAAACAGAGGCAGCTAAATCA | 17346 GGTGCCTACCCTATGTGATTTCTGA | 28330 TACCCGAGGCTGGGGAAAGAA | 39314 |
| 5689 | CCTTTATGGGCACCAACTGATTTC | 17347 ACTGCCCTGTGACACTGGAA | 28331 GGGCTGGTCTAGATGCTTCCTT | 39315 |
| 5690 | CTGAGGTTCTATGCCTAAAGAAACCAA | 17348 GAGCTAAAGTCTGAGGAGGTTCTGTTTTA | 28332 GTGACTTCCTGAGGTTCTATGCCTAA | 39316 |
| 5691 | GCTACCAAAATGGGGCTAGGAAGA | 17349 TGGAATGGTGTAGCCCAGTGA | 28333 GGCCAGCGTAGAGCTACCAA | 39317 |
| 5692 | GCAACTGTGAACTCAGGAGCAAGT | 17350 GACCTGCTCAATGCTTCTGGGTAAG | 28334 TGTCTGGTATGCAACTGTGAACT | 39318 |
| 5693 | GGGGATTGCTGATTGGTTGGATTG | 17351 GGGGACAGCTTTGATTCCCTATG | 28335 TGGGCTAGGGAATGGGGATTG | 39319 |
| 5694 | CAGCCAGCACTAAACGTAGAGAAAG | 17352 CACAGCGTAGGCAATGATTCTTC | 28336 GCAGAAAGAGTAAACAGCCAGCACTA | 39320 |
| 5695 | GGAAAGAGAAATAATGGGAAGCATGTGAT | 17353 GCCTGGTGGAACTGGCTATTGT | 28337 TCAGTGTGGACATGGAAAGAGAAA | 39321 |
| 5696 | AGGGAAGCGTACTGAGTGCTAT | 17354 CTGTATCCCACCAGAGTTGGTTAG | 28338 GGCTTCAAGAAAGGGAAGCGTACT | 39322 |
| 5697 | TGGAAACAGAGGCAGCTAAATCA | 17355 TCTGCCCCTTCTAGCTCTGCTT | 28339 CTCCAGCCTCCTGCTTTGGAA | 39323 |
| 5698 | CCTCTCTCCCCTCGGCTCTA | 17356 CCCCAGCTCTTCTCTTCCTAGAT | 28340 CCTTTCCCTTGAGTCCCTCTCT | 39324 |
| 5699 | GCTCGTAGTGTGAACTGGGAACT | 17357 CCACTTAGTCCTTTCAGCAGCCAAAT | 28341 CACCACTGGCTCGTAGTGTGAA | 39325 |
| 5700 | CAGGCTTGGACTAGAAGTACACCAT | 17358 GCAGTTGGCAAGCTGGAGACT | 28342 CTGGACTTCAGGCTTGGACTAGA | 39326 |
| 5701 | GCAGGTTGCTTGGGTTGACA | 17359 GAAAAGAGACACACAACAAGGCTATG | 28343 TGGAACAAGGCAGGTTGCTT | 39327 |
| 5702 | CTGAGTTTTCAAAGGCTACACGTTACTTC | 17360 GGGTGGAGTGAAGCCAATTCCAA | 28344 GCAACCGGTCGAATATGCTCTGA | 39328 |
| 5703 | GCTGTCCCCATACTAGTGACTCAT | 17361 AGTGGGTGTGCAGTTTGCTT | 28345 GGACAGAAGAGCTGTCCCCATACT | 39329 |
| 5704 | AGCTACGTGGACCCCACTGTT | 17362 GGTGGTAGAGCAGAGTCCAGTGT | 28346 GGCTGTGCTTGTCTTCAGCTA | 39330 |
| 5705 | GCCTTTCTCGGCCTTTGGAATC | 17363 CTTCAAAAGTTATGCTGTGGTGGTAGA | 28347 CACAATGTTCCGAGTTGCCTTTC | 39331 |
| 5706 | CCATGGACTAAAGGGTTATAGGGTTCTA | 17364 GCTGTCTTTGTGGTCTAGATTGCTTT | 28348 CCACCACCATGGACTAAAGGGTTA | 39332 |
| 5707 | CTGGTAACCTACTAAGGCTTGTTTTG | 17365 TTTCCTCTGGCCCTGACCAT | 28349 CCCATGTATCTCTTCTGGTAACCTACTAAG | 39333 |
| 5708 | CCCTGCACACCCTCTCAGT | 17366 GGGAAACAAAGTCAATCCTCCATTTC | 28350 GAGTTCCCCTGCCGACTTG | 39334 |
| 5709 | TCCCTTAAGTCCCGGAGCAT | 17367 GGGGAGTTAATCAGATTTGCTTTGAGA | 28351 GGCCCTCAGAGATCTGTATTCCCTTA | 39335 |
| 5710 | TTGCTACTGGGCTCTGGTGAGA | 17368 GTGGTGAGACTTGGAAAGGGGTTT | 28352 TGGGCGAGCACTTGCTACT | 39336 |
| 5711 | TGATGTCCAGACAGAGTGTTCAGA | 17369 GTGGTTAATGGAAAACAGGGCATAG | 28353 GGGGACATGTTTGATGTCCAGACAGA | 39337 |
| 5712 | CCCTGTGTTTTTGGAAGACACCATGT | 17370 CACCTGGATATTTCAGAAGCCCTTGA | 28354 GCTTTTACTCCCTGTGTTTTTGGAA | 39338 |
| 5713 | GGCCTGAGTTCTGATTTGGTGTTG | 17371 CCTAAGTCACTCCACAGGACACA | 28355 GGGTCTAGACAGGCCTGAGTTCTA | 39339 |
| 5714 | GGTGGGATGGAGGATTCTCTTTGT | 17372 TCAGGTAGGTAGCCTGCTCTAAA | 28356 AGAAAGAGGTGGGATGGAGGAT | 39340 |
| 5715 | GTGTCCCAGAACGAGCACTT | 17373 GGACTACTTGCGTTTTGATTGCTA | 28357 GAGTGTCAGTTGTGTCCCAGAA | 39341 |
| 5716 | CGGGACCAGTAGTCTTGTTTAATCACATA | 17374 GAAGTCACGCATTGAATCAGAGTAG | 28358 GGCGGGACCAGTAGTCTTGTTT | 39342 |
| 5717 | GCTCTCCCTAGACATGGCGACTA | 17375 CTCTTTGAGCTTGGAGTCTCTAATACA | 28359 GTGCACATGCTCTCCCTAGACA | 39343 |

FIG. 36I8

| | | | |
|---|---|---|---|
| 5718 GGGGATGTAGGGTGGAAAGAAAC | 17376 GTGTTCAGCCTCTGCCTATTTTC | 28360 CCGTAAACCAAGTGGGGATGTAG | 39344 |
| 5719 CTGTGCTGGTAAGAGAATTAGCTGGAAT | 17377 GGGCCTTTTTACATGTTCCAGAAG | 28361 CCTCAGTCTGTGCTGGTAAGAGA | 39345 |
| 5720 GTTGCCTCCTTTGACCCTGAA | 17378 GTGAGTCATGCCAAGATGAGATTG | 28362 CTCAACATGGAATTAAGTTGCCTCCTT | 39346 |
| 5721 TCTGGGCCATTCGGTAACATC | 17379 CAGTACACGGAAGCTGATGTAAGA | 28363 ACTCTTATCTAGGATTCTGGGCCATT | 39347 |
| 5722 GCATAATTGGGCCTAGTGGGTTATG | 17380 GAGAACAGCACCAAGCCTCTCA | 28364 TTGGTCCCCGTTGTTGCAT | 39348 |
| 5723 CCTGAGGAAAGAATCCCTGAGCTTT | 17381 GGACTGAGACAGGGGTTTTAACTGA | 28365 GACTGGCACTCCTGAGGAAAGA | 39349 |
| 5724 GAGGGAGATGACCTCCACTGA | 17382 AGACACACGGGGCCTTTG | 28366 CCTGGGGAGGAGGGAGATGA | 39350 |
| 5725 GCAGTTTTGCACCAACCTAATGCTT | 17383 GGAGCATTTTGACGTGGGTGATT | 28367 CAGAACAGCAGTTTTGCACCAA | 39351 |
| 5726 CTGGCTCTGCAGTTTGGAGAAAAG | 17384 TGGTTTGGGTTCTGAATGACACA | 28368 GGATGCACTGGCTCTGCAGTTT | 39352 |
| 5727 CCAGATGGGCTGACACAGTCAT | 17385 CTGTCTTAGGAATAAGGCGAGGTTGAAG | 28369 CTCTTGGATTCACGGCCAGATG | 39353 |
| 5728 CACTGTGGAGTTTTTCCTGGTTGTAA | 17386 GTGCCACTACAGCTGGAAGGAT | 28370 GGACATGATTGGTTCACTGTGGAGTT | 39354 |
| 5729 TGGGAAGTCCTGGCATGTAAC | 17387 CACCAAGGCCAATCCCTTCA | 28371 ACCTATCCTTGACGTGGGAAGT | 39355 |
| 5730 GCAGCGACAATGAAACCCAGTTC | 17388 GTGGGTGAGCTACTTTTCTCAGGAT | 28372 CCTGCAGCAGCGACAATGAA | 39356 |
| 5731 TGCAGTGTTGATGTCACATGCTAT | 17389 CCCATTGTAGACCATTTGCTCTCT | 28373 CCTAAAGGGAAAAATGCAGTGTTGA | 39357 |
| 5732 CAGGGTTCTGCAATGTACCACAA | 17390 GGCCCTGCCATTCAAAATCACCTT | 28374 GGCCTAAGTCAGGGTTCTGCAAT | 39358 |
| 5733 TCCACTTCCACTGGCTGACA | 17391 CCATACCATGCAGGCTTACTCAAG | 28375 AGTGCTCACCCCTTCCACTT | 39359 |
| 5734 CACTGCATTCCCACTCATATGCTTCT | 17392 CACCATGGCTACTGACCCATT | 28376 CATAACTACACTGCATTCCCACTCA | 39360 |
| 5735 TGTGGGGAAATTTGCCTATACACT | 17393 TTGGGGCTCGGAAGGAACAT | 28377 GGAACTCAGCTTTTCATTGTGGGGAAA | 39361 |
| 5736 GGGTAAACAAGGCTAAGAAGCAAAG | 17394 GGGAGTGTGACTGTAGAGAATGTTAG | 28378 AAACCTGCTGACAGGGTAAACA | 39362 |
| 5737 GGAAACACCTCAACCCGCATT | 17395 GGCAGAGCAGGAGACTAGGAACA | 28379 CCCGTGCTTCTAACAGATTGGAAA | 39363 |
| 5738 CATCCTCAGACTGGGACTTCTGT | 17396 TGGCTGAGGGGTCAGTTTTATG | 28380 CCAAGCACCAAGGACATCCTCAGA | 39364 |
| 5739 TGGTGCTTAAGAGTAGGCTGATTC | 17397 CTGTGAACACAGGAAGTCCAAGA | 28381 TTGGGGTTGAGATCCAGCAGATG | 39365 |
| 5740 TGGTTCTGAGCAAATTGTGGTACT | 17398 CAACGCCAGACCTTTCTTATTTGT | 28382 GGTGCTTACATGGTTCTGAGCAA | 39366 |
| 5741 GCTAGAGTGCTAAGCTTTCTGTCA | 17399 GTTCTTAGGATCCTGTCCTGCTTTAC | 28383 CTGGGATAAGAGCTAGAGTGCTAAG | 39367 |
| 5742 GGCATTACCAGCTACTGAGATTTTAGA | 17400 CTGCCCTGGTAAATATCCAACTGA | 28384 GACTTAAGAAGGCATTACCAGCTACTGA | 39368 |
| 5743 CCACACCAAGAATGGTTATCAGTGTGAA | 17401 GTGGGACTAGAGAACATATCTGTGAGA | 28385 CTGGCCACACCAAGAATGGTT | 39369 |
| 5744 AACCCAGCATATGAGTGCAATGAA | 17402 TGTTTTGCCTGACATTGAGTGA | 28386 CCAGCTGCCAGAGGTTTCACAT | 39370 |
| 5745 AGGGGATGACCAACCCTGAT | 17403 TCTTGTTGCTCTTGAAGGCATTG | 28387 GGTTGGAATATGAATGTGGAGGGGATGA | 39371 |
| 5746 GGCTGTTCTTCAACAAGAAGTGAATG | 17404 GTTGCTTTGCATTCCAAGCCTTTC | 28388 ATACCAAAGGCTGTTCTTCAACAAG | 39372 |
| 5747 CCAGGATTAGAAAGTTCAACCCAAGT | 17405 GGAGGGAAAATGCACTGAGACA | 28389 TCCCACTCACTTTCCAGGATTAGA | 39373 |
| 5748 CCGCCAAGTCAGTTCAGACAGA | 17406 CCGATGGGATGTGGAGGTGAT | 28390 ATGCATCCCGCCAAGTCAGT | 39374 |
| 5749 GCTCCTCTCTTTGTGAGGCAAA | 17407 TCTGGTCTTAGGCTGGAGATTAGT | 28391 TGCCATTTTTGCTCCTCTCTTTG | 39375 |
| 5750 CGTGTCTGCATTCTCCCTTCA | 17408 GGTGAGTGCCATGTTGTTTACTGT | 28392 CACTGCATCCACTCTCGTGTCT | 39376 |
| 5751 CCCACATGCAACCCAGTTCTTC | 17409 TGTGCCAGCCTTCTGTATCTTG | 28393 TCCTTGAAGCCCACATGCAA | 39377 |
| 5752 GCCTTTCTGCAGAAACTCCCAGATA | 17410 GATCCTTCCCACTCCAGGAAAC | 28394 TGAGGACCGAGATTTTGCCTTT | 39378 |
| 5753 AGAGATACCGATACTCTCTCCATCAA | 17411 AGGATCCCAATCCTAGCTGTCA | 28395 GCATTAGTACTGCAGAGATACCGATAC | 39379 |
| 5754 TCTGTGTTGCTCACTACTGCTT | 17412 TGGTTGGGAGACACACGGAGAT | 28396 ATGGTCTGGCTGCCTGTTCT | 39380 |
| 5755 CTCTTCAGCTCAACCCTCCCTTTT | 17413 TGGGCAGAGTGCTTGGAAAG | 28397 AGGCCCAGCTTAGCTCTTCA | 39381 |
| 5756 CCAAAGTGAACCTAAAGCCTTACTCCAA | 17414 ACCAACCAGTAAAGTCCAGTAACCTA | 28398 TCTGGGACCAAAGTGAACCTAAAG | 39382 |
| 5757 GGCCCTTCCTTTAGAGCTTTTCA | 17415 AGCTCCCCAGGCAATTCAGGTA | 28399 GGTTCAGAAAATGGCCCTTCCTTTAG | 39383 |
| 5758 GGCTGCAGCATAACTGGCTTTG | 17416 GTGCCCTTTTCCCTGTCCAGAA | 28400 TGCACAGGCTGCAGCATAAC | 39384 |
| 5759 GGCTGAGGTCATTAAGACCTAGTGT | 17417 AGGCCTCCAGGACAGGGAAA | 28401 CCACCCAGGCTGAGGTCATTAAG | 39385 |
| 5760 CGGAGATAGGAGCACACTCTTG | 17418 GGTGCAAATAGGGTGTGATTAGAAGGAA | 28402 CGGGACCTTGATTTCGGAGATAG | 39386 |
| 5761 CCCTCTCTTCTTCATCAGCACTCTTT | 17419 CAGAAGCTTGATGCATTCCCAAGAAC | 28403 GGGAGTAGACACATACCCTCTCTTC | 39387 |
| 5762 CAGAGAACTCTGAAGCTGGCTAGT | 17420 GAGAAACCAAAACCCAGGTCTGT | 28404 CCTCTGGATTAGGTAATGAGGCAGAGAA | 39388 |
| 5763 TCCAGGTCTTCTCAAGGCATCTA | 17421 GTGCCCTAACTTGGTGCTTCTCT | 28405 GCTAAGCATGTCAGAATTCCAGGTCTT | 39389 |
| 5764 GCCAAGTCGGTGGCGAGAA | 17422 GGAGGTGTGTCTGGCTTGCAT | 28406 AGCCGTCATCCAGCCAAGT | 39390 |
| 5765 GTGTGTGGGCTTCGCTACAGAAA | 17423 CCAACCGGACACCTCTCATACA | 28407 CCCAGTTTCCAGGGGTGTGT | 39391 |
| 5766 CCTCTGTTTGCGCAGAGATCACA | 17424 CTCCTGGGGTCCCTTTTTCTCT | 28408 GACTAAGTGTGTTGCCTCTGTTTG | 39392 |
| 5767 GACAGGAGTGTAAAGGTTCCAAATAG | 17425 GGCCTTTATTTGTTCCTGGTCAGT | 28409 GGCATAGGGTTTGACAGGAGTGTTA | 39393 |
| 5768 CACTGGCTCTCTGAGCATCTTAAATC | 17426 GACTTAAGTTTAAAACCCAGGCTGTTC | 28410 GAGAATTATACATCACTGGCTCTCTGA | 39394 |
| 5769 GTGGCTCTCAAACCAGACACCAA | 17427 CCAGTGGAGATGCCTGCAATCA | 28411 AGCATGCATGTGGCTCTCAAA | 39395 |
| 5770 CTGCCTACTCCCCACATCTTTAC | 17428 GGAGCCCTATGGGCCATCAA | 28412 ACAAGCCCCATATCTGCCTACT | 39396 |
| 5771 GCTTGTTCCACTCCCGTCACA | 17429 GGGCTGGAACCAATGGCTAGT | 28413 GCCTTCCCATCTGTGAGCTTGTTC | 39397 |
| 5772 CATTGCAAAGAGTTCCAGTGAACA | 17430 GGAAACCACTTGGAATCTGGTAGT | 28414 CTGCAGTCAGACATTGCAAAGAGTT | 39398 |
| 5773 GGCATGGGACTTCACTCTGACA | 17431 GGGAGCAGAAAGAGGAGATCTTAG | 28415 GGGTGAGGGCATGGGACTTC | 39399 |
| 5774 GCTCTTCCAAAACATTGCCACATATC | 17432 CCTGGTTTTCAGGGAGGGAAGA | 28416 GGTCCCACATGGCTCTTCCAAA | 39400 |
| 5775 GGACTGCAGGATACCTGTTGCTT | 17433 TCGCTGAGGGCTGTCTCT | 28417 GGAGCTAAAGGGACTGCAGGATAC | 39401 |
| 5776 CCACTAGAAATTGGATTGACCCAACA | 17434 TGGCGGGAAGACTAACGTTTC | 28418 TGCCAACAACCACTAGAAATTGGAT | 39402 |
| 5777 TCGATGCCAACTCTATCCATGAAA | 17435 GCTTCCTACCTTCAGTAGTATCAGTAGT | 28419 CTGATATCCAAATCGATGCCAACTCT | 39403 |
| 5778 GGACTGCGTACAAAGACTGCCTAAT | 17436 TGGGGTACAAGGACGGAACA | 28420 GCGTGATTAGGACTGCGTACA | 39404 |
| 5779 GAGATGGGATGGATTCTACCCCTAAAGTAAG | 17437 AGCCCTCACCCCATTTCTGGAT | 28421 GGAGGAGAGGAGAGATGGATGGATTC | 39405 |
| 5780 GCCTCTAGACTCACTGGTCCAA | 17438 CCCACTGCTAACACTGACATAGAA | 28422 TTCCCCAAGATGCCTCTAGACT | 39406 |
| 5781 CCGGACTTGATGTCAGATTCAAGCTA | 17439 GCAAGCTCAGAGGGCTTATTCAAG | 28423 TGGATTCAGCCGGACTTGATG | 39407 |
| 5782 GACTTCGCACAAGTTTTCCTTCAT | 17440 GGAAGGAAATGATAGAGAGAGGCATTG | 28424 CTCTCAGTGACTTCGCACAAGTT | 39408 |

FIG. 36I9

| | | | |
|---|---|---|---|
| 5783 | GCACAGAGGAAATGGGTATAGGACTTA | 17441 | GAGGGTAAGTGGCTCAGAGAGT | 28425 | GTCACGGCAGCACAGAGGAAA | 39409 |
| 5784 | GCCAGTGGGAACAATCTGGAGAA | 17442 | GCTTTCTATCAGGCTCCCAGTT | 28426 | AGTAGAGAGCCAGTGGGAACA | 39410 |
| 5785 | GGCTGGAGCATGTTCCTTCAATCT | 17443 | GGCTGGGCGTCTACCTTTTGAA | 28427 | ACGTGTTGGCTGGAGCATGT | 39411 |
| 5786 | CACCCAACTTTTGTTTGGAGAGCATT | 17444 | GCTCGGGTTAAAGTTTCACTGAATATG | 28428 | GGCAACATTTTCCAACACCCAACT | 39412 |
| 5787 | CTGTCCACCGTACAGGATCGTT | 17445 | CGGTCCTATCCATTAGAAGGGAGTCT | 28429 | ACTCGGGCGTGGAACTGT | 39413 |
| 5788 | GTGCTAGTGAGAGTGCTGGTTT | 17446 | GTGCTGAAAAGTCTGTGCCTAAG | 28430 | AGGGGTACCCATTCTGCATGT | 39414 |
| 5789 | CCTGGCCCAAGGTGAGAATGTAG | 17447 | GGTGTGCCCTGCTTGGATACT | 28431 | TCTCCAGCTGGGTGTCTCTATC | 39415 |
| 5790 | CTGGGGCTTTAGTCTTTTGCCATA | 17448 | CTGCATGCATACTTTAGGCACATATC | 28432 | AATTCCCTCATCTGGGGCTTAG | 39416 |
| 5791 | CCCAAACACCTACAGAAAAAGAATCGAACT | 17449 | AGGTAGGTTGAGGCCAGATTGT | 28433 | GAGGTCTCCCAAACACCTACAGA | 39417 |
| 5792 | AGCTGCTAGAGTGCCGATGT | 17450 | CCCATTCAGCCACACGCATTAC | 28434 | AGCACTCAATAAACTCAGCTGCTA | 39418 |
| 5793 | ACCATACCCCAGCAAAAGAAACA | 17451 | CAAGGTGGTTTAATCTTCACTGGATGT | 28435 | CAGTTAGGACCACAATCAAACCATAC | 39419 |
| 5794 | CTCGGCCCACTTAATTCTAGATGTTC | 17452 | TGGTAGGCATAGCGGCAGTT | 28436 | GTCCTCTCGGCCCACTTAATTC | 39420 |
| 5795 | GGGAATTTCTACTCCTCCTTCAGCAAA | 17453 | CACCCTGGGGATAGGAAGGTAA | 28437 | CCACTGGCTTCTGGGAATTTCTAC | 39421 |
| 5796 | TGGGGATTCCACAAACTTTGGTT | 17454 | TGCCTTCATCCTCCCTGTCTCT | 28438 | ACCAGATGGCATTGGGGATTC | 39422 |
| 5797 | ACACCATCTCCTGGAAGTAACAGT | 17455 | GGGGCATGTTGCCTCAGTTTC | 28439 | CCCCTGCTCCAAACACACCAT | 39423 |
| 5798 | GCCCTTTGCTGGCTGACACA | 17456 | CCATGATCTCCAAAAGACCTTGCTT | 28440 | TTTGTGGTTGCCGCCCTTTG | 39424 |
| 5799 | CTGCTTTTGTGGATTCAGGGTGACT | 17457 | TGAATGCCATTACCTCTCTGTGTT | 28441 | CAAGGATAACTTTCCACTCTGCTTTTG | 39425 |
| 5800 | GCCATCTGCCATATCTCAGAGAGTCAA | 17458 | GGACAGCAATTTCTGGGTTAAAGGAT | 28442 | CGGAGAGCCATCTGCCATATCT | 39426 |
| 5801 | AAGGGAATTCCTAGATGCCAAACTT | 17459 | GCTTCTGTACCAGGAGTGGCTTAC | 28443 | CGCCTCTTAAGCCAAGGGAAT | 39427 |
| 5802 | CGCCGAGTGATCTTAAAAGCAGACAA | 17460 | TTCCCCTCCAATCTCAAGGTTTAC | 28444 | CAAATCCCGCCGAGTGATCTTA | 39428 |
| 5803 | AGAATCCTGGGGTATGTTAGTGATTG | 17461 | GCAAGTAAAGGGCTCAGTGGCTAT | 28445 | TTTCCTAGATAGAATCCTGGGGTATGT | 39429 |
| 5804 | CGAGGCTAACCAAGGTCAGATAATA | 17462 | AGATCTAGGCCCTCTGGTTTCA | 28446 | AAGACACAACGAGGCTAACCAA | 39430 |
| 5805 | CCAGCTTGCATCAAGAGGACTGA | 17463 | TCCCTGAGCTTCCCCTCCAA | 28447 | GTGAAGCATTTCCAGCTTGCATCA | 39431 |
| 5806 | CCTGATGATGGCAGAGTCTGAAG | 17464 | CCCCAGATTTGTACCACAGAAATCA | 28448 | TTGACAGCGGCTTCCTGATG | 39432 |
| 5807 | CCATCCTCTACTTTAGGGTGACTTTAACA | 17465 | CCTGTAGGAGAAAAGCAGTCAGT | 28449 | GGATCAGGTTTGCCATCCTCTACT | 39433 |
| 5808 | GAACTGCTCTCTGGCTTCCTT | 17466 | CAGCTGAATGCATGAGGGTGACA | 28450 | GCTGCTTTTCAGAACTGCTCTCT | 39434 |
| 5809 | GAAGCAGTTCTGGTCTCAAGATGATA | 17467 | CTCTTTGTGAGCCAAGCTGCTAAA | 28451 | AGGGCACTCCAGAAGCAGTT | 39435 |
| 5810 | CGGCGAAGCACTAAAAATGCACTA | 17468 | CAGCAGGAGAAATCTTGCCTAACA | 28452 | GAGCATCGGCGAAGCACTA | 39436 |
| 5811 | CCTTAGCCTTAGATATTACGCTCCAGCATT | 17469 | GGTTATTGGCAATTGCTGTGGAT | 28453 | TCCCAGCTGCTCCTTAGCTT | 39437 |
| 5812 | CACAGAGTCCTGAAAAGCAGGAA | 17470 | CGGACTAATACACTCAGACAGACTTC | 28454 | TTGGCCAATGGAATCACAGAGT | 39438 |
| 5813 | GAGTCCAAGCAGATCATGTGTGT | 17471 | CCTGTTCCCTCTTGCAGTGCTT | 28455 | GGACAGCAAAGAGTCCAAGCAGAT | 39439 |
| 5814 | GCGAGAACGACCATTCAAAATCA | 17472 | CCCTGTAAGCACTCATCACACGTT | 28456 | TTCCCAGCGAGAACGACCAT | 39440 |
| 5815 | GCCTATGTCACTTCTCTCCCCTTGAAC | 17473 | CCCCAATACACAGACTCTCCATGTCA | 28457 | CAGACTTCAATTGCCTATGTCACTTCTCT | 39441 |
| 5816 | GGCCAGAAATGGTCTTGCAGCTT | 17474 | AGCTAAGCAGAGCTGGGGATTC | 28458 | TGGGACTGTGAGGCCAGAAATG | 39442 |
| 5817 | GCATTAGAGTTGCTACCGCTTTC | 17475 | CTGCTTACAAATTACTGGGCTAGTTGATCT | 28459 | TCTAAGTCCTGTCTTGCATTAGAGTTG | 39443 |
| 5818 | GGCAATAGGGCACTCACAAAC | 17476 | GCCTCCTTGTAAGGATGTTGGAA | 28460 | ACCGGGCACACCCATAGGCAATA | 39444 |
| 5819 | TGTCACTTGCCCACAAGGTT | 17477 | TGAGCTGAGTTTAGCTTGGTACAT | 28461 | CGTCACATTACACCTCCTGTCACT | 39445 |
| 5820 | CAGTGTGCTGGTTCTGGTTGAGT | 17478 | CAAGTGAAGACTTGGTTGCTGACA | 28462 | GTGGTGTCTACAGTGTGCTGGTT | 39446 |
| 5821 | GCAAACACAGCTTGTCTCAGGAT | 17479 | TCCTAACTGCACTGGTGTGATAAG | 28463 | CCACTCCTCATTAAAAGCAAACACAGCTT | 39447 |
| 5822 | GTGTGAAGTCAGTGTTCTAGGAAGTATTG | 17480 | GCTGCCTTGCAGGGTTTCTT | 28464 | CCTTTACTTGTGTGAAGTCAGTGTTC | 39448 |
| 5823 | ACAGGGACCTCTCTAAAACTCAGA | 17481 | CAGTACACTTAAACCCAGGCAAGAA | 28465 | GACCAGAACAGGGACCTCTCTA | 39449 |
| 5824 | GCCAGATCCTGCTTATAGTTTAGATGTTAC | 17482 | TGAGTCATTAGGCAAGGGCTCTA | 28466 | ACACCCGCAAAAGCCAGAT | 39450 |
| 5825 | CCCCAGGCTTCATGGTTCATCA | 17483 | GCACTGGGCAAGGCAGAA | 28467 | ACAGAGGCCCCAGGCTTCAT | 39451 |
| 5826 | GGTTCCCACCATGAGCCTTT | 17484 | GGCTTGACACACCTTTAATGACACT | 28468 | CCCACTCGGTTACAATTTGTTGGTT | 39452 |
| 5827 | GCCTTGCTCCAAGTGCTCCAATG | 17485 | TGCAGAGAGGAGGAGAGATGAA | 28469 | GGGGTCGATTTGGTAGCCTTAG | 39453 |
| 5828 | GCAGGTAGCGAATCTAAGACAAAAAG | 17486 | CAAAAAGGCACTGCACTTGGAA | 28470 | GACAAAGTTAGCAGGTAGCGAATC | 39454 |
| 5829 | GTCCCTTTGGGCCTAATTTTCCTT | 17487 | GGTAGGTATGAAGTCAGGGGAAAG | 28471 | AATGTGGAACCAATGTGCCCTTTG | 39455 |
| 5830 | CCCACAGCAACACTAACTCTTCAT | 17488 | GGGTAGCTCCAGAGGGCAAT | 28472 | CTGAGATTCCCACAGCAACACT | 39456 |
| 5831 | CCACCCAACACTGCACATCAAG | 17489 | CCATGACCCTGGGACCGTTT | 28473 | TCCCTTACCTCCACCCAACACT | 39457 |
| 5832 | CTTGCCTTCTTTGCCTGTCGAA | 17490 | GACAACATTCCCAAGTTCCCAAAC | 28474 | GCCAGCAGACTTGCCTTCTTTG | 39458 |
| 5833 | TGTGTCAGACAGATAAGCGTGTT | 17491 | GATTTCCACTGTGTTGCTCTGAAA | 28475 | CCTGTCACTGCTTGGCATGT | 39459 |
| 5834 | GGGCGGGACTAATAGAGCTTAC | 17492 | GGGATACTCAGTCTGCATTGCTT | 28476 | TGGTGGATGGGCGGGACTAAT | 39460 |
| 5835 | CGCGTTTTCCACCACGGTAA | 17493 | GGGCCTGGGCTGCTTTTCATAAG | 28477 | ACAGCCTACACGCGTTTC | 39461 |
| 5836 | CGACATTCCTTAACATTCCACAGTTG | 17494 | TGTGCGAGGGCTGGTACATA | 28478 | GGTGGAAAGCGTTGCGACATTC | 39462 |
| 5837 | GAACTGTCCATTACAGAGCTAGAAAAG | 17495 | CAGGAGAGGTTGGGATGCTTAG | 28479 | GGAAGCAGAACCTAGAACTGTCCAT | 39463 |
| 5838 | GTGTCTTACTTATCCCTCTGACCTCAT | 17496 | GCCTACAGCTTAGTGGGGAAAGA | 28480 | GGTTCTGAATGGGCTGTGTCTTACTTAT | 39464 |
| 5839 | ACCTAGAGAGAAAGTGGAGGAACT | 17497 | GAGAACAAACGGGTCTGAATGACA | 28481 | GTGCAGCTGAAGTAAAGTAACCTAGA | 39465 |
| 5840 | GAGAGCAACTCAGCTCGCATT | 17498 | GAGAACTGAACGGCCACACT | 28482 | CTCTGTTCGGTGAGAGCAACT | 39466 |
| 5841 | AGCGGTTGCCATGGACTAATAC | 17499 | CGGGCACTTGCTTCTCTGAGATTA | 28483 | GACATTTGGTGCAGCTGTGTT | 39467 |
| 5842 | CATCTGATTTGCAACCACTACCCTTT | 17500 | GGCTTTGCAGGAAATGGCATCTA | 28484 | CACTCCATCCTCTCCTTCCATCTGA | 39468 |
| 5843 | CAGTTGCCTCTTTCAGTCACTGTT | 17501 | AGGCTCAGCTAGAGAAAACCATTAG | 28485 | ACTGTAACTCAGTTGCCTCTTTCA | 39469 |
| 5844 | CCTGACAATGCAGCACACTCT | 17502 | GGCCTGCAGTAATGAAGGGTAAGCTA | 28486 | TCCACCCTCCAGCCTGACAAT | 39470 |
| 5845 | AGGGGACACAGTCCACAAAAC | 17503 | GGGGAACCCCTTGACTTGTAGTTG | 28487 | AGAGTGGGAGGGGACACA | 39471 |
| 5846 | CCTCCATTTCTGCCAAGCTCGTT | 17504 | GCTCACGAAGCTGCACGTA | 28488 | TGCCGTGAAACCTCCATTTCT | 39472 |
| 5847 | GCTAAGTCCCTAAGAGAAAAGCTTTGTGA | 17505 | CTTCTCACTCACCATGCCAGAT | 28489 | GGGAGAGACAGCTAAGTCCCTAAG | 39473 |

FIG. 36I10

| | | | |
|---|---|---|---|
| 5848 GTGTTCACTCCAGGGCCTCTTATC | 17506 TTCGCACTTCCTCTCGGAAAAT | 28490 ACACAGGGCTGCAGTGTTCA | 39474 |
| 5849 GCTGGCCCTGGGATTTACTTCACA | 17507 CAGATCTCATTTCTGGCACAGTTC | 28491 CTCATAAAGCTGGCCCTGGATT | 39475 |
| 5850 GCTCAGTTGTATGGTTTGGAACAAGA | 17508 GGCCATTAAGATGGCATGCTGATAC | 28492 CCCGAGGAGCTCAGTTGTATGGTT | 39476 |
| 5851 TTTCTCACATTGCCTGAGACAGATA | 17509 TCTCAGGATCACAATCCACCACTA | 28493 GACAACCCAGTAAAGTTGTTTCTCACATTG | 39477 |
| 5852 GGCCTATAACTGCCACTCAGTCA | 17510 CTGATGGTGAAAAGCCAGGTATAGTT | 28494 GTCCAGTGGGTGAATGGCCTATAA | 39478 |
| 5853 CTGCCTTTTGAAGCAACATGCTTTT | 17511 CAGGATACCAGGCTGCACTTCA | 28495 GCCTTGGATGAAGCTGCCTTT | 39479 |
| 5854 GTGGCTGCCATCAGAAGCTAAG | 17512 GCCAAGATCTGCGGGACCTTTT | 28496 AGGAACCAGTGGCTGCCATCA | 39480 |
| 5855 CTCTGCCGATCAACACATGATTTC | 17513 AGGCTTCCCACACCCTGAGTTA | 28497 GCTGGTAAGTCTCTGCCGATCAAC | 39481 |
| 5856 GGACATGTTACACCTGGGCCAAAT | 17514 AGACATGAGAGTGGCGCTTTG | 28498 TGGCTGAGGAGGGGACATGTTA | 39482 |
| 5857 GGGTACACCATGAACCAGGACCTT | 17515 CCCTCCAAATCCTGCCACACAA | 28499 GCAGGTGGGGTACACCATGAA | 39483 |
| 5858 GGCTGATTCCAGAGTCAGAACTTCA | 17516 GAGTCCATCCTTTGGGGTGTTTG | 28500 AACGCAGGTCTGGCTGATTC | 39484 |
| 5859 GGTGACAGCAATGTCAGGTGCTA | 17517 AAGTGCAACCTTGGAGAGTAACA | 28501 GCTGGTTGGGTGACAGCAA | 39485 |
| 5860 CCACCGTAGACCTATTGACTTCATTTC | 17518 GCAACTTGTCCAAGCATAGTTCACA | 28502 GAGTTTTCATACCACCGTAGACCAT | 39486 |
| 5861 GGATGGGGTCATTTAGGGACTTAAAAC | 17519 GTCCAAGATCAAGGCACCATTTTTGT | 28503 GTGGATCATGTTATAGGATGGGGTCAT | 39487 |
| 5862 ACATGTAGTTTCCAGAGGCAAAGAA | 17520 GTTTCTGGCTTCAGTGCTTGTT | 28504 TTGGCCAACTGTAACATGTAGTTTC | 39488 |
| 5863 GACTAAGGGGAGGCCATGAAAG | 17521 GCAGGGGATGAGGCTCTGT | 28505 AGGCCAGGGTGCTCTGTTGA | 39489 |
| 5864 TCCCTGGTTTCATGAGTGACAAG | 17522 CCGATTTGGCATCAGTTGAACCCTTA | 28506 GTAGACAGAGCATCCCTGGTTTC | 39490 |
| 5865 TCTTACTGATTCTTTGCCGTCAGTA | 17523 TTCCGCAACTGGAGAGATTTGA | 28507 GGGGCTTCCACAGCTTCTTT | 39491 |
| 5866 GCGATGCCTTCTGCCTGAGTA | 17524 CTGGGCTGGGTGGAATAA | 28508 TGGCTCGCGATGCCTTCT | 39492 |
| 5867 AGGGGAAAGCCACAGAAAATGT | 17525 AGCATTTCCTCGTGCTATGTTAGT | 28509 CTTGCAGCTACATCAAGGGGAAA | 39493 |
| 5868 CAGCTTGTGTCAGCTTCTAGCCATA | 17526 GGGGCTCAGGAACTTTTAAGTGACA | 28510 GGTTTCTAGCCCCAGCTTGTGT | 39494 |
| 5869 AGAAACTCCAGCTGTCTTGACTTC | 17527 AGTGTGACAGCGCATTCTATGA | 28511 CTTGCCTCCTTGCTCAAGAAAC | 39495 |
| 5870 GTCTCTGGGAACCAAGTCCATATC | 17528 TCTGAGTCATGTACCCTTATCTAGCTT | 28512 AGTGAGAGTCTCTGGGAACCAA | 39496 |
| 5871 AGTCAGTCCCGGATCTCTGAA | 17529 CACAAGGAGCCACATTTGATGTACT | 28513 CTGTACCCAGCTCAAAGTCAGT | 39497 |
| 5872 CGCTTAGTCAATCCTCACCCATTC | 17530 GGACGTATCTTCCACCGTGCTT | 28514 CCCTTCCACTTCCTCGCTTAGT | 39498 |
| 5873 GCCCCTCTTATAGCAAGCCGTAAATC | 17531 GCAACTGCCTCAACCAGCAT | 28515 CCAAGATACACCTTGCCCCTCTT | 39499 |
| 5874 GGTCAATCTGGCAAACAGGGTGAT | 17532 TGGGGCCTGGAATTCTCTTGT | 28516 GCACCCTGGAACTTGGTCAATC | 39500 |
| 5875 GCTCGTGTTCTGTCAGTGACTTAT | 17533 GGGAGCCAAACTCAAATTCTACTAAGA | 28517 GAGAAATATCTTAAGGCTCGTGTTCTGTCA | 39501 |
| 5876 CCCAAGCAAGGAGGATGATTACTGT | 17534 GGCTCTTTGGAGTCCATTCTTCTCT | 28518 CTTTCTCCCAAGCAAGGAGGAT | 39502 |
| 5877 CACCCCAAAGTGCAAAGGATTC | 17535 TCCCAGGAAAGTTCATGGTTTACA | 28519 CACCCAATGTTCACCCCAAAGT | 39503 |
| 5878 GAGTACACAGTCATGGGCTAGAGT | 17536 GCAGGCACAGCCTTTTACATTG | 28520 TGTATAGACCTGGAGTACACAGTCA | 39504 |
| 5879 GAGAAGGCTTTTCAAGCAGAAGATT | 17537 CTCATGTCATTTCACTCCCACACT | 28521 GCAGCTAGGCAAGAGGATGAGAAG | 39505 |
| 5880 CCCTTTAGGTTGCTGGACTCATTTG | 17538 GGAAGCATGGTCCTTCCTAGTGGAT | 28522 GCATAAACCCAGGTCCCTTTAGGTT | 39506 |
| 5881 GTTCTTTCTCTGTCTTCCAGACCAA | 17539 GGATAAGGAGGCCCAAGTCCTAGA | 28523 CCACAGCAGCCACTGTTCTTTC | 39507 |
| 5882 CCGCAATTATCATAGCAGTTCCCATCT | 17540 ACGTGATTTCATCTGCGTCTTACA | 28524 TCGTCTCTATGGGCCGCAAT | 39508 |
| 5883 GAGATGCATGGATTGGACTACAGGAA | 17541 TGGGAATAGCAGGGAAGCAGAT | 28525 CTGCAAGCATGCACTCATAGAGA | 39509 |
| 5884 GGACACACTCCCTACACATTTGA | 17542 TGGTGCTGGCTTGCCATTCT | 28526 GGGGATACTTGGTAGGACACACT | 39510 |
| 5885 GCACAATAGAACAAGCTAAGCCTACA | 17543 TCTTAGGCTTTCCACACCTCAATG | 28527 GGATAGCAAATACACTGCAGCACAA | 39511 |
| 5886 CCTTACTGTCCCGAGAAGCAATC | 17544 CGTGGAGTCACCCCAAGACT | 28528 CCCTTTTGAGGTGTCCTTACTGT | 39512 |
| 5887 CAGAGCCATGGAACCACAGACA | 17545 GTCCCCAAGCTCCCTGTTGTTA | 28529 CACATGGAACAGAGCCATGGAA | 39513 |
| 5888 GCACGTTTATGCATGACATCTCTGT | 17546 CTGCTCCCTTCCTGAGTTCATC | 28530 GGGAAAGGTACAGCACGTTTATG | 39514 |
| 5889 CCTCTGTTGGAACCACTCCACTCTAC | 17547 CATATTGTCAGCGGCTACTTTGT | 28531 CTGACCACACAACCTCTGTTGGAA | 39515 |
| 5890 CCCTCACATGAATAGCCTACACTCT | 17548 GGGACTCAGTAGTTTTGGAGCCCTTA | 28532 GTGGAACGTGTCTAATTCCCTCACA | 39516 |
| 5891 GGAACGCTGTCAGTCGAGAATTT | 17549 GCAGTCAATACTCTGGGGTGAA | 28533 GCTGAGATAGCAAGCGTCAGT | 39517 |
| 5892 CAGAGACTTGATGAGACTCAGGTTTG | 17550 AATAGAGTGGCACCCATACTCTTG | 28534 TGACAGCAGTATCCAGAGACTTGA | 39518 |
| 5893 GGCGGATTAGTGGCTGTCTACATTATTC | 17551 TCCAGATGGGGACACCCTACT | 28535 ACAGGATGAACAAGGCGGATT | 39519 |
| 5894 GCAAGTCAACAGAGCCGTTCATC | 17552 CCGATGTCACCTAATTTCAGAGGCAAA | 28536 GACATGAAGGTAAGAGCAAGTCAAC | 39520 |
| 5895 GCATCAGCTTCTGAGTTGCCTTT | 17553 CCACTCCCACCATCACCTTGT | 28537 GACATTACCTAATCAGAGCATCAGCTTCT | 39521 |
| 5896 GACTTGTCATTGCTCCCTTCTTC | 17554 GCCAGGTGCCTACCTAAAAGCTA | 28538 GGGAAGGTGGCAAAGACTTGT | 39522 |
| 5897 CCAGTTGTGGATGTGGCATTG | 17555 GAGCACTTCCCTCTTCCCATCA | 28539 CCACTGGGTCCAGTTGTGGAT | 39523 |
| 5898 GCAGACGTCTCGGCTGTGT | 17556 CCTGCAAAGCAGGTCACCAT | 28540 AAGTTGTCTGTCCACTTCCCTAAG | 39524 |
| 5899 GTGGGTCTAACTGGCTTGATCTT | 17557 CAGGGAACCTTAATGTAGCAATACAGA | 28541 GGAAGTTTTGCAGTAGTGGGTCTAAC | 39525 |
| 5900 AGACCACTGAGCAATGACACAAAT | 17558 CTGAGTGTCTCAGGTGGATGCTT | 28542 GGCTGCATTACAGACCACTGA | 39526 |
| 5901 ACTCCAGAGTGTATTTGGTTCACTT | 17559 AGCACAGCCTGGCACACA | 28543 GGGACTTGTCTACTCCAGAGTGT | 39527 |
| 5902 GGCTCTCAGGAGACTTTATGGTCAGA | 17560 CAGCCCTGGTGAAAAGGAACATTAG | 28544 GTGAACATGGCTCTCAGGAGACTTT | 39528 |
| 5903 TGGGGCTTAGGGCAAGTTTAAT | 17561 GGAGGCTCTCTGCCTGCTA | 28545 TGTCTCCCAGTTTGGGGCTTA | 39529 |
| 5904 CCACACCTGGTTCCTAGCTCTATTG | 17562 GTGTCCAGTGTGCTTTACACTTCA | 28546 TGCCACCACACCTGGTTCCTA | 39530 |
| 5905 ATGCTGGGAATATGACTTGTGACT | 17563 GTGTGCTGAACATTGTACTTGCTCATGTTA | 28547 ACGAACCCATGCTGGGAATATG | 39531 |
| 5906 GAGGAAAGGTTCATTCCCTCTTCA | 17564 GACCTTAAATGCCCTGGACTTCT | 28548 GCAGGGAGAAGAGGAAAGGTTCA | 39532 |
| 5907 CCAGAACGCTAAAGTAGGCAGAA | 17565 CTGGTTGTATTGCAGTCAAACACTCAA | 28549 CAGCCAATGTTCCAGAACGCTAA | 39533 |
| 5908 CCCCTCTACTGGAAGAGCTAAGTTG | 17566 TGCTGGTGCACCCAAGCATT | 28550 TCCCTCACCCCTCTACTGGAA | 39534 |
| 5909 TCCGCAAAAACCCCTGTGT | 17567 AATGACACCACCACCCACTAAAT | 28551 GGGATGTCAGGGAACAAAAGCAATC | 39535 |
| 5910 TGCTAAGAGGGGAGTCTGTTCT | 17568 TCACAGCTGCTTCATATGCTTGA | 28552 CAGTGGGTGGGAGATGCTAAGA | 39536 |
| 5911 ACAACACACTAGGTCTCCACAGA | 17569 GGTATGGAACTATGGAGCTTGGTT | 28553 CCAGATGCCCACTTGATAACAACACA | 39537 |
| 5912 CCCTCTGGACCTCAGTCTCATCTTT | 17570 GAACATACAAGGCGCAGGCAAT | 28554 AGCCCCTCTGGACCTCAGT | 39538 |

FIG. 36J1

| | | | |
|---|---|---|---|
| 5913 AGGGGAAAGACCTGCCTTGT | 17571 TCACCTGCTTTCCCTCTTGAAAAA | 28555 ACAACCCCTGTGGGCTCCAA | 39539 |
| 5914 TGGATACCTCTGAGAAGCTGATGAT | 17572 CCAGTTTCATGTGTTTGCCTGCTTT | 28556 TTCTGTAAGGGGCACATGGATAC | 39540 |
| 5915 CAGGACTGGAAGTGAGGGTATTC | 17573 CCAGTCCTAACCTCTGGCTCTCT | 28557 GGGGCCATCAGGACTGGAA | 39541 |
| 5916 GGGGCGTGTCAAGGTATTAGTTG | 17574 GTTCACAGAAATGGCTTGCCTTTAG | 28558 ACCTCTGTGGGGCCTGTCAA | 39542 |
| 5917 CCAGTAGGTCACAGCAGAAGAAAA | 17575 CAGGATGACACTGGAGTTAGCTT | 28559 CCTTTACATTTCTCCAGTAGGTCACA | 39543 |
| 5918 GTGGGTATGTCACCTTAGGCAAGA | 17576 GGGTCCCCAGTCAGACCATCT | 28560 CCTCAAAGTCTAGCAATCAGTGGGTAT | 39544 |
| 5919 ACATGCCCGATGCCAGGTA | 17577 AGAGGAAACATTCAACTGGAAGTGA | 28561 AGCTACGAGCTGAGGATCACA | 39545 |
| 5920 GCTACAATTAGGCACTGGATCTGGTT | 17578 GCCTGAAGGTTCTTTCGTCACTTC | 28562 GTGTGTTTGCTGTGAGGCTACAA | 39546 |
| 5921 CCTTACCATCAGTTCAGTAGAAGCATAGAT | 17579 GGCACCTGTATCATGTTACTGCTCTT | 28563 CCCTGTCTTTTAAAACCTTACCATCAGTTC | 39547 |
| 5922 GGCGGGAGGAAATGTGGAATG | 17580 CCTCCAGAAAACGAGAAGCAATGAT | 28564 TGTGAGGAAGGCGGGAGGAAA | 39548 |
| 5923 GAGCCCTAGTTTAAAAATGTCCCTGTAAG | 17581 GTGGAGCTCACTGCTTTAATTGTGA | 28565 CCCATACAACTCCGAGCCCTAGTTT | 39549 |
| 5924 CTGAGCCCAGAAGACTTATTTTCCAGTTT | 17582 GGAGGCTGTCCCTGTGGTTTC | 28566 GCCTCCAAAGGCAAAGACTGA | 39550 |
| 5925 GGGTCTTCATATTAGGCTGTGAGATAGTGT | 17583 CGCTTGGTTCATACAAAACCAACT | 28567 GAAGTCTTGCAAAAAGGGTCTTCAT | 39551 |
| 5926 GGCTTAAACCTCCGTTTCTTGTTC | 17584 CACGTCCCACTAGGGGTTAAGTTC | 28568 CACCTTTGCACCGAGGCTTA | 39552 |
| 5927 CTGAAAGCCTGGATCTTTCATGGGATAG | 17585 GTGTGTTCAAGACAGCAAGGAAAG | 28569 GCTGCCTGAAAGCCTGGATCTT | 39553 |
| 5928 CCGTGCAGGTTGATATGGTTCCTT | 17586 CCCAGTTAACTCCTAGAGCCAAAC | 28570 GCACACCGTGCAGGTTGATA | 39554 |
| 5929 CCAGCCAGAAGTGTTAGTGAGAAG | 17587 GGCAACATCCCTCACAGCTTTCTT | 28571 CAGCAACCAGCCAGAAGTGT | 39555 |
| 5930 CGGCATTTGGTTGAGCACAAAG | 17588 GCGTGGGATCTTGTTTGCCTTGA | 28572 GCCTGAGAGTCGGCATTTGGTT | 39556 |
| 5931 GCAGAACCTATGGCAGCTAAAAC | 17589 GCAGTTGGAAATCGAGCAGTAAAG | 28573 TTTGCCATCTTTGCAGAACCTATG | 39557 |
| 5932 GGATCAGAGAGAACCAGACTCACTT | 17590 TCTCAGGAGCCGGTTTGTTATG | 28574 GGCAAAAGGTGAAAGGATCAGAGA | 39558 |
| 5933 CTGAGTTATGTACAGGGCAGAGATG | 17591 TGAGTGTGTTTGTAAGTGCAGGAT | 28575 GCTGGGACCGAAACTGAGTTATGT | 39559 |
| 5934 AGGAGGGCACCTGTAGATTAAAAC | 17592 TGCCCACACATTCAGCTGTT | 28576 TGTGAAAGGAGGGCACCTGTA | 39560 |
| 5935 GGCAAAAACATTATCATTGAGCCTGGATTC | 17593 ACACCAGTGAGGAGGCCATA | 28577 GGCTGGGAGTGGCAAAAACA | 39561 |
| 5936 ACTGTAGACTCCATCCACCATTACA | 17594 GGTCTGAGATGTTTACTTGGTTTCCCAAA | 28578 CCAGAGGGTCTGAGTTCTACTGT | 39562 |
| 5937 TTGTTGGGTTGATGGCTGTCT | 17595 AACTGCCGGGACTGTACCAT | 28579 GAGCCTTCAAGTTGTTGGGTTGA | 39563 |
| 5938 GGTGTGGCTTGGTTTCTTTTTGAAG | 17596 GGAGACCAAATGCCTTTCCTCCTT | 28580 GAAAGTTTTGGTGTGGCTTGGTT | 39564 |
| 5939 CCATGGGCTAAGAACCAGGTGAAAG | 17597 GAGTGAGCACAGACAAAGCAAGT | 28581 CGAGCCAACCATGGGCTAAGAA | 39565 |
| 5940 AAAACTGCTGCTGTAACCTGAATC | 17598 TCTGGGGCTGTCGGGTGTCT | 28582 GGCAGTGAAAACTGCTGCTGTA | 39566 |
| 5941 CCCCAGCAATCTAACTCACCCAGAA | 17599 GGGTGCATTGCATTGTCTCTTC | 28583 GGGGTCCCCAGCAATCTAACT | 39567 |
| 5942 GAGCCGTGTAAGAAGGAAGGATCT | 17600 TGTGTTCTCTCTACCTAGCACAAATG | 28584 CCTCTCTGTGTGAGCCGTGTAAG | 39568 |
| 5943 GTGGGGCTTAACAGCCAGTAGA | 17601 CCCCAGCTGCCAGCCTTTATTT | 28585 GACAGACCTTGTGGGCTTAAC | 39569 |
| 5944 GGAACCAGAGATCCCAGTTAGCTT | 17602 CTGTTTCCTGCCGAGGTTCAACT | 28586 AGGAATGGACTGGAACCAGAGA | 39570 |
| 5945 CAGTAAGATGTGTGCCTTTGGATCT | 17603 AGCCCACCAAACCCCTAAGA | 28587 GGCATGGTTTCATCTGGTCAGT | 39571 |
| 5946 TGTGTCTGTTGTCCCTAGGTTGA | 17604 GCCTGAGTGACCTGTGCAT | 28588 GGCCAAGGACTGGTATGTGTCT | 39572 |
| 5947 CCTCCTGCCACTAGGCTTTGAAC | 17605 GGGAAGGGTTACAAATATGTCTACAGAAG | 28589 CCATGCTTCCTCCTGCCACTA | 39573 |
| 5948 GGCTGACAAGATGTAAAAAGCTCAAC | 17606 GGGCTAGTAAGACAGATTCAGGAGAAG | 28590 GGGTCTCGGCTGACAAGATGTA | 39574 |
| 5949 GCAAGGGAGTCTGACCTACATGA | 17607 CCCTAAACTGTTTTCCCACTCTACT | 28591 GGAGAGTACAGCAAGGGAGTCTGA | 39575 |
| 5950 GGTTCCTTCTTACCTTGGAGTGAA | 17608 AAGTCCCATTGCATGATAGTTGAGA | 28592 TACCCCTGCTCCCTCTGGTT | 39576 |
| 5951 CAGCCTGCTTAAGATGGTGAGA | 17609 GCTCCACTGCACCTGGTTAGTT | 28593 GTAGTTTGAGACCAGCCTGCTT | 39577 |
| 5952 CTCCAACATCAACTCCTACAATTCTCTTC | 17610 GTGAAACTGGCATGTCCAGAGA | 28594 TGACTCTGGCCTATTCTCCAACA | 39578 |
| 5953 CCCACCAGCTACACAAGGAGATTC | 17611 TGAGCAGTTTCAAAGTCGTGTCA | 28595 CCAAGATTTCCCACCAGCTACACA | 39579 |
| 5954 CAGCAGCTCTTTCCCCTCTTTC | 17612 GGAAGCATCCCAAGCTTCTTGA | 28596 GGTGGTTTTCTCTCAGCAGCTCTT | 39580 |
| 5955 GCAGAAAATCAAAACTGGCTACCAA | 17613 CCCTCCTTCATCAGCCAGAATC | 28597 CACCAACGACAGAGCCAGAAATC | 39581 |
| 5956 CAGCTAAAAGAGGCTGGGAAAGAA | 17614 GGAGGGAAAAGATTCAGCTGTGTT | 28598 CAGCATCCTCCAAGGTTTCAGCTA | 39582 |
| 5957 GGAAACAGGGAATGAGGGTAGAAG | 17615 CTGAAAACCATCGTGCACAAAATTC | 28599 GCTCCTATGGGAAACAGGGAATG | 39583 |
| 5958 GCTAAATGGCAAGTGAATCCCTAGA | 17616 CTGCCTTGCTCTGCATCTCT | 28600 CCAACCAGAAGCTAAATGGCAAGT | 39584 |
| 5959 GGGGAAGAGTGCACTTATCTGTGTTT | 17617 CTTCCAGAAAGTAGGCACAGTTTG | 28601 CCCAAACACACTGGGGAAGAGT | 39585 |
| 5960 GGGTGAAGCTGGGAATATCATAAGT | 17618 CTGTTGATCCCCTTTGCACATCT | 28602 GGGATTAAGATGGGTGAAGCTGGGAAT | 39586 |
| 5961 CCCGTCTTGTGGGTAAACTGTCAT | 17619 CACTGGAAACCATGCCATGCATAA | 28603 ACCACTGAGTCCCGTCTTG | 39587 |
| 5962 CAACATGGAGAGACACTGTTCCTA | 17620 CCCTGTAGTTGAAGCTGCCATAACTT | 28604 CCAGATTTACCAACATGGAGAGACA | 39588 |
| 5963 CCAGTTGTGTGGTCTCAGGGACATAA | 17621 CCTCTCCTCATTTTGCTAGAGAAGGTA | 28605 ATCCCTGCCACCAGTTGTGT | 39589 |
| 5964 GGGGAACTTGAACTACCAGCGAAAG | 17622 CTGCAACTGCTTTTCTCCACAACTAC | 28606 GTTCCTCAAGGGGAACTTGAACTAC | 39590 |
| 5965 CATCAGCCATATGTATGACGACTGT | 17623 CTCTTTTGCACAAGCCTTTCCTTTG | 28607 GGAAGGTCACAAGACATCAGCCATA | 39591 |
| 5966 CTGTCCACTTCATCTCCTTTCTGTT | 17624 CCAGATCGGTAATACCTGGAAATGGTA | 28608 GTCCTCCAAATCTGTCCACTTCATCT | 39592 |
| 5967 GGATGGGACCAGATATGCCTGAGA | 17625 CAAGCACTTGTGGCTGTCTGA | 28609 GCAGACCAGGATGGGACCAGATA | 39593 |
| 5968 ACTGCCCTTGTGACTGAAAACA | 17626 GGACGGAACAACACACTGGGATT | 28610 GATTATGCTGAAACTGCCCTTGT | 39594 |
| 5969 GGACTGTCTCCTCTCTGGATGTAG | 17627 CGTGCACACGACTTTTTGGAA | 28611 ACCAGTGTGTCCCTGGACTGT | 39595 |
| 5970 TCTCTTCTTTCCACCAAAGTGACA | 17628 AGTGAGCAGGACCTTGCAAAT | 28612 CAACAATGGGCTAACCTTTCTCTTC | 39596 |
| 5971 CTGCTCCTTCCTTTGGGTCTGA | 17629 GAGCTGTGGGAATTCCATCTCTCA | 28613 TGGCTCCTCTGCTCCTTCCTT | 39597 |
| 5972 AGGGGAGGAGTGAGCAAGAAGT | 17630 GCCCCTTGCATGGTGTGGTTA | 28614 TGGGGTTTAGGGGAGGAGTGA | 39598 |
| 5973 GTCCAAACAGAGCCCTGGAAAA | 17631 GATGCAGGGATGTTTAACTCCAATC | 28615 GCATATACGGTAAACCTTAGTCCAAAC | 39599 |
| 5974 CCCTCAATCCCCTTCCTGCTT | 17632 GGGTTCTGTAATCAGGGCCATACA | 28616 CACACAGGCTTTCCCCTCAATC | 39600 |
| 5975 CCCCTGAACCAAATTCTGAGATACT | 17633 GGGTTTTGGGGTTCACCACATT | 28617 GCTGCTTCTTCCCCTGAACCAA | 39601 |
| 5976 CCCAATGAAGAAGATGCCAGTCA | 17634 GCAGCTGCCAAGCAGATGTT | 28618 CAGTGTTTTCAATACCACCCAATGAAG | 39602 |
| 5977 CGTGCTTTGTGAGAATGGTGGAA | 17635 CACATTAACCTTCCACTGGTGCCATTA | 28619 GTGGCTTTGTTCTGACGTGCTT | 39603 |

FIG. 36J2

| | | | |
|---|---|---|---|
| 5978 AGGGTATCACACAGTGGAGACAT | 17636 CAATTTTGGGTGGAGTTAGAGAGAACA | 28620 GAGCATTAGTGTTAGAGGGTATCACACA | 39604 |
| 5979 GTCGGGGAAAGTGAAAAGAAGTTG | 17637 TCCTGTGACCCTATTATCTCCCATT | 28621 GTGTAGGAGTCGGGGAAAGTGA | 39605 |
| 5980 GGCTCCAATAAAACCCCAACAGT | 17638 CAAGGTCTGCTCTCAGAAGAAACT | 28622 CCCAGGTAGGTTAGGCTCCAAT | 39606 |
| 5981 ATGGTGAAAGCTGACCCTTGAA | 17639 CTGTCTGCATTTGGCTCCTTGT | 28623 GCCAAATCCTCTGGAATATGGTGAA | 39607 |
| 5982 GCTGTTTGTCTTGCCCACTTCCTA | 17640 GGTGAGTTGGAAGCACATGTGGAA | 28624 CGTGCAAGAACTAGCTGTTTGTCT | 39608 |
| 5983 TGTATCGTAGTTCCCCATTGTTCAT | 17641 GGGCTGGGCATTAGGTAGCATT | 28625 GGGAGACAGCATGTATCGTAGTTC | 39609 |
| 5984 GGCCATTCAGGCCAGTCATACA | 17642 CCATCAAGAGGTACAGGGGTCTTC | 28626 TCCCACCTGCCTTTTTCAACT | 39610 |
| 5985 CCTCTTCTAGATACAAGCCCCAATCA | 17643 GGCCCTTTGGGTTCAGAGCTT | 28627 CTGGCACTGTTTACCTCTTCTAGATAC | 39611 |
| 5986 AAGTGGGTGTCTGGTCTCTCT | 17644 CAGCCTCTTCCCCTTTACCTTTG | 28628 CCCAGGCAAAGTGGGTGTCT | 39612 |
| 5987 GCAAGGGGTGAAGATACTCACTGT | 17645 AGTACCTGCCAATGTCTATCAGTCT | 28629 GGCCAGCAAGGGGTGAAGAT | 39613 |
| 5988 GGGGTGAGAAGGGAGTATGTAGTAG | 17646 AATCACCTGTGGCACTTGTTTAAG | 28630 TGAATCCAAATCTTGGGGTGAGAAG | 39614 |
| 5989 TCTCAATCTTCCAGCTTCTCATTGT | 17647 GCTAATAGCTGGCATCTAGGGGAAA | 28631 CTCCATGTGTTTGCTCTCAATCTTC | 39615 |
| 5990 CCAACCCCAAAGCCAGTTCAGT | 17648 GCAGATGCATCCTCAGAGCATTAC | 28632 TCTACCCGTCCAACCCCAAA | 39616 |
| 5991 CTGCATTCTGTCTCAAGGAAGAAATAG | 17649 AACTCTGATGGAGTGATTTGCCTTA | 28633 CCTCATTTATCAACTGCATTCTGTCTCAAG | 39617 |
| 5992 AGTGGGTACTTGGATACTCCATCA | 17650 GCTGCTGATCACAACAGAATGAAAAC | 28634 CCTACTTCTCTCCCTTAGTGGGTACT | 39618 |
| 5993 GCCACTGTTTCTGGTCCAATGAAG | 17651 GCTCTTTGGACTCTGCCATTTC | 28635 CAGGTGTGAGCCACTGTTTCT | 39619 |
| 5994 GTCAGTAGTTCCTCTGAAGGGATTATTTGT | 17652 ACTGTGGTTTTTACTGGAGGAAAGT | 28636 CCCCACATGTGAGTCAGTAGTTC | 39620 |
| 5995 TGAGTGAAAGATGGCACTGATCTAC | 17653 GGGGACTGAGGGGACTTACTTCAAC | 28637 TGCATAAGGCCACTTTGAGTGA | 39621 |
| 5996 CCACCTAAGCAGTCCTGCATGT | 17654 CAAGGATGCTGAAGCTCCAGGTTCA | 28638 GCCCAGTTTTCTCATACCACCTAAG | 39622 |
| 5997 TTCTGTGGGGCTCAGTTTTGT | 17655 GGCAGAAAGAAAACCCTTCGAGATG | 28639 GCTGTCCAGCTTTCCACATTCTGT | 39623 |
| 5998 GCAAAGCTAGGCAAATGTCTAATGGATTG | 17656 AGCAGTGAGCAGCCTCCTT | 28640 GGCCTGAGTGGATGCAAAGCTA | 39624 |
| 5999 GCACCGTGAGTCTACCAGAAAC | 17657 GCCACAAAGCCAAGTGCAAAG | 28641 TTCCCTAGCACCGTGAGTCT | 39625 |
| 6000 TGAACATGGGGTCATCACACTTG | 17658 GAAGCCCTGCAGCTTTCTGT | 28642 GCCTTGGCCTGTGATGAACA | 39626 |
| 6001 CTTCAAGGCAGTATTCTCGGCAAGT | 17659 CCTTCAGCCCAAGAGAAGAATTTATCA | 28643 GGTTCTGGGCATAGAGACTTCAA | 39627 |
| 6002 GCAACTAGCTAACTGGCCACAA | 17660 GCTGTGTGGGGTACAGTAGACACT | 28644 CCCAGGAACCAAGGTTTTGCAACT | 39628 |
| 6003 CAACTCCAATCAGGGTGGTCTCT | 17661 GACTTGGACTAGAGACATGGAATCTT | 28645 GCCCTCCCTCAACTCCAATCA | 39629 |
| 6004 CCACTGTAATCACCAACCACGTT | 17662 GGGGATGGTTCAGTAATACCTACTCTGT | 28646 CCAGAGCTGCCACTGTAATCA | 39630 |
| 6005 GCTTCTTAAGCACATTCTGGCAAAC | 17663 CACACTGATGAGACCCAGAGT | 28647 GTGAGGTTTGCTTCTTAAGCACATT | 39631 |
| 6006 CAGTAGGTAAAAGAAGGGATTTGTGGATAG | 17664 CCAAGTAACTGCTGCAAGAAAACACA | 28648 CTGGCTCAGTAGGTAAAAGAAGGGATT | 39632 |
| 6007 GCTTTTGCAGTGTTGGTGCTAAAA | 17665 GGATCTCATAAAACGTAACTCCTCTGACA | 28649 ACACAGAAGCTTTTGCAGTGTTG | 39633 |
| 6008 GGGAGTTGATCTGTGTGGACAA | 17666 GCACCATATTTAGAGGGTATCGATTTCTGA | 28650 GCTCTGTGTCCTGGGAGTTGAT | 39634 |
| 6009 CCCAGGCAGTTCTGAGGTACA | 17667 CAGTGCATCTAGCTATCAAGTCCCAAA | 28651 AGCAAGAACCCCAGGCAGTT | 39635 |
| 6010 GCAATGTCTAAGCCTCAGTGGTT | 17668 CAAGAGAGGAAAAGCTCTACTGGAA | 28652 GATGTCTGCTGTTGGGCAATG | 39636 |
| 6011 ACCACAACTGGCTTGATTTCCTT | 17669 CCATGCCTGGCCTAGAAAATGTTA | 28653 GGTGTGCGCTACCAACT | 39637 |
| 6012 AGAAACTGTAGAAGGAGGAGAGTCA | 17670 ACCTGCTGGGAACAGGATGA | 28654 GTGGGTCTCTTTGGGAGCATAAG | 39638 |
| 6013 GGGTGTGATTCTGACCTCCCTAAG | 17671 GACTGCGTCAATCCTCCTCCTATC | 28655 GGCAGCTCAATGGGTGTGATTC | 39639 |
| 6014 GGAGTGTCTTATAGGGGCAAGAAG | 17672 TCCTACTTGGGCTACTGCAAAG | 28656 GGCAGGTTACAAGGAGTGTCTT | 39640 |
| 6015 CCACCAGTAAGCAGAGAAATACAGTCT | 17673 AGCCTCCACCCTTGTCCAT | 28657 TGCCCACCAGTAAGCAGAGA | 39641 |
| 6016 GCCTCTCTTCCCTGATTCTTCCTTTC | 17674 GCTGGTAGGTCACTGTGCATGT | 28658 GGGTTGCCTCTCTTCCCTGAT | 39642 |
| 6017 AGCATCAGACACTCGGTGTTAC | 17675 GGAAATCACCTCGCTAGGAACTTG | 28659 TCCAGGACCAGCATCAGACACT | 39643 |
| 6018 GTCCCTTCCTCCATCATGAACTGT | 17676 GGCCATCCCTAACCTTGACCTATG | 28660 TGTGCTGTCCCTTCCTCCAT | 39644 |
| 6019 GGAGTTTGTGTTAGAAGCAGGTAAGA | 17677 CAAAGTTTGTGCAAAGAGGGAAGA | 28661 GGATGAACTGAGTTGAAAGGAGTTTGTGT | 39645 |
| 6020 GTGGATGCTTTTGAAGGTTTGGTTT | 17678 CGCTCCAGTCAATGGCAATGT | 28662 GGGAGAGCTGTGTGGATGCTT | 39646 |
| 6021 CACAGAGTTCTCATCCTCAGTGTTAG | 17679 ACCAAAAGGTCCTTGAATGTAGTGA | 28663 TCTCCCATTTGCCACAGAGTTC | 39647 |
| 6022 CTGCATGATGCGTATTGGAGTGGTT | 17680 CTGCATGACTGGAAGAGCAAAC | 28664 CCACAGGAACTGCATGATGCGTA | 39648 |
| 6023 GCTCAGAATCCAAACACCATAGCTTTC | 17681 GGTCCTGCACACTGGCAATA | 28665 CAGCTGGTTCTGCTCAGAATCCAAAC | 39649 |
| 6024 CTGACTGCCTAACTGGGTCTCA | 17682 GAAACCACACAAAGCAAGAGGAATC | 28666 GTCTGCTGACTGACTGCCTAAC | 39650 |
| 6025 GGGGCTGACTTACCAGTGACTCTA | 17683 GGAGGTGAGACTCAGAGACATACA | 28667 AATGGAGACGGGGCTGACTTAC | 39651 |
| 6026 GCCAGGGACTAAAGTCAAAAGCCTTA | 17684 GCCAGCCACAGTGTAACAGA | 28668 CTTTCCAGGAGCCAGGGACTAA | 39652 |
| 6027 GGGAGCCAGGATTTGGAACTCT | 17685 ACTTCCTTTACCTGATCCCTCTCA | 28669 AGTAACGGGGAGCCAGGATT | 39653 |
| 6028 TAATACCGCCCGCAGCCTCTT | 17686 GGCGCGCAAACTTGAGTTACTT | 28670 CCAAGTCGCTGCAAACGCTAA | 39654 |
| 6029 CCCAGGCAACTTTCTGGACTGT | 17687 GAGAAACCCTGAGTTAGAGGAGATGAAAA | 28671 GTGAAAAGCACCCAGGCAACT | 39655 |
| 6030 CATTTTGATGCATACCACCCTTGT | 17688 TGAAACCCTTACACCTGAGTTCTTG | 28672 CTGGGTGGTTCCAACATTTTGATG | 39656 |
| 6031 CGAGGTGCTAAGGGAAGACAAT | 17689 GGCAGGTCATTGAAGGAAATGAATGT | 28673 CTTGCCAACAGGAGTGCTGTAAG | 39657 |
| 6032 CCCATCCCAGAATTGAGAGAATAAGGTGTA | 17690 CCACAGCACCTTCCTTGTGTAT | 28674 CATGATCCCATCCCAGAATTGAGA | 39658 |
| 6033 GCCCATGCCTATACAGTGCTTTC | 17691 CTACAGCCGGTTTCTCTGAACA | 28675 CCTGTTTTGGCCCATGCCTAT | 39659 |
| 6034 GCCCACAAACCACACATCTTTCATC | 17692 CGGACAGGGGAGACCTCAGT | 28676 CCAGCCCACAAACCACACA | 39660 |
| 6035 GAAACCCAGTGAACATGAAGGAAGA | 17693 TCTCTGTGCTTCATGCTGTGTAAA | 28677 GCTGAGTAGAAACCCAGTGAACA | 39661 |
| 6036 CGAGTTCCATGGTTTTGTTCCAATC | 17694 CCCAGTGCACAGCCATATCCAT | 28678 ACCTTCATCGAGTTCCATGGTTT | 39662 |
| 6037 CAGTTGCCTTTGTGGTAAGACATAC | 17695 CCAAGCCTCAGCAATGGTGGAT | 28679 CTGCAAACAGTTGCCTTTGTGGTT | 39663 |
| 6038 CCGATTCCTTTGCAGTGTGACTTG | 17696 GACTAAGCCTGTATCTACCACCACTT | 28680 AGCAGCCACCGATTCCTTTG | 39664 |
| 6039 GTTGCCTGTTTGGGAGATCAT | 17697 CCAGTCTCCCTGCTCCAAACCTA | 28681 GTCGGACAGAGTTGCCTGTTTG | 39665 |
| 6040 TGCCATTAGTCATGCTGTCACT | 17698 GGCCCATGAAAACACAGCCAAT | 28682 CCTCACCAGGAAAGTGCCATTA | 39666 |
| 6041 CTGCAGGTGAACAGACAAAAATCATGT | 17699 CAGCCTTTCTTCAGCTCCTCCAA | 28683 GGAACTCTGCAGGTGAACAGACAA | 39667 |
| 6042 GGGAGGAGCTGACACAGTTCTCTA | 17700 AGATTCCCATTGCCTTTCTTGGAT | 28684 GCATGGGGAGGAGCTGACA | 39668 |

FIG. 36J3

| | | | |
|---|---|---|---|
| 6043 AAACGCTTCCTCCTTCAAGTATCA | 17701 CAGACACAGTCACCCACGAAGAT | 28685 GTGTATGGTAAACGCTTCCTCCTT | 39669 |
| 6044 CCACTGTCACCTTCACACAAGT | 17702 GGCTTCCACCAGCTTAGCCAAA | 28686 GGAAGACCTACACCACTGTCACCTT | 39670 |
| 6045 CAGAGCACTTCTATAAGATGGAGGCAAAAA | 17703 GTTTTTGCAGAGACACCCAGTTTTC | 28687 GGTCAGAAAGGCAGAGCACTT | 39671 |
| 6046 CTGGGGCCTCTTCAAGCACTAA | 17704 CGTGGTGTGGACAATGGGTATG | 28688 AGATAATCCCTGGGGCCTCTTC | 39672 |
| 6047 ACTGGATGGATTCCCAATGAACTT | 17705 GAGGTAGAAGACCCAGGAACAAG | 28689 ATCTACCAAGTGTACTGGATGGATTC | 39673 |
| 6048 GGGCAGCTCAAACTAAGCAGTGTAG | 17706 AGGCAGCCTAGCCCTAAAGT | 28690 GGACAAAGATGGGCAGCTCAAAC | 39674 |
| 6049 CCTCACTCCTAACAGCTGCTCTTTCA | 17707 GAGTCAGCCTATGCAGCTATTGAATC | 28691 GTCTCTCTGCCTCACTCCTAACA | 39675 |
| 6050 GTCCAAGCCCAATCACTAGTTCCTT | 17708 GCTCAGGCAGTGTTTTGTTGGAT | 28692 CCTAGTGGTCCAAGCCCAATCA | 39676 |
| 6051 ACGGAAGCATCTCCGACTCCTT | 17709 TGAACACCACTGTGAGGACTTC | 28693 GCTGTTTTTAGATGGGAACGGAAGCAT | 39677 |
| 6052 GCTCTGCTTCCAGTAGGGCTTAT | 17710 TGTTTTTCAAGGCTACAGGGTTTCT | 28694 ACCACGATCAGGCTCTGCTT | 39678 |
| 6053 GCAAGCACTGGCATTCAACAATGTGTTTC | 17711 ACTGTAGCTAATCTAGCTCTGTCTCTT | 28695 AGGCAAGCACTGGCATTCAACA | 39679 |
| 6054 CTAACATAGGAAACTGCCAGGAGAT | 17712 CAGAGACCTTCCTTCCTGGAGTAG | 28696 CCCTCCTGGGCTCTGAAACTAAC | 39680 |
| 6055 GGTGTGGACAGAGAAGGGTGAAAA | 17713 GGGGCTGTTAGAGATTGGTGAAC | 28697 AACCTGGGGTGTGGACAGAGA | 39681 |
| 6056 TGTCAGATGTTTCTTGGTTAGGACATC | 17714 GGGCAGAGATGGCACCTGTT | 28698 CACCAGAGTGCATTGTCAGATGT | 39682 |
| 6057 GGAACCAAAGCCTTCATAACATCTTC | 17715 GGGGCAATTGTGAAACAGTGGAT | 28699 TGGTTAGGAACCAAAGCCTTCAT | 39683 |
| 6058 GCTTAGGGGTAGTGCAGGAATAAG | 17716 CACAGGCTTCAGGTGAAAAGAAG | 28700 CACATGTGTGCTTAGGGGTAGT | 39684 |
| 6059 TTTTGGAACTGCACACCTGTTG | 17717 GGGGACAAACTTTCCTAGTCAGCTT | 28701 GCCCCTCCAGACTTTTGGAACT | 39685 |
| 6060 TCCTCCTCCATTTACAGTGACATTTAG | 17718 CCCCATGTTCCATAGGGCAAAC | 28702 GGTTACATTTCCTCCTCCATTTACAGT | 39686 |
| 6061 CCAGGAAACCCAATGACACCTTGT | 17719 GATGTTCCTCTTCTGTAGGGTGAAAG | 28703 CTTGCATTCCAGGAAACCCAATG | 39687 |
| 6062 CAAGAATAAGGACAGGCTGGTGAAC | 17720 GTACCAATGTGCAGGTATGAGTACA | 28704 GGAAGCCTCGCCACAAGAATAAG | 39688 |
| 6063 CCCCACCTTGGATTTGCCTCTAAC | 17721 CTGGCAGAGGGACTTCTGCATT | 28705 AGGCTCCCCACCTTGGATTT | 39689 |
| 6064 TGGGAGTGGAATATACAGGAACATCA | 17722 GGAGCGGCTCATCTCCCAAAT | 28706 GGCCCAGAACATTGGGAGTGGAATA | 39690 |
| 6065 ACACTGATACTGAGAGAGAGGTCATA | 17723 GCAGAGCTGCCTAAGAGAAGAAA | 28707 GGAAGCAACACTGATACTGAGAGA | 39691 |
| 6066 GCTGAAATTCTACATGGGGTTCCTAGGTT | 17724 GGGAGTGGTCCACATATTGTCCTT | 28708 GCAGCTGCGAATAAAGCTGAA | 39692 |
| 6067 TGCTGCTTCAGCTGGGGTAATG | 17725 GCCCTTAAAACCTCCATCCCAGTTC | 28709 TTGCTGGAGTGCTGCTTCA | 39693 |
| 6068 GCCCACTGGAAACACACCATGT | 17726 ACCCAAGTCCATCTGCACAAAG | 28710 AGTCACAGCCCACTGGAAAC | 39694 |
| 6069 CTGTTTCTGCCATGGATACTGGTAATTG | 17727 TCCTGGGACTTAAAAGCTTGACTT | 28711 CAGAGCTGTTTCTGCCATGGAT | 39695 |
| 6070 CACGTGTCTTCATGTAGAGCTGCTT | 17728 CTGTCGATAACCCATTCCTGGTT | 28712 TGCAAGTTCACGTGTCTTCATGT | 39696 |
| 6071 CCTGTTTGTACAGGAACTGTGTGT | 17729 TGTCCCCTAAGGCCATCTGT | 28713 GGTTCCCGGAGTTCCTGTTTGT | 39697 |
| 6072 CCAGCCTGCATCGTCCTTACT | 17730 TCATCCCCTGTCCTGTGTGT | 28714 TCCCTCACCAGCCTGCAT | 39698 |
| 6073 CCCACATTTATTAAACCGTGTGCTTCT | 17731 GAGTGAAGGACTGAGTTAAGTGGAAGA | 28715 TCACACCTTCTGAAACCCACATT | 39699 |
| 6074 CTGTAGCTTAAAAGTAGGGGAGTCCTAGA | 17732 GGCACAGCACTAGTTCACCTT | 28716 CCGAGGACTTAGAACTGTAGCTTAAAAGTAG | 39700 |
| 6075 CAGAGATAGCCCTCTTACAGATCAAG | 17733 CCCGGCTTTGTCAGAGTAGAGACA | 28717 GGACACTACAGAGATAGCCCTCTT | 39701 |
| 6076 GCTCTACAGGCATGGTGACAAG | 17734 TTTCTCTGGCCCTGTTACTTTGA | 28718 TGACTTGTCTTCTGCAAAGCTCTA | 39702 |
| 6077 GCACTGCAATATCATCATCCTAGCTT | 17735 CCAAGTCCTGCCTCTTGCTT | 28719 GAGAGTGGCACTGCAATATCATCA | 39703 |
| 6078 CGCACATGGACCATCACACA | 17736 GAGGGTCAGCACCAACCCATAA | 28720 AGGGCCTTGCACGCACAT | 39704 |
| 6079 GACAAAAGGCCAATTGCAGGAA | 17737 GCCAGTGCCTTTTGCCTTCT | 28721 CTGGACGAAGGAAGCCATGTTAG | 39705 |
| 6080 TTGGGTAATACCAGGACTCCCATA | 17738 CAGGGGCAGAAGATGGAAGACT | 28722 GGTGTCTTGCCTTGTTTGGGTAA | 39706 |
| 6081 TGCCTAAAACCAGTCATGGACTTC | 17739 GCCAGAAATAGGATATACTGTCCCCTAAA | 28723 CCTTGAACCTTGTCATGCCTAAAAC | 39707 |
| 6082 CCACACGTCAAGCACTTTCTAACTTTT | 17740 CCCCATGAGGACTGTTACCTACT | 28724 TGTACCACACGTCAAGCACTTT | 39708 |
| 6083 GATGCATGGCAGAACCCTAAAC | 17741 CCTTGACTTTGCCATGACCTTTC | 28725 TCAAAGCTGCCTGGGAGATG | 39709 |
| 6084 CGGGCTGGATGAAGAGAAGGTACA | 17742 TCTCTGTCTCTCTCCCATCAATTCT | 28726 GGAACCGGGCTGGATGAAGA | 39710 |
| 6085 CTCAAGTGAAACTGCCTTTTGGAT | 17743 GGGCCGGTAATCACAGTCTGTTC | 28727 CCTGCATCACCAAGTCCATTCTCA | 39711 |
| 6086 GCCAAAGAACCTACTCCTCATGATGTTTT | 17744 CTGTACCTCCACCTCCTCATACT | 28728 TCATGGTTGCCAAAGAACCTACT | 39712 |
| 6087 GGCTATGGCACAGACAGTAGGTT | 17745 TGAGAGGAGAGTAGAGTTGCAGTTAAT | 28729 CACCATGCCTATGGCACAGA | 39713 |
| 6088 CGCCCACAAAGACGATTCGAT | 17746 GGTAGGTGGTACGGGACAGGTT | 28730 CACAATTATCCCTATTATCGCCCACAAAGA | 39714 |
| 6089 CTTCTCTCCCAGGTAAGGCTAACT | 17747 GAGAAAGGGATACTGGAGGAATGATTGAAG | 28731 GCTGGTTCACTTCTCTCCCAGGTA | 39715 |
| 6090 TCCCTTGTTTGTCCTCCAACTTAAA | 17748 GGAATTTGAGGCAGCCAAGATTCAA | 28732 GAAAGAGGCTCATTTCCCTTGTTTG | 39716 |
| 6091 GGGTGACAGAGTCTTAAACATCCACATT | 17749 GGCCTAGGTTGCCTTCAACA | 28733 GAGTCTGGGGTGACAGAGTCTTA | 39717 |
| 6092 CCTTGCCAGTTTCCCCATATTTTC | 17750 GAAGGGATCACCCGCATTTACT | 28734 CCTCCAGTGAATTTACCTTGCCAGTTTC | 39718 |
| 6093 GGAGTAATCAAGTGCCATTGGGTTTTC | 17751 GCCTTATCCTCTTTGTCTCTTGCTTGTT | 28735 GATGGCTGGTGGAGTAATCAAGT | 39719 |
| 6094 CGCCCCTTTACCCTTTTCTCT | 17752 GCCTATAGACACCAACTCTGACTTT | 28736 TTCTGGCTACACGCCCCTTTAC | 39720 |
| 6095 CCATGGCCACATTCTGGGTCTAA | 17753 GCCATCCTCTGGATCTCAGAAGTAATGTT | 28737 TGCTGTCCATGGCCACATTC | 39721 |
| 6096 AGGTTTGGGTAGGTTCTTCTTTAG | 17754 TGGGTGATGAGAAACTGAGCTTTG | 28738 CATCAGAAAATAGGTTTGGGGTAGGTT | 39722 |
| 6097 CCCAGAAGTCCCCAGAGACAA | 17755 GTGCACAGTGAGGAGAGTCTGT | 28739 AGGAACCTGAGGCCCAGAAGT | 39723 |
| 6098 ACTTCCCTCCAAGTTAAAGTGTGAA | 17756 CAGGATAGGCTGAGGCATGATTG | 28740 GCTAAACACAAACTTCCCTCCAAGT | 39724 |
| 6099 CTGGTTTGGGGTTGCTCCTTTAGT | 17757 TGGAAGCCCAGCTGTCTAA | 28741 TCAGTTGCCTGGCTGGTTTG | 39725 |
| 6100 GCTGTTGGTGTTGTTGCCTCTTA | 17758 CAGCTCAAAGGTTCTGAAGCTCATTC | 28742 AATCAGGAGCTGTTGGTGTTGT | 39726 |
| 6101 AAGCTCTGCCACCCTGTAGT | 17759 GTTGGGACTACCCAAATAGGAACTT | 28743 CCACCTGGAAGCCAAGTTGA | 39727 |
| 6102 CCCTGTCCTAAGCCACTCTTTTC | 17760 GCCAGGGGCCTTTACTCACTTT | 28744 TCCAAACCCTCCCTGTCCTAAG | 39728 |
| 6103 TGGATGGATATTTGTTGGCTGTCA | 17761 GGGCTTTAACACACGGAAGCAGAA | 28745 TGGACATGGCAAATTGGATGGAT | 39729 |
| 6104 CTGTGCAAGGTTAGAGGCAAAAG | 17762 TTCCGTTTCTCCCCTCTGTCT | 28746 GCCTGTCTTTTCTGTGCAAGGTTAG | 39730 |
| 6105 GAGGCCATCAGCTTTTCTCTCTTTG | 17763 GCCGTTTTAACATCCTTCGGGTTA | 28747 GTCAGGAGAGGCCATCAGCTTT | 39731 |
| 6106 TGCCCTGGCATACCTCTCTCATAG | 17764 GCATTGCCCAGTCCCACTGAT | 28748 TCCCACAGTGCCCTGGCATA | 39732 |
| 6107 CGACAACAACATTGCGAGGTCTCT | 17765 CGGAGGAGGTGTTAGGAGCTACA | 28749 CTTGGATCAACTTTCCCGACAAC | 39733 |

FIG. 36J4

| | | | |
|---|---|---|---|
| 6108 GACACCAGTAACTGAGACAATGCTA | 17766 GCCACCTGTGTAGAAGGTAGAAC | 28750 TGGACCGTAATGACACCAGTAAC | 39734 |
| 6109 GTCCTGGACACTGATGTTTTGTGA | 17767 GGGGAGCTGAGGGAGGTTAGAAT | 28751 CCACCAGTCCTGGACACTGAT | 39735 |
| 6110 AGGAGGAGGATAGCCTTATTTCTTCT | 17768 CAGAATCAAACCTGCGTGTGACAA | 28752 GGTGAGCTTAAATTAGGAGGAGGATAG | 39736 |
| 6111 CTTCAGGCCACAGAGTAAAACCTT | 17769 AGCTGGAGTGCTTCCCAATG | 28753 GTTGACCTTCAGGCCACAGA | 39737 |
| 6112 GGGGTGCTGTTAATATCCTCCGTTT | 17770 GCTCAGGCTTTCACCTTGGTT | 28754 ACCCTGTGATGGGGTGCTGTT | 39738 |
| 6113 GGACAAGCGACACTGGAGATAAG | 17771 GTCACACATCTGTGTCTCAACCTT | 28755 AGCCAAGGACAAGCGACACT | 39739 |
| 6114 TTGACTAACACGTCACGACACT | 17772 CCTCAGGCTGTCTTGCTAGGAT | 28756 CCTGAATGGCATTGGGCTTGACT | 39740 |
| 6115 TCATGGGGTAAGAGAGGTTCTCA | 17773 CCCATGGGTTGATGCAATCTGT | 28757 GGGTTCAGCATTCATGGGGTAAG | 39741 |
| 6116 AGGGCTTTTGGTGCCACGAT | 17774 CTGCAGGACTCTAGCAGACGATA | 28758 CAAGCTGGGATAGAGGGCTTTTG | 39742 |
| 6117 GCTCTTCCTGCTGTTTATCCCAGAGA | 17775 CCTGTGTACAGGCTACTGTGTGA | 28759 GCAGGTGCTCTTCCTGCTGTT | 39743 |
| 6118 TTTCACTCGCAATCCCACAGA | 17776 GCCCTGACACTTGGAAAGTTGTT | 28760 GAATGGGCAAAGCACTGGTAATTTT | 39744 |
| 6119 CTGCCAATCCATCAGTCCTTCT | 17777 CCAAGTACAAGTGCAGCAGTTTTGT | 28761 GCTTGAGGGTCTGCCAATCCAT | 39745 |
| 6120 GGGGAGAAGAAGTTGAGTTCTAGATGCTT | 17778 GCGCTGACACTGACACAGACT | 28762 GGGCCCTTACTTGGGGAGAAGAAGT | 39746 |
| 6121 GGATGCATTGCACTAAGCATGT | 17779 AGAGGCACATTTGACCCTCTTTAC | 28763 AGGTGGCAGAGGATGCATTG | 39747 |
| 6122 CAGCCTTGCAGAGGCTAGTCTTTCT | 17780 GGTAGGCAAACTCGTAGTGAAATAAG | 28764 TTCTGCCTCACCCCAGCTT | 39748 |
| 6123 CGAGGTACTGTGGGTCTGGAAA | 17781 TGAGTCAACATCGCACCAGTT | 28765 TCCCCTTCACTCGAGGTACTGT | 39749 |
| 6124 CTGTATGGGCTCTGTGCAGGAT | 17782 GAGGCTACTATTCAGAAACTGGAGAA | 28766 CCAACCATGCAGTGATGCTGTA | 39750 |
| 6125 CCCTGTAAGCAAGAACAATGCCTTCAT | 17783 AACTCCTCACTCAGGGCACAAG | 28767 CCCCTGCAACTATCATCCCTGTAAG | 39751 |
| 6126 GAGTCTCTCACAAATGGTGGTCTCA | 17784 TGCTCTAGGAGAAATTGCCAGGTA | 28768 GCCTGCTTGGAGTCTCTCACAAAT | 39752 |
| 6127 GCCACCATGCCCTTATTCTGTTTG | 17785 GGCAGGTAAAGTAACTGGGAGCA | 28769 ACGAGCCACCATGCCCTTA | 39753 |
| 6128 CTGTCTGGCCTAAAATGTTTACTTGGCTAT | 17786 CCCCTGTGGTAAAGGGACTTAGA | 28770 CTCCATCCTGTCTGGCCTAAAATG | 39754 |
| 6129 GGAACAACAGTCCTGAGTGCAGAT | 17787 CAAGTGTGGCCTACTGATCCAT | 28771 CTTCTCTTCACTCAACAGAGGAACAA | 39755 |
| 6130 CGTTAGCATGTATAAGAGCAGTCTTC | 17788 AGACTTCCTAAAGTGGAGGAGTTGA | 28772 GTGGTTGGACCGTTAGCATGT | 39756 |
| 6131 GTTGATGACACCTCAACTGTGACTT | 17789 TTTTCCTTGGCTTGGCTGACT | 28773 GGGAAGGCTTCTGGAGTTGATG | 39757 |
| 6132 CCATCCAGATCTTAGGAGAAACAAGA | 17790 GCTGGGAGTGGAAAGGAAATCA | 28774 TGGAGCCCCATCCAGATCTTAG | 39758 |
| 6133 GGCACATCTCAATAGCCCCAGACA | 17791 CAGGCCCTTAGGCTTCCTGATT | 28775 GCTTTGCCAGGCACATCTCAA | 39759 |
| 6134 GGAGGGCCATCAACAATGTGAA | 17792 CTGCAGGACAACTTGCCTTCT | 28776 AGATGGGGAGGGCCATCAA | 39760 |
| 6135 AGGGCCCTTCCTTGTGGAGAA | 17793 GCCCATATCCGACATTGAAGCAT | 28777 CAGGCTTGGCATTGTGACTTG | 39761 |
| 6136 CTCAGGCCCTTGTAGTCCAGTT | 17794 GGGCTTCTCACCACAGTTAGAATAAAA | 28778 GCCAAGTAACTCAGGCCCTTGT | 39762 |
| 6137 GCCAGGCACATGATGGCATT | 17795 TCTCCTCCCACACTCTCTGTTG | 28779 CCTTGGGAGCCAGGCACAT | 39763 |
| 6138 CCCTTTCACGACACTGGCATCT | 17796 GCGTAGAATATGTACCCAGGGCTATAC | 28780 TACCCCACTGTGCCCCTTTCA | 39764 |
| 6139 GGCTTGGCAGTTTCAGCTATGTGT | 17797 GAGGTAAAAGCAGGCACCAGTGT | 28781 GGAATCATGGCTTGGCAGTTTCA | 39765 |
| 6140 ACAGGTACTTAGAGCACTCCCTTA | 17798 ACAGGAAGGACAGGGTGTCTCA | 28782 GCCCAGGCAGATCTACAGGTACT | 39766 |
| 6141 GGGGAGTGAATGGGTGTAGAAG | 17799 TCAGCCCCTGCAGGATAGTAAC | 28783 GCTTGGTTCCATGGGGAGTGAA | 39767 |
| 6142 GGTTCCCTGAGAATTCCATTGAAGATA | 17800 GCTTTGACATCACTAAAACGATCCTGAGTT | 28784 CTCAGAGTCTGGTTCCCTGAGA | 39768 |
| 6143 CAGCCCTGGATAAGGCAAGAGA | 17801 GTCCCAATTCTGCAACTAACTCTGT | 28785 CAGACAAGGAAACAGCCCTGGAT | 39769 |
| 6144 GGCTAGAAGTTCCTTCAAGGCAGATA | 17802 GCCACTGGGGCCACAAACAT | 28786 CCCTCCCTGCCTAGAAGTTCCTT | 39770 |
| 6145 GGTAACGATTACAGCTGCCAACTA | 17803 CTAAACTAAGGCTGACTGAGACAA | 28787 GCTGTTTTCAAGGCTAAAGGTAACGAT | 39771 |
| 6146 CCTTGGGTTGCTTCTCCCTGAA | 17804 CACATTTGAGATGGTAAGGGTATAGA | 28788 CACCTGTACCTTGGGTTGCTT | 39772 |
| 6147 GGTAGCATAATCCCCGCCTTATC | 17805 TGCAATTCTCTGGAAAGGCAGTA | 28789 CCAGATCTAGAACCCTGGTAGCAT | 39773 |
| 6148 AGGAATGGGATGGGAGAAGGAT | 17806 TGCAAAAGTCCTGTGAAGGTACA | 28790 ACTCCACAGGTGCCATCCTA | 39774 |
| 6149 CTGCCTTGTCTTTGCTCTCACTCT | 17807 TGTTGCATGTGTGGGTGTGA | 28791 CCTTCCAACCACTTTCTGCCTTGT | 39775 |
| 6150 GGGCTGGACTAAAAGGTAAACAGT | 17808 CATCTAAGGCTGTAAGGACCTTGT | 28792 GGCAAAAGCAAATAGGGCTGGACTA | 39776 |
| 6151 CCTGCAGCTGATACAGTAGATGGCTAA | 17809 CCTTCGAAGTACGGGAATAGTTAAACA | 28793 TCCTCTTCCTGCCAGCTGATACA | 39777 |
| 6152 GCCTGTCTTAGGGAATTGTGTTGGTT | 17810 AAGCAGTTATGTATGCCTGGAACT | 28794 GGTCATTCTGCCTGTCTTAGGGAAT | 39778 |
| 6153 GGCCACGGTTTACCAGGAACA | 17811 CCTGGAAACTGGTGCTTCGACATC | 28795 TTTGGGTGGGCCACGGTTTA | 39779 |
| 6154 CTCCCAACACACAAACCCATCTA | 17812 TGTGAGGGAATGAACTTGAGGAAATC | 28796 CTGAAGAGCCTCCCAACACACA | 39780 |
| 6155 CTCATCATGGGTGATTTCCTTGTGGAT | 17813 CCAGTGGGGAAAAACTCAGAATTCAA | 28797 CCGACTTGCTCATCATGGGTGATT | 39781 |
| 6156 GCACAGTCAATATGGGCAGGAA | 17814 CTCAGTGAACTACACACCCTTGT | 28798 ACACGGCCAAGCACAGTCAA | 39782 |
| 6157 GCCATTTCCACTGATCCCTTGTTG | 17815 TGCCCTCAGAGTGGGATCGTT | 28799 CCCAGCAGCCATTTCCACTGAT | 39783 |
| 6158 CAGCACCTGGATCCAAGACACTT | 17816 GGGAGAGAGGATGAGATGTGAGGAA | 28800 GCCAGGCAAACCTTGTCATC | 39784 |
| 6159 GACGAAGCAGAACCCACTCAT | 17817 TGGAATCATGTTCATGGGGTTCA | 28801 GGGACATTCTCTGGTTATTGACGAA | 39785 |
| 6160 CCTGTGAGACACAACTATCCAACA | 17818 GAGGTGCTAAATGGATGGTTGAGAGA | 28802 CCTAGCTCCTGTGAGACACAAC | 39786 |
| 6161 AGGCAGTGCAGAATCGAGACTA | 17819 TGGAAAAAGCCAAAGGTGTTTTGATG | 28803 GGCTTCAGAGGCAGTGCAGA | 39787 |
| 6162 GAGGGTGAGGAAAACGCTGTGA | 17820 GGAGGCTCCCATGAGCCTAGAAA | 28804 AGTGTGAGCAGGGTGAGGAA | 39788 |
| 6163 TGACCCCTTGGGCATCTTGA | 17821 TGTCCCACGTCAGGTCAACT | 28805 GAGGGCAGACCAGGGATGA | 39789 |
| 6164 CCCTTAGCTTCCCATTGTTGTGT | 17822 CTGATGGTGTCAAATGGGCTATTTTCTTC | 28806 ATTTGCATCACCTCCCTTAGCTT | 39790 |
| 6165 CACAAGAAGGCTTTCCCAGTATCAAC | 17823 CAAGGGAAGCTGTGTCTTAGACTTAC | 28807 CGGATAAAGGCTACGAACACAAGAA | 39791 |
| 6166 CCTGCTGTTAGTTTTCCACCACAA | 17824 GAGAAAAGGCATCTCCAAATGTGCTAA | 28808 GGATACTCTGACCTGCTGTTAGTTT | 39792 |
| 6167 GGGCTTTGGAAGACACTGCAA | 17825 GCTGAAATAGGACTCTAGGCAGTT | 28809 GCTAAGTGCGAGGGCTTTGGAA | 39793 |
| 6168 AGTGCTGTGCTACCTAATTGCTTT | 17826 CTGCTGCCTCTGAAACAGAAAGTTG | 28810 CAGCAAAACCAAAGTGCTGTGCTA | 39794 |
| 6169 GTGCCGATCTAATCGCAAGTGA | 17827 CCTGCTGCTTCCTGCTGTTA | 28811 AGGCCTGAGTGCCGATCAA | 39795 |
| 6170 GGATTTTGGTGCCTTTTCCCACTA | 17828 GGCAGATGCTCAGAGGCATTAACA | 28812 CTCCCTCTTGGCTACTTTTGGAT | 39796 |
| 6171 CCAGCAGCAACAGCACACATTTT | 17829 GAGAGCATGAATGTGTCATCTGTGT | 28813 CACCCTCTTACCAGCAGCAACA | 39797 |
| 6172 GTGGCAACATACAAACAGCACTAA | 17830 GGGCTATGAATTTAGCTCTGCATTTG | 28814 ACTACATCCTTCAGTGGCAACATAC | 39798 |

FIG. 36J5

| | | | |
|---|---|---|---|
| 6173 GCTGTCATCAGACCCAAGCCAAA | 17831 GGATGCTGGGAGCAATCAGTTC | 28815 CAGAGAACAGGCTCAGCTGTCA | 39799 |
| 6174 TGGCAAGAGCTGACATTTACCAA | 17832 CTCATCCATTGATTCCGTTCAGTAAAG | 28816 GATGGAGAGAGTGATTGGCAAGA | 39800 |
| 6175 CCACCTATACTGAACTTAGGGGAAGA | 17833 CTGGTTTGTAAATTTCTGAAGGCAGTGGTT | 28817 GACTGATTCTGCCACCTATACTGAAC | 39801 |
| 6176 ACCAGGAACCTTCTTGGGCATA | 17834 CTGCTCAGATGCCATAAATGTTTGAGA | 28818 CCTGGACCTTTCTTAATACCAGGAACCTT | 39802 |
| 6177 CACCATGCAGGGGTTTATTACTGA | 17835 CTGCAGCATGGCTTTCCATTTC | 28819 CTCATTGTCCACAGATTGATCACCAT | 39803 |
| 6178 GTTAGCGTTTTGGGGAGGTAGT | 17836 CTGATCTTACAAGTATTGCTTTCCCTGACT | 28820 GAAAGGAGAGATAGGTTAGCGTTTTG | 39804 |
| 6179 CCTTGCTTGAAATTTCCCGTATAGATG | 17837 AAGGGCCGATCCGGAAACTT | 28821 GGGTGTCATTTTCCTTGCTTGAA | 39805 |
| 6180 CAGGCCAGAGTTAATCAGATTTGGAA | 17838 CAGCAGTTGCAAAAGCACATTC | 28822 CAGGGTAACAGGCCAGAGTTAATCA | 39806 |
| 6181 GGGCTGGAAGAGGCTGCAAA | 17839 AAGCTGGTGGTGGTCACTGT | 28823 AGAACCCATGGGCTGGAAGA | 39807 |
| 6182 GGTTCCTGTGTGTAGCTGATCATTC | 17840 GCCAGTTTGTAACAGCGGCTTTG | 28824 GCTGTGAGCAAGGTTCCTGTGT | 39808 |
| 6183 GCCTCAAGTGCAGGAAAAGACA | 17841 GCTTGTATGTTGCTCTTTCCGTATG | 28825 CTGCAGTATTCACAGAGCCTCAAGT | 39809 |
| 6184 GTGCCTGCTAGTACATCTGGTGTTAG | 17842 GCATGGGCATTTGGAATCAAAAGAT | 28826 AGAACTGTGCCTGCTAGTACATC | 39810 |
| 6185 GGTGCCACTGACTCCAAGGAAA | 17843 AGTAAGTAGAGGAGTAATGGAGTGTGA | 28827 TTCCCAAGGTGCCACTGACT | 39811 |
| 6186 TCTTCTTCTGCAACTCTGTTCCAA | 17844 ACTGTTGAGGGAATGGTTCTTTTCT | 28828 CAAGGGCTTTTGGCTCTTCTTC | 39812 |
| 6187 GATGGTGCCTTGTTGCTGAATC | 17845 CCACTTGTGAGGACACAGCATTC | 28829 CTGTCTCGAAGATGGTGCCTTGT | 39813 |
| 6188 CTCTCTGCTTGTGAGTGGTGACA | 17846 GAGAACCAGAGCCTGTGTCTTCATAG | 28830 CCTCAGTGTGCTCTCTGCTTGT | 39814 |
| 6189 CCCCACACCAAGTATTTTGCTCTT | 17847 TGGACTGGGAAAAGAAGACACTAGA | 28831 CCTCAAACTACCCCACACCAAGT | 39815 |
| 6190 GGATAGGTCAGTTAATTGGGATTCAGA | 17848 GGAGGACAACTTGTGTTTGTGGAAT | 28832 GAGCTGGACTTGGATAGGTCAGTT | 39816 |
| 6191 TTGCAGGAGCCCCTTCCAAT | 17849 GGGAGCCTTGTGACCAGAAAT | 28833 AGCTAGTTTGCTCCTACGTCTTG | 39817 |
| 6192 GGGTGCCAGTTCTGCTGCAT | 17850 GCCTAGAGTTGCAACCTTACGAAT | 28834 GTGCCTTGGGTGCCAGT | 39818 |
| 6193 GTGAGAAGGGGTCTAGTATTTAGGGAAAAA | 17851 CTGTCTACCCAAGGATCTACCCAAA | 28835 CAAGAGGTGAGAAGGGGTCTAGT | 39819 |
| 6194 CACCAAGCTCATTCTCTGCCAAT | 17852 GGCGTGCTACACATGTCCACAA | 28836 AGTCCATGTATCACCAAGCTCATTC | 39820 |
| 6195 GGTGGCCAAGTGCAGAAGAACA | 17853 CTTGGTTCTGTCATCCTCAGACTTC | 28837 ACAAGGTGGGTGGCCAAGT | 39821 |
| 6196 CCTGAACAAATTTCAGTGGCAGACAA | 17854 GGAGCTCAATCAAGGACCACAGT | 28838 GGCCTTGGACCCTGAACAAA | 39822 |
| 6197 CCCTTTCCTTTCTTCTGCTCCAAGT | 17855 GCAATGAGATCACGCTCTTGTTT | 28839 CCCTCCTAATGTCTCCCTTTCCTTTC | 39823 |
| 6198 GAGATAGCAAGTACAAACCACACGTA | 17856 CAGCAGCACGTGAAGTCAAC | 28840 GGTCACTGACTTTGAGATAGCAAGTA | 39824 |
| 6199 TTGACACGCAACCCCACACA | 17857 CTGGAGCTGCATCCATACCCATAC | 28841 CCAGAAGCTCCAGTGTTTGACA | 39825 |
| 6200 GCTCCTTTTCCTCAGCACATAAACATA | 17858 CTGGAGAAGGGTCCTTTAAAGTGCAA | 28842 GCTGCTCCTCTATTAGCTCCTTTT | 39826 |
| 6201 CGGCATGAGCGAAGAGGATCT | 17859 GCACGTCAGGGGACACTCT | 28843 AAAAGAGGAAGAGCGGCATGA | 39827 |
| 6202 GCAATCTCCAGGACCCCTAAAATTC | 17860 GGGGTCATTGAATCATGGACTGT | 28844 CAGGGATTGCCACAAAGCAATC | 39828 |
| 6203 TGGAGAAGGGCCAACATCAGT | 17861 CGCATGGAGATTGTGCTGCTAAC | 28845 CTGACATGTGGCTGGCATTCT | 39829 |
| 6204 GCAGGTTTTGGTTGCCTTGA | 17862 AAACCCACTCCAACAGCCTTT | 28846 GGCACAGCAATATGCAGGTTTT | 39830 |
| 6205 GGGTCTCTGTCGCCATCTTTCT | 17863 GAGCCCTGATTCTGAAGACAATGAGA | 28847 ATCAGGCTGTGGGTCTCTGT | 39831 |
| 6206 TCGTGAGTGGGTCATTTATGTCTTAG | 17864 CATAGATTCTCACCCAGTTTGGTTCT | 28848 CCATTTTCATTCGTGAGTGGGTCATT | 39832 |
| 6207 GTCCTGACAAAGCAGGACATACA | 17865 GAGACTTATGGGAAGATGGAGCAGTATAA | 28849 AACTGGACTGTCCTGACAAAG | 39833 |
| 6208 GGAATCAATTGTTTGCCAGCACAGT | 17866 TGCAAACTAAGCCACTCTAGTCAA | 28850 GCCCTGCAGGAGGGAATCAAT | 39834 |
| 6209 TTGCTCCTCCTTTTCTCCTCTTC | 17867 CTGCTTTAGCTCCAGGCATTACA | 28851 GCCAGAAGCTTGCTCCTCCTT | 39835 |
| 6210 TCTCTCGGGCAAACTTACATTTCA | 17868 GCTGTTCTCACTGGGTAACTTTCT | 28852 CAACATGTATCTCTCGGGCAAAC | 39836 |
| 6211 CCCACAGTTTGACAAGCAGACTT | 17869 CTGGGCCCTAAATAGGCATTCA | 28853 GTAGGTCACCCACAGTTTGACA | 39837 |
| 6212 AGGGAGCCTCTTCCTCAGATGT | 17870 GGCTGTCAGGCCCTGTATACTTGA | 28854 ATGCCCACAGGGAGCCTCTT | 39838 |
| 6213 GCTGGGGAGTGTCAATGAGCAA | 17871 AGGGACACTTGGGCCTCTT | 28855 TTCCATAGAGCTGGGGAGTGT | 39839 |
| 6214 GGAGTGCGTTCATGAGTCAGT | 17872 GAGTCCTCAGTGAGATTAAGTCCAGTTG | 28856 AGCCAATAAGGAGTGCGTTCA | 39840 |
| 6215 GGGCTAAAAGGGCACACTGTA | 17873 GAGCACACAGATGGACAGGTATAG | 28857 TGCGGACAGCAGGGCTAAAA | 39841 |
| 6216 GAACCAAAGACTGGTAAGACCATTAAC | 17874 GTCCACACTAAGCTTCCAGCAA | 28858 GCAGTTGGAACCAAAGACTGGTAA | 39842 |
| 6217 TGGGTGAAACAGGGCAGTCTTG | 17875 ACAGGCCGGAGCTCGGATCA | 28859 CTGTCCCACTTGGGTGAAACA | 39843 |
| 6218 GCTCACAGGGGTTTGGGGTTATTG | 17876 GCAGCAGAAGGATAAAAACGCAAAT | 28860 CACACAAGCTCACAGGGGTTTG | 39844 |
| 6219 GATCCTAGTGATTCTTGGGACCTAAC | 17877 CCCTGTGGAAGCTAAAGTGTTGGAA | 28861 TCTCTGTTCGTGGAGATCCTAGT | 39845 |
| 6220 CCCTGGAGGAAAACGGTACACA | 17878 GGTTCACATGCAGTTGTGAGAAAC | 28862 GGATGCTACCCCTGGAGGAAAA | 39846 |
| 6221 CATGACACCAGTTGCCACAAATC | 17879 TGTCTGTGGTGGCAAAGAAATAGA | 28863 GGCTTCAATCATGCACACCAGTTG | 39847 |
| 6222 GCTCCACCACTTCTTTGAGTTTC | 17880 TTATCAAGGCCCATTTCAGGTATCA | 28864 CTGATAGAAAATTGAGCTCCACCACTTC | 39848 |
| 6223 GAGGTCAGTTGGACCCTTCAGA | 17881 ATCAGTGGGTCATTTTGTGGTACT | 28865 GCCAGGTATGTGAAGAGGTCAGT | 39849 |
| 6224 ACTCATCTGATGCCCCTCTAGT | 17882 CAGAAACAACCCAGGCTCACA | 28866 TCCCATTCCGCCACTCATCT | 39850 |
| 6225 GAAATGTCCTTTCCTTTCTGCACTT | 17883 GGCCAATAACTCAGCTTTGCAAGAAG | 28867 GTCTCACTTACAGTGGAAATGTCCTT | 39851 |
| 6226 GGATTCCTGGGCTACTCCATTTTTC | 17884 CACATTTCAACAGGTGCCTCTTATCCTT | 28868 TCCAAAGGATTCCTGGGCTACT | 39852 |
| 6227 GCCCTGCCACTCAGCTTTCTATC | 17885 GCCTCTTTATCTAGAGTCAGCCAGATG | 28869 ACTGGAAGCCCTGCCACTCA | 39853 |
| 6228 TGCACTCACCAGACCCAAGT | 17886 GGGTGGCAGAAGCCCCATAAT | 28870 CCCAGCAAGCCTGCACTCA | 39854 |
| 6229 TGTTCAATCAGTTGGCAGACTTTC | 17887 ACTTTTGATCTAAACTCGGCCCATA | 28871 CACCCCTACGTGTTCAATCAGT | 39855 |
| 6230 GGTGGAGAGTGTCTACTACTGTTGAGAAG | 17888 CTCCTGCTACGGTTCTTTCCCTTT | 28872 GGAAGGTAAAGGTGGAGAGTGTCTACT | 39856 |
| 6231 GCCTCTTTCCTTTCCTAACAGTCTCTTC | 17889 GCTGGAATGGAAGCCAGCTTAG | 28873 GTGGTTGATGCCTCTTTCCTTTC | 39857 |
| 6232 GTGGCCAGGTCAGGGATACATT | 17890 TGAGAGAATGGGAGAAGCTGGTT | 28874 GGCCTGTCGCACCCCTTTAG | 39858 |
| 6233 GCTCTCTGGGAAGACAGAGTTC | 17891 GTCCTCTCCACATGAAGTAGTAAATAGTTG | 28875 CGTAATAATGCCCTGATGCTCTCT | 39859 |
| 6234 GGGTGCTGTATTGGAATCCTTAGT | 17892 GCCAACATAGGGATGGATCGTA | 28876 GTGGAAAGAAGGGTGCTGTATTG | 39860 |
| 6235 GGGGTTGAAGAGAAAGGTTAGGACAAG | 17893 GTCACATATAGGCTGCCCATTCTCTAA | 28877 GTTTAGTAGCTTGGGGTTGAAGAGA | 39861 |
| 6236 CCCTCGGCATAAACCCTACTCA | 17894 CTGCTACCCAGGCCACATTTCA | 28878 GGGAATTTACAGTCCCTCGGCATA | 39862 |
| 6237 GCAAATGTGACCCTAGGCAGAAAC | 17895 CCCCTTCTTAGCTTGATCATCTGCTTT | 28879 ACCCCAGTGCCTGCAAATGT | 39863 |

FIG. 36J6

| | | | |
|---|---|---|---|
| 6238 GCGCTCAATCTTGAGTTGTTGAAG | 17896 CCAGATGTCATGCCCAATAATGACT | 28880 GTCAAAACCCAAAATGCGCTCAA | 39864 |
| 6239 GCTGTCTTGACAACTTTGTGCTTCA | 17897 TGAGGAGAGCAGGGGACTTG | 28881 GATGCAATATGAAGTGCTGTCTTGA | 39865 |
| 6240 GCCAATCCTTTCTCACGATACCTA | 17898 GCTGGTGTCCAGTTTTACATCACT | 28882 TGTGGTTATGGCCAATCCTTTCT | 39866 |
| 6241 CGCTTTGGAGAGCTATTGCTTAAA | 17899 GCTTCCCTGGACTTCCTTCTTT | 28883 AATTGTCCGCTTTGGAGAGCTA | 39867 |
| 6242 TTCTGGGCGAGGGATGGTA | 17900 AGAGCTGGGCACAAGCAAAG | 28884 TTTGAGGCCCTGGCCTGCTT | 39868 |
| 6243 GGAACATCAAGGTAGTGTGGATCA | 17901 GACTGGTGATTTGGGGCTTACA | 28885 GCAGGGGAGGAACATCAAGGTA | 39869 |
| 6244 CTCTTGACACTTGTGGCCAAGTTAATC | 17902 GGTTGTGGCAGATCCACTAATCA | 28886 GACACGACCTCTCTTGACACTTG | 39870 |
| 6245 GGGGTGTAGGAGCAAGATAAGCAA | 17903 GGGTATCTCACATCTAAGACTCAACATC | 28887 ACAGATGGGGTGTAGGAGCAA | 39871 |
| 6246 CTTCTCAGCAAGTGGGAAAGAATGTT | 17904 TCCCTGCCCTATACAAGATGT | 28888 AGTAGGCCCTTCTCAGCAAGT | 39872 |
| 6247 CCCAGTGTCTAACAAGGCACTCT | 17905 CTGCAAGCAGGAAAGGCTATTCA | 28889 TTGGCCTTACCCAGTGTCTAAC | 39873 |
| 6248 GGGAGGAGCACATTAAAAGTGGAA | 17906 TCTGACTTTCAGGAGCCTACACT | 28890 TGTTTCTTTGGGAGGAGCACATT | 39874 |
| 6249 CCTCCCATACAGGGCCAAACT | 17907 GCAGCCTGAGCCAATTCTGA | 28891 ACTCCTCCTGCCTCCCATACA | 39875 |
| 6250 GCTGCTGATGAAAGAATCACATCATCT | 17908 GGGGTAAGAGCTCCTCTGCAT | 28892 TCCGTCCTTTGCTGCTGATG | 39876 |
| 6251 CCAAGAACCAAGACCTCAACCTGAA | 17909 CTAACATCCCTGCCATCTTCGTA | 28893 AATCCCTTGTCATACCAAGAACCAA | 39877 |
| 6252 CTGGCTGGCACTAAGGAAGCAA | 17910 CCTTGGCCCACTTGTGACATTT | 28894 TAACGGGCTGGCTGGCACTA | 39878 |
| 6253 GCATCCTGCAATGCTGGGAAAG | 17911 CCTTGGCCCATGATTTCTTCCAT | 28895 TTGGGTGGCATCCTGCAATG | 39879 |
| 6254 CCAACTCACTTAGCATTGCATTGTGT | 17912 CCCATTTATGTCACCCTCCAACCTA | 28896 CCACACATTGCACCAACTCACT | 39880 |
| 6255 GGACGTATAGAGAGCTGAGACTTTG | 17913 AGGCACAAAGCAGTTCACACA | 28897 GGTCAACTTACCTGGACGTATAGAGA | 39881 |
| 6256 GGGCTTACACACTTTACTGTCACACTT | 17914 GAGATTTCATGACAATGGTCCTCAGT | 28898 GCTGGATGGGCTTACACACTT | 39882 |
| 6257 GGCAGTGTAAAATGCCTCACAGATG | 17915 GCCAAATACAACAACTCCTCTTCA | 28899 GTGAGCATGGTTGGCAGTGTA | 39883 |
| 6258 TCAGGCTTTTAACCCACCAGTATT | 17916 CTCCCAGGATTGAGCACATTCTTAC | 28900 GGGGAGGGGATTTCAGGCTTTT | 39884 |
| 6259 CTGCTCACAACCTAGCAACCTCTTT | 17917 GGTGTGGCTGCAACTATAGACA | 28901 GCCTGGGTTTTTCTGCTCACAAC | 39885 |
| 6260 CAGCAGCCAAACCGTTTAACCAT | 17918 GCAGTAAGCTATGATTACACCACTGT | 28902 AGCTCAGCAGCAGCCAAAC | 39886 |
| 6261 CCTGAACCTACTCCATCTGTTCCTA | 17919 CTGCCCATAGACCATGCAAGT | 28903 GCGTGCCCATTTTCCTGAACCTA | 39887 |
| 6262 CCAACTGCCTGAAGGTCTGTTTTTG | 17920 GTCAATACAGCCAAGGTCAGAAATG | 28904 GCACAGTCTTCCAACTGCCTGAAG | 39888 |
| 6263 GCACCTTACTCTCTAGCCCCAAGTT | 17921 CAGACGAATCTGGACACACTTGGAA | 28905 TCACCTAAGTGCACCTTACTCTCT | 39889 |
| 6264 CAGATTCCTAACTCACCTTCAGCAA | 17922 CCATCTGTATTGGAAAGTGTGGTTCA | 28906 GCCGCCCTACAGATTCCTAACT | 39890 |
| 6265 CCCGTCACACGACTAGGAAAGA | 17923 TGCTCTCCTCACCTTTCAGTGT | 28907 CTAAAACTGGGTTCCCGTCACA | 39891 |
| 6266 GCAGTTACTCCTCTTCCCCACTT | 17924 TGGGTTACACATGGGACTTCTT | 28908 GGTTTCACCACCGTGCAGTTAC | 39892 |
| 6267 GCCTGGTTCAGCAGTCTCAGTT | 17925 CTCCTGCACCAAGATATCTGCAAAG | 28909 GAACCTGCTTGCCTGGTTCA | 39893 |
| 6268 GACTGCCCTTTTTCACTTGGTGAT | 17926 GCCACAAAGAGACATGGAGGAA | 28910 TGTAGTCTTTTCAGACTGCCCTTTT | 39894 |
| 6269 GCTGACACCCGTACCCAGAGA | 17927 CCACCTTTTGTCCTTGGGATACAT | 28911 CCACAGTTCATCCCAGTGCTGACA | 39895 |
| 6270 GAACCCCAGGACATCTATTGGTT | 17928 GCTCTGTGATATTGTGCTGTCAGGTA | 28912 CCTCCAGAAGAACCCCAGGACAT | 39896 |
| 6271 CCAGGTTTCCCTTGCAGTTTCAGT | 17929 GGTGCACAGTATTAGCATTAGCAAGT | 28913 TCACCAATTCTAGTCTCCAGGTTTC | 39897 |
| 6272 AGACACCATGTCTCCTCACAGA | 17930 GGAAATGCTACGGAGGCTGTGT | 28914 CCATGGAAGGGAGACACCATGT | 39898 |
| 6273 GGGCTGACCATTAACTTAGGTTTACACT | 17931 ACTCTTTAGGTGAGGACTTCTCTGA | 28915 TCATGTGGGCTGACCATTAACTTAG | 39899 |
| 6274 CCATGTCAGGAAAGTCCTCATGTTTC | 17932 CGAACTTTGGCCTGCCTTCA | 28916 GAGCAGAACATTGTCAGGAAAGT | 39900 |
| 6275 GGGTCCTCCATGTCATCTAACAAAC | 17933 CATCAGGTGATACGGCTACATTCA | 28917 ATGGGGATGGGTCCTCCATGT | 39901 |
| 6276 TGGGATAGAGTGGGGAAATGGAT | 17934 TGACAAATGCCTCTGCCTGTT | 28918 GTACCCAGGCTGTGGGATAGA | 39902 |
| 6277 GGGCACATTTAAGAAGCCCTGAT | 17935 GATTGGTCCAAGCCTGATCTGA | 28919 CCATCTCCAACTTGGGCACAT | 39903 |
| 6278 GGCATAAAAATAGGGATGGGACCATTA | 17936 GGCACAGCTGAAAGGCAAACA | 28920 TTGGGACCCAGAATATGGCATAAAA | 39904 |
| 6279 TGCGGTCAGAAGAGTAGTCAGA | 17937 CCCAACTCTCACCATGGCTTAT | 28921 TCTAGGCTGCGGTCAGAAGA | 39905 |
| 6280 CCCCTAGTTACTACAGAGCTAAGACAA | 17938 GCCTTACAATTTCTACCCTGGAAAGA | 28922 GCAGAACATAACCCCTAGTTACTACA | 39906 |
| 6281 GCCTGGCAAAGGAGCTGTCAT | 17939 CCAGGGCCTATTGGAAACCCTAAAC | 28923 GACACATTAGCTGCCTGGCAAA | 39907 |
| 6282 CCAGTTGCTCCAAGTTTGCCTTTG | 17940 CAGCTTTCTGCCCCTTTTCTTTTAG | 28924 GCTGCCAGTTGCTCTCAAGT | 39908 |
| 6283 GACTAACCAACGAAAACAGCAAGT | 17941 TCCATCTCCTTCCATCTGTTTAGACT | 28925 CATCCACAGAGTGTGGGTTGACT | 39909 |
| 6284 GTCTGTGTCCACCAGGCTATGA | 17942 ACCAGGTGCACGTAACTTGTAA | 28926 AGGCGGCCTAAAGTCTGTGT | 39910 |
| 6285 ACGACCTTGCGGGTGATTCT | 17943 ACATCCACAATGGCAGTTCTCA | 28927 AGCTGGGGTTTCACGACCTT | 39911 |
| 6286 GCCACCACCATGCTGGCTAAA | 17944 CCAGACAGAAGGTGTTGTCCTAACCTA | 28928 CACCACTGCCACCACCAT | 39912 |
| 6287 CCCTGAAGCGTTCCAAACATCTCA | 17945 GGGACCAGCTCCTCACATCA | 28929 TGCTGCACCCTCCCTGAA | 39913 |
| 6288 GCAACTTGACGTAGATAGAGGAGAT | 17946 GCTGATCCCTGGAGACACCTGTT | 28930 TTCGAGAAGCAACTTGACGTAGA | 39914 |
| 6289 GGGCCCACTTTCTGGTTCATAG | 17947 TCCCACACCCATTCCACCAA | 28931 GTCTAGTGAGGGCCCACTTTCT | 39915 |
| 6290 GGTAAGAACAGTGGATGAGAAATGGAT | 17948 GGCTTATGGCTCAAATCCAAGCAA | 28932 GGCTCAGGGTAAGAACAGTGGAT | 39916 |
| 6291 TGGAAGTCCCATAGCCTTACTGA | 17949 CAAGCCCAGTCCTATGTACCCATT | 28933 GCAGCTCTGGAGCTCTATGGAAGT | 39917 |
| 6292 CTGTCTCTTCTGGCAAATCCTTCA | 17950 CCCTTACCATGAACCCGTAAGAA | 28934 TCTCCTCCTTACTAGCTGTCTCTTC | 39918 |
| 6293 CCTGATTCCTCACTTCACATGGAATC | 17951 GACCTTCAGCGTCAGGAGAACA | 28935 GCTCCTTCCTGATTCCTCACTTCA | 39919 |
| 6294 GTCACTCATGGGCTCGGAAA | 17952 CAGACTTCAGCTCTTTCTTCTCCTTCA | 28936 TGCAGGAAGCCGTCACTCAT | 39920 |
| 6295 GGCCTCCTAGACCACTTCAGA | 17953 GGGGATAGAGCCATGCTTTCATTG | 28937 AGCCTGTGGGCCTCCTAGA | 39921 |
| 6296 CTGACATCGCACTGGCCAAAC | 17954 GGACTTGCTTAAGGCTGGGAATAA | 28938 CCACCGTTTTAACTTGCACTGACATC | 39922 |
| 6297 CCAAATGAGGGTCCCACTGCTT | 17955 CAGTTGATTGTGAGTAGCAGTCACGTA | 28939 CAAGCAAAGGCTGAACCAAATGA | 39923 |
| 6298 GACATGCTTCACCAAACTTCAGACTCTA | 17956 GACCAAGCGAGGCAGAAGGAAA | 28940 CCTCCTTGACATGCTTCACCAA | 39924 |
| 6299 GGCACAAAGAGGCTGTCCTGAA | 17957 CTGAAGTCTTTCAACAGAGGAGTAAGATCA | 28941 GCGCTACCAAGGCACAAAGA | 39925 |
| 6300 TCACCGAAGTCCTCCTCCATCA | 17958 CTTTTATGACTCCATTAGAGGTAGGGGATA | 28942 ATGCCTGGCTCACCGAAGT | 39926 |
| 6301 GTGGGCAGAGGAAAAACACTTC | 17959 CCTGAACTCTTGGATCATCAGTCAGATA | 28943 CCTTCAAAGTGGGCAGAGGAA | 39927 |
| 6302 CTCATTGCCAGTTACATAAACCTGTGA | 17960 AAAAGTGTCCCATGTGTCTCAAAAC | 28944 GGCCACAGATATCTCATTGCCAGTTAC | 39928 |

FIG. 36J7

| | | | |
|---|---|---|---|
| 6303 CCCCTTTCCCTCTCAACTGGAAGA | 17961 CAGTAACTCTCCTCTCTGCTTTGT | 28945 ATACGCCCCTTTCCCTCTCA | 39929 |
| 6304 CCTCCAGGCTAAGAACCCTTTTG | 17962 AGGTACACTTCCATGCCAAGAAAA | 28946 CGGAGCCCTCCAGGCTAAGA | 39930 |
| 6305 ACTTTGCCTGGGGAAGTCAGT | 17963 CCAGCTCTAACCCTTACCCATTCTTC | 28947 GGCCCAAAGCAAGGGTATTTCACT | 39931 |
| 6306 TCCCCAGCTGTCTAGTGGTTCT | 17964 GGAGGCTGTGGCCATGATTAAC | 28948 AGCCTTTCCCCAGCTGTCT | 39932 |
| 6307 GGGCCTTGGTGAACATCGTCTT | 17965 TCGCTGGACTAGATGGCTACT | 28949 ATCCTCTGGGCCTTGGTGAA | 39933 |
| 6308 CTCGGTGGCTTTTAAGTTCATGT | 17966 CCTTCTGGTTTCCACCCAAAGAAG | 28950 GCATATCCTACTTCTCGGTGGCTTT | 39934 |
| 6309 GGTGAGTTGCTGGAGGCTCATT | 17967 GGGCCCTTCTGGAGCTTTTAAC | 28951 GGGTTGCAGAAACTTGGTGAGT | 39935 |
| 6310 GAGCAAGCAAGAAGTCATTGAAACT | 17968 ACAGCTCCCTGTCCTGCAAA | 28952 GGAAGGAAGAGCAAGCAAGAAGT | 39936 |
| 6311 GCAAGAAGTACAGTTGAGACACAAACA | 17969 CCTGTCCCGAATTTCCCTCTCTCT | 28953 GCTGTGGAAAGCAAGAAGTACAGTTG | 39937 |
| 6312 AGCCAAAACCATTTGGAACCATTG | 17970 GTGGTTGGCCAGGCAATGAA | 28954 CAGGCAGCATCGTCTTCTCT | 39938 |
| 6313 CCTGACTTATTGCCTCAAACCTCTAC | 17971 GCCTGAAAGTGTACATGCCTCTTCT | 28955 ACCCAACTCAGCTCCTGACTTAT | 39939 |
| 6314 GGGGCATGCTAAGAGTCAGGAGTA | 17972 GGGAACATACCACAGCATTCGCTTA | 28956 AGGTATCAAGGGGCATGCTAAGA | 39940 |
| 6315 GTGAATCATGGGCAGGACCTT | 17973 AGTCAAGATGAGGAGAATCCAGTTC | 28957 TGCCCCAAGAACAAGTGAATCAT | 39941 |
| 6316 GTTCAGACTGGTATGGACAGTAAACA | 17974 GCCACTGGAAGGACCAATTCTGA | 28958 TCTCTTCCACCCTTAGTCAAGTTCA | 39942 |
| 6317 GCCTTGGATAAGCGGTAATCCTGACA | 17975 GGCTAGAAAAGGAACTCCACTGCTT | 28959 CATACAACATGGAAGCCTTGGATAAG | 39943 |
| 6318 CACATGGCCTGGGTTGGAATCA | 17976 GGCACAGAGAGGTTCAATCCAT | 28960 GGGCTAAGAGGCAGGAACACA | 39944 |
| 6319 GACATATCATAGGTGTCCAGCACAT | 17977 TTGCAGCGCCACTGCTTT | 28961 GACATAGTTGGAGAGCGACTGACA | 39945 |
| 6320 GGTTATCCTCTTCCGGTGGAGTTG | 17978 GTCACCCATTGTTGCTGAGAGA | 28962 GGACAGAGCTTCCGGTTATCCTCTTC | 39946 |
| 6321 CTCATCACACAGAGGGAGAGCTT | 17979 CCGGTCAGTTGTGGACTTTTGT | 28963 CGACACTGCCACGTCTCATCACA | 39947 |
| 6322 CCCTTCATGGCTCAATCTGGCATT | 17980 GAGGTCAAGAAAAGACCTCCATGAT | 28964 CCTGAAGCCTTATTCCTATCCCTTCAT | 39948 |
| 6323 GGTAACTGGACCAGAACAGGTTAG | 17981 ACTCAGACCCTCCCTCGTGTTT | 28965 TTGAGAGTGACCTGCTGAGGTA | 39949 |
| 6324 TGATCACCGGCAGATTCAATTAAGA | 17982 GCTGCCTTGTCATCCTTGTTTC | 28966 CCTTTCATGATCACCGGCAGATT | 39950 |
| 6325 TGTCACCCAGAAAAGCTCAGT | 17983 TGGGCCTTCCCCTCACACT | 28967 TGGCCTGTGTCACCCAGAAA | 39951 |
| 6326 CACTCCCTTGTTTAGGCATCCAA | 17984 TGAAGGCCCCAGCCACATTAC | 28968 TGCTCACCCACTCCCTTGTT | 39952 |
| 6327 GCCAGGGCCCATAATTTCACTCT | 17985 CGACACCACCACTGTCATCTGT | 28969 TGGTGCCAGGGCCCATAA | 39953 |
| 6328 CTACTTGCCTGTGTGGACAATACT | 17986 GGCAGCAAGAGTGAATGTGTTG | 28970 TCCATCCTCCGGCTTCTACTT | 39954 |
| 6329 AAGCAGCGGATCAACTTCTTTTC | 17987 CCCAGTACCACCACAGAATAAACT | 28971 GAATGGGAAGCAGCGGATCA | 39955 |
| 6330 GCTGAGTGAGTGATAAAGGACAGTTGTA | 17988 CTTCACTGGCTGCTGTCACCCTTGA | 28972 CCTCAGTTGGCTGAGTGAGTGATAA | 39956 |
| 6331 TCTTATCCTGTACCTCCCATGCTT | 17989 CCAGACCAAAATCAAACTCAAGAGCAA | 28973 CACCATCTGCCTTGATCTTATCCTGTA | 39957 |
| 6332 GGGTGATGCGCTCTTCCAAA | 17990 GGAGTGTCCTCAAACTCCCAAA | 28974 CCTGTACCAGGTCTGGGTGATG | 39958 |
| 6333 TGCCACCCTATTCCCCAGTGT | 17991 CCGCATTAGGCCTAGTCTCTGTTC | 28975 GACCTGGGTCAAATGCCACCTA | 39959 |
| 6334 CGTTGTGTACAACAAGAAGGAGAGAAG | 17992 GCTCTTAGGTCTGGGCTCCCTAA | 28976 CCCCTTGCTCATCACGTTGTGT | 39960 |
| 6335 CCTACACCTGCTTCCTGTCCTT | 17993 GCCTGCCTGGAAATCTCAGTCT | 28977 CAGAGCTTCCCTACACCTGCTT | 39961 |
| 6336 CTGTCACTGACCATTTGGAGTTTTG | 17994 CCTGTGTTTGCTTTGACTTTTCCTT | 28978 GGTTATGCCTGTCACTGACCATT | 39962 |
| 6337 GGTGGGGAGGTGAGATTTTGTGATG | 17995 TCAGGAAGGTCTGCTCAATGTAAG | 28979 ATCAAGGTGGGGAGGTGAGAT | 39963 |
| 6338 TCCGTTTGGGCTCACCTCAGT | 17996 GGGATGCCAAAGTGGACATACGAA | 28980 GCAAGCAGGCTTGTCTCCGTTT | 39964 |
| 6339 GGCTGGTTTTCTCAGGGGATAAG | 17997 CGTATATCTTTCCCGCCATAGGTTGA | 28981 AAGGGGCTGGCTGGTTTTCT | 39965 |
| 6340 CGCATCCATTACACCTGGGACATT | 17998 CCCCTTTACGCAAATCTACCTTGTA | 28982 CTCTAGAGATCCCCGCATCCAT | 39966 |
| 6341 TTCAGGTCTTGGCTTAAATGTCAAC | 17999 TGAGTGGGGCTGTCAGGAAAAC | 28983 CACCACTGACATCATTTTTCAGGTCTTG | 39967 |
| 6342 GTTGGGCAGTGACTTGCTTTTTC | 18000 GGAAGGGTGAGGGGAGATACTGA | 28984 ACATCACTTGTTGGGCAGTGA | 39968 |
| 6343 GTGTCCGAAAGAGAGCAAGGAGTT | 18001 GCAGGGAGTAGCAGCAAGTT | 28985 TCAGGGCCCTGTGTCCGAAAGA | 39969 |
| 6344 GCAGGGAACAGGCGAATGTGTA | 18002 AGGGGCCACTCCCGTAGATAAA | 28986 ACACTCCAGGTAGCAGGGAACA | 39970 |
| 6345 CAGCAATTCAGCCCCAGTGT | 18003 GGCCAGCTGGTCTGCAAATAAC | 28987 GCTCTGCAAGGCAGCAATTC | 39971 |
| 6346 GGCTAGCTCTCTGTGGAGTTGAAG | 18004 TTGGAAACTTAGGGAAACCCAACA | 28988 GGGAGAATGGCTAGCTCTCTGT | 39972 |
| 6347 GCTGGGGTTTGAACTCAGGTCTGT | 18005 GGTCACAGCAGTCAGCACAAT | 28989 GCAGAGCTGGGGTTTGAACT | 39973 |
| 6348 GTGCTGAATGCTGTTCTCAGAGTTTG | 18006 TGATGGGGACAATCACCTCACA | 28990 GCCTTGAGTGCTGAATGCTGTTC | 39974 |
| 6349 CGAGGACCATCCAGTTTTTCCAAAG | 18007 CATCAGCGCAATCAGGTTGAAAG | 28991 TCCACGAGGACCATCCAGTT | 39975 |
| 6350 GGAATGCCTGGGATGATTTACTAAGAGA | 18008 GCCGATCCAAGTTGCCATCCTT | 28992 CCTGCTTTAGGAATGCCTGGGATGA | 39976 |
| 6351 GTCCCTCCTAATCCAGATACTCACA | 18009 GGGGAAGACAGGTGTCTGAATG | 28993 CATTGCCCTTAAGTCCCTCCTAATC | 39977 |
| 6352 GGTGCTCTGAGGATCCAATGGTA | 18010 CCTCGGTTGCTGGTTCAGGATT | 28994 GAAGTTGTGGTGCTCTGAGGAT | 39978 |
| 6353 CTCCCAGGAAACACAGCAATGA | 18011 CATGACACTGCAGGACTGAAGAAG | 28995 AACCAGGTGCTCTCCCAGGAA | 39979 |
| 6354 GCAAAAGGATGTGAGCAGAGCAT | 18012 GGAGGTACACACTTTCCCGAAAAAC | 28996 GGATCCTGGCAAAAGGATGTGA | 39980 |
| 6355 TCTCTGACTCCCAATCCCCTAAC | 18013 CCTGCTGGCTTCTGAGCTCTT | 28997 CCTGGGCCACTTCTGTGACT | 39981 |
| 6356 GTGGTGGGTTGATGAGGACAAG | 18014 GAGCCCAGTGGAAGCAGGAAATG | 28998 GTATTGCTGGTGGTGGGTTGA | 39982 |
| 6357 CACCCAGCCGATTTAGGGTAAT | 18015 CCAGCGCTCATTGACAATTCAAA | 28999 CACTGCACCCAGCCGATT | 39983 |
| 6358 CCCCAATGTCAGTTAAGCAAGTGTTCCTA | 18016 AAACCCCTTCCATCCGAGAATC | 29000 GGAGCCTTCTCCCAATGTCAGT | 39984 |
| 6359 CCATACAACCTTGTGGGATACAATCT | 18017 ACCCATTTCCAAGGTCCAGGTA | 29001 GCCACAGCCTGGAAACATCCAT | 39985 |
| 6360 CACATGCAAATGCAAACTGCAGAAG | 18018 CCTCTGCCCATTTGTAACCTCCTA | 29002 GGCAGGTTGCTGGAACTGGTTA | 39986 |
| 6361 GCATCATTTCCCTGTGGCGAGTT | 18019 CCCAACAGAAGCAGGAGGATAGGAT | 29003 CTTGCAACACCACAGCATCATT | 39987 |
| 6362 GCACATTATAAGGATCCTGGCTTTGA | 18020 TGCAGCTGCCTCCTTTCGTT | 29004 GGCCTCGCAGAACAGAGGTA | 39988 |
| 6363 CAGTGGGAAGGAAATGGGACAGA | 18021 CTGATGGTCACACAGCTCTCATAG | 29005 CTGTTTGTCACAGTGGGAAGGAA | 39989 |
| 6364 TGTGGAAGAAGGATACCTCATGGTA | 18022 CCCAAGACGTTTGCCTTTGAAGCTACT | 29006 TCTAGTCTCACCTGTCCCCACTGT | 39990 |
| 6365 GCCTGTAGATCCATTGGCCTTT | 18023 CCAAGACAGATTGACAAGTAGCTTAAC | 29007 GTGTCTTGGTAATTCAATGCCTGTAG | 39991 |
| 6366 CCTCCAAACTTCCTGAGAGAGATG | 18024 GCCACGCTTGTTGCCGTTAG | 29008 CCCCACATGTCTCCTCCAAACTTC | 39992 |
| 6367 GAGCTGGGGAGACTTAGTCAGAT | 18025 GGACCAGCCTTGGGGAAATG | 29009 GAGGTGAGCTGGGGAGACT | 39993 |

FIG. 36J8

| | | | |
|---|---|---|---|
| 6368 GTTAGAGACTGGAAGATGCCATACA | 18026 GATGTACACACCCACATGTAGCAA | 29010 GACACACATCCTCAAGTTAGAGACT | 39994 |
| 6369 CCTCTTGAGTCTTTACCTGTGT | 18027 CTGCGTCCAATATGTGTACTGCTTCT | 29011 CCTGTTTCCACCTCTTGAGTCTTT | 39995 |
| 6370 GCATTGGGTGCACGTTGAGA | 18028 TCCTTTGCAACTCTGAGCTTTGT | 29012 GCACTGTGCGAGGCATTG | 39996 |
| 6371 CCGAAGATGGCAATGACGTTGA | 18029 GACTGGTCAATACTTGTTGAGTGGT | 29013 TTCCCGTCTGCTACCGAAGATG | 39997 |
| 6372 CGCAGGCTCTGGAATTCTTTACT | 18030 GCAGCTTCTTCCACAAAGCTAGA | 29014 AGAACACGCAGGCTCTGGAA | 39998 |
| 6373 GACCTTGCCCACAAAAGTCAATGTTC | 18031 AACATTCGGTGCAGCTATGGTA | 29015 GAACAATTAGACCTTGCCCACAAA | 39999 |
| 6374 TGGGTCTCAAGTGGCCCAAA | 18032 ACCTCCCATTGCCACTCGAT | 29016 CCTCCTTCCTTTGGGTCTCAAG | 40000 |
| 6375 GTGGGGATTATCTGGGAGTGTGA | 18033 GACTAGGAAGTGTCCTCCTCTGA | 29017 AGAGCTGAGCAGTGGGGATT | 40001 |
| 6376 GGGCAAATAGCTCCTTTCGATCCTA | 18034 TCTTGGACAAGGCATGTTTTGATG | 29018 CTGCTAGGTTTCCAAGGGCAAA | 40002 |
| 6377 GGGCAGGTATGAGGCTGACA | 18035 CCTGACCACATGCCTTCATATCTCA | 29019 GGGAGCAAATGGGGCAGGTAT | 40003 |
| 6378 GGCTATGGCTTCAGTCCATCTTTC | 18036 GACTGTTTGTTCAGCCTAAGTCCTAGA | 29020 GCAGGTTGGCTATGGCTTCACT | 40004 |
| 6379 GTTGAAGTTCCCTGCATTTCACA | 18037 GGCTGACCTCTCTCCTGTGTT | 29021 GTTTGGGACAAGCTGAGTTGAAG | 40005 |
| 6380 GACCCTGCAGTAGTACTTTTGTTCT | 18038 AGCTCATCAAAATTCACCTGTGTCT | 29022 TCATGGATAATTGACCCTGCAGTAG | 40006 |
| 6381 GCCTCATGTAACTCTCGGGTATGA | 18039 AGTCATGAGACCTATTGCTACCCTTA | 29023 GCAGATACTGCCTCATGTAACTCT | 40007 |
| 6382 CCAATGCCTCAAFTTCTCCAGGAAAC | 18040 TGCCTAGCCTGGAGCATGAA | 29024 GACTCAGCCAATGCCTCAATTTC | 40008 |
| 6383 TGATGCTTCTAGTCCACAGACTTTC | 18041 GCTTGGGCTGTGGTTTTCTCTA | 29025 AGCTCCCAGATGATGCTTCTAGT | 40009 |
| 6384 GGTGGCTGGAAGTTTGTTGAAGA | 18042 CCACTCACCACCTCTCACCAGAT | 29026 GCAGTGTTGGTGGCTGGAA | 40010 |
| 6385 TGTTTGTCATCAGTCTGGAATGCTT | 18043 TCACCCATTATCTTGGACCCTTTTC | 29027 GGGGAGGGTGTTTGTCATCAGT | 40011 |
| 6386 GGGAACCGCATTTAGGTCGTGTTG | 18044 CCGCTTTTGCCGGGAGATG | 29028 GAGATGCACGGAACCGCATT | 40012 |
| 6387 CTGAACCAACTAAAAACAGGTGGTGTTG | 18045 GGGATATGAATTGCCTTCTTCCCACATA | 29029 AGCAGCCTGAACCAACTAAAAAC | 40013 |
| 6388 GGGCCCCATAGCCTTGCAAAT | 18046 GGAAACTTTTGCATGACTCTCACA | 29030 GGAAGGGAGCCCCTGTTGAAT | 40014 |
| 6389 CCCTGCTTTTCCTAAGGGCAGATTT | 18047 GGAGAAGCAGTTTCCAAGACATGA | 29031 AGTGGGATCCCTGCTTTTCCTA | 40015 |
| 6390 GCCCGGTGCTTTGTTTTACTGTGA | 18048 AGGAAGAGGACTTTGTCTTTCAACT | 29032 TCTGCCCGGTGCTTTGTT | 40016 |
| 6391 GGGTCATGGTTTCAAGGAAATGGATTG | 18049 GCTACAAGCTCTACTCCACTCAGAT | 29033 CTCAACTGGGGTCATGGTTTCAAG | 40017 |
| 6392 GGCTATGGGAGAAACAGTACCATGT | 18050 CCAGAAGGCCATGTATGCTCTGAA | 29034 CCGTGAATCCTGGCTATGGGAGAA | 40018 |
| 6393 CCTGCCCTGTAGTCTTCCTGTCT | 18051 GAGGGAAAAGGGAACATTTCAGGTAT | 29035 AAAGGCTCCCTGCCCTGTAGT | 40019 |
| 6394 CTGGCCTGTGTTTTAGGCCATTT | 18052 ACTCAAGGCCCTGGGTTCAAG | 29036 ACCCCACCCACCTTTCTCT | 40020 |
| 6395 GGAAAGACAGTTAAGGCTGGCTCTA | 18053 GCCCAAAGGCAACACTCTA | 29037 CCCTGCTAAGGGAGGAAAGACAGT | 40021 |
| 6396 GGGAGTAGGTTGCCTTCTTGCTA | 18054 GGCTGAGGTTCAGAGAAGAGAAAA | 29038 GTATCTCCAGATCTAGGGAGTAGGTT | 40022 |
| 6397 CCTGAAGAACGCGATTGACCCATT | 18055 GGTGAAGAAGACTTAGGAGTGACAT | 29039 CCTCGCAAAGCACCTGAAGA | 40023 |
| 6398 CTCACCTGCTTGTTTGATTCTCCTTA | 18056 CTCTATCTCAGCTTTGGAGGCAACA | 29040 GGTTAGGATCTCACCTGCTTGTTTG | 40024 |
| 6399 GCGGAATTCAGTCAGACAGTGAAC | 18057 TGAAGCCAAGTCTATAAGGACGTTT | 29041 TCCCCGCGGAATTCAGTCA | 40025 |
| 6400 ACACAGGCTGAAGGAAATGATGT | 18058 CCCTGGTGAATCTGTTTTCCATCAAA | 29042 GTGCATGAAACACAGGCTGAAG | 40026 |
| 6401 CGGTTATCAGCCAGAAGGGGTTT | 18059 CCCCACCAGCTGTTTCTGACA | 29043 CCCTGCCGAATTTGCGGTTATC | 40027 |
| 6402 GGGTGGATGGAAGGGATGTGA | 18060 CTCAGAATCTGTTGGGAATGATTTCTCCAT | 29044 CCTCAGGGTATTGAGGGTGGAT | 40028 |
| 6403 GTACCAACCCTCGTAAGTTCCTTAG | 18061 GTCACTCAGGAAATGGGTTGAACA | 29045 GCTTTTCTGAGTACCAACCCTCGTA | 40029 |
| 6404 GCACCAAGACCACGACCAA | 18062 CCGCCTGTCCATTCAACAGT | 29046 ACTGTTGTAATCCAAGCACCAA | 40030 |
| 6405 GCCCTTGGCTTATTTTCCCCTTTC | 18063 GGAAAAAGTCACCTCGGCAGTTTTG | 29047 GCTCCTACAGCCCTTGGCTTAT | 40031 |
| 6406 GGGCTCCCTATTTTCCAAAGATCAGA | 18064 GGTGGGAACAGATATTTCTGGTGAA | 29048 AGAACTTACAAGGGCTCCCTATTTTC | 40032 |
| 6407 GTTGCCCTGAGATGTTCACTGT | 18065 CAGTAAGCACTGTAAACACCCTTCCTA | 29049 GGGGCATCATAGTTGCCCTGAGAT | 40033 |
| 6408 GGCACAAGTGAGCTGAGTTCAGA | 18066 GTAGCTCCTAAACACAACAAGTACCAT | 29050 AGGAGGACTTGGTAGGCACAAG | 40034 |
| 6409 GCTAGGAGGTCCGAATTCTTTTGAAC | 18067 CCTCACACCCATAGTCCTTTCCTCTA | 29051 GGAGAAGCTAGGAGGTCCGAAT | 40035 |
| 6410 TGCCCCTGGAAAGACTACAGA | 18068 TTGTGGTCCCAAACAGGGTATATTT | 29052 CAGCTTGTTTGCCCCTGGAA | 40036 |
| 6411 GGGAAGTTCAAATTGCTGAGCTTGTAG | 18069 CCCAGCCACCTCCTAATGGACTA | 29053 CCCCAAAGCTAAGCATGGGAAGT | 40037 |
| 6412 CCAACCAGCTATGCTACCATTTCTAC | 18070 GTGGAAAGTCCTCAAGCCCTCTTAG | 29054 CCCACTGCTTAGACCAACCAGCTATG | 40038 |
| 6413 GCAACAGGAGATTTTTGGTTGTTTG | 18071 GTGCCTAGCCAAGGAATACACT | 29055 GTGTTACTGAAGTGCAACAGGAGAT | 40039 |
| 6414 TGTGTCAGGTTTTAGGCTGCTT | 18072 TCAGGAAGCCATGGTTTTTGAGAT | 29056 GCTTGCTCAAGTACATTGTGTCAGGTT | 40040 |
| 6415 AGGCCACAAAGCCTCACATC | 18073 GTGTTTAGGATTCAGAAAGAGCTGAGT | 29057 AACAAGCCCAGGCCACAAAG | 40041 |
| 6416 AACAGGAGTAGCAGAAAGGCAAA | 18074 GGCTGCAGAGATGATACCTGAGCTT | 29058 TGGGGTATGTCTATGAACAGGAGTAG | 40042 |
| 6417 CAGCAGCTTAAACAACCATGAGAAGT | 18075 CCAGGTGAGATTTTCCTTGTCACT | 29059 GACAGTGAATCAGCAGCTTAAACAAC | 40043 |
| 6418 CCTTCATCATTGGTAGCCTAGCTGTA | 18076 ACTTGGTGTAGGGGCTGAGT | 29060 GCCAGTGCTGGTTGTGTCCTT | 40044 |
| 6419 GTCAACCCGAATAGCTCCTTTCT | 18077 ACAAAAGGAGAGGTAAACCCTGTTC | 29061 CCCAGAAACTTGTCAACCCGAAT | 40045 |
| 6420 CCCCACATCACAGGGCTTTAGA | 18078 AACCACTATAGCCCACAACAA | 29062 CCCCTCAACCCCACATCACA | 40046 |
| 6421 TCCGCTCAAGCGTCCAAGT | 18079 GTTACCCCATGACAGCAAAATCAAG | 29063 GACTTATCATTCCACTCCGCTCAAG | 40047 |
| 6422 CCTGAATGGTTTTATCTGACAGGTT | 18080 CGCCCAGCCAGACTTATTCTCA | 29064 CTCCAACTTCATCCTGGAATGGTT | 40048 |
| 6423 GGCCCTGACTTTGCTCAAGAT | 18081 TGCTGCCTGGCTTCTCTCT | 29065 TGGGCTTGGCCCTGACTTTG | 40049 |
| 6424 CAGGCGTTATCAACTTTCCCACTT | 18082 CATAAACACTCCTTTGCCTCAGTCT | 29066 CGGAGGATGACACAGGCGTTA | 40050 |
| 6425 CCCTCTGAATCACTCTCTGCTCTTCA | 18083 TGGAGACATCCGCCCATATCA | 29067 GCCCACTTGTGTCCCCTGAAT | 40051 |
| 6426 GCTGTCTTCTCTAACACCCAGTCT | 18084 GGTTCTGAGGACCTGGGTTTTCTT | 29068 TCTGGGTTGCTGTCTTCTCTAAC | 40052 |
| 6427 CAGGCATGGTCAGAAGGGTTAAG | 18085 CAGGAGGTAAACACCATCCCTGAT | 29069 CAGATTCACAGGCATGGTCAGA | 40053 |
| 6428 GATGCTCTTAGGCATGGGAAGT | 18086 GGGGTGAGACCCATGAGTGACATT | 29070 GCTTACATTCCCTGTGATGCTCTTAG | 40054 |
| 6429 TGTGTCTTTCTGCTCCTTCCTT | 18087 CCACTAGTTTATCCCACCTGTGTAAC | 29071 CCAGGTTTCTGTGTGTCTGT | 40055 |
| 6430 GTTTTCCTGTTGCCTTGACTCACA | 18088 ACCCAGACAACAGTCTCATCTGT | 29072 GCCCCACAGTGTTTTCCTGTT | 40056 |
| 6431 GGGGCTGTTAAATAGAATCCACTCCTTTG | 18089 TGCGAGTGGCAGTGCTTAG | 29073 CCAAGCTCACTGGGGCTGTTA | 40057 |
| 6432 GGCTTCTGTGAGGGCGATGTT | 18090 GCATTAGTGACAGGGATCCAGGAA | 29074 TGGGACTTCAGGCTTCTGTGA | 40058 |

FIG. 36J9

| | | | |
|---|---|---|---|
| 6433 GGGGTGGAAACGTTGGAAGCTA | 18091 CCGATGCGTGACAGGTTTGA | 29075 AAGGGCTGGTGGGGTGGAAA | 40059 |
| 6434 GGACACTGTCAGGTTACTGAGGTT | 18092 GTCTAGAGACAATGGTTCTCACTGATG | 29076 GGTGATTGGACTGTCAGGTT | 40060 |
| 6435 CCGCCTCCTTCACATTTCCACTAC | 18093 TTGGATGTGTGGTGTGAGAGAAG | 29077 CTGATAAGTCCAACCGCCTCCTT | 40061 |
| 6436 GTCACAGGCTAAGGGTTCTGAAG | 18094 CTGGGCCTCCATTGTTTTGTCA | 29078 GAGGCAATGAGTCACAGGCTAA | 40062 |
| 6437 GTCGAGCTAAGAAGGTTGTGGAAAAG | 18095 GTTTCATCCGTTTTTCCCTGTAGTT | 29079 GCCTGTCGAGCTAAGAAGGTT | 40063 |
| 6438 CTGCCGTCTGAATGGAGATGTGCTA | 18096 TGGAGGGACCGTCTTTGGAGTT | 29080 CACGTAAAATGTGCTGCGTCTGA | 40064 |
| 6439 TTTGATACAATCTGTGTGGGGATGA | 18097 GGACTGGTCTGTGCTGGTGATAC | 29081 CTCACCCAGTTCCTTGGCTTT | 40065 |
| 6440 GGAAGGGATCTGAAGAAGGGGTCTA | 18098 GTAAGTCGTGAAGTTAAGGTACCTAGT | 29082 GGCGTTGGTGTTTGGAAGGGATCT | 40066 |
| 6441 CCAGTCTCACTCACACCCAGATAGT | 18099 CTGGAGGAATCGCAGACAGTTTCA | 29083 TGATGCCCAGTCTCACTCACA | 40067 |
| 6442 GGGCATCTGAATTGCTCTGGGAAT | 18100 CTCATTAAAGAGGTGAGGACAGGTAA | 29084 GCAGCAACTAGGGGCATCTGAA | 40068 |
| 6443 GGTCTCATTAATTCCATCCTCCCATCA | 18101 GGGTCCAACTGCTTATTTCTTGTTG | 29085 AAGGCTCTGGTCTCATTAATTCCAT | 40069 |
| 6444 GGGGTGGCATAAATTTGCTCTTC | 18102 CTCATACATTTAGGGCTGTGTTGTTCA | 29086 TCTTGGTTTACTAGGGGTGGCATA | 40070 |
| 6445 CCTCCAGTTACCATTTTGAACCTCTT | 18103 CTTTCTTGGCCTTGTGGGACTA | 29087 GGAAAAGATAGCTTTGATACCTCCAGTTAC | 40071 |
| 6446 GGTGACTGGCAGCTCTTAGTGGAA | 18104 GTGCTCTTCAGGGAGGGTGAATC | 29088 TTCTGGAGGTGCTGGTGACT | 40072 |
| 6447 GCACCCTCACTTGCCTTACCTT | 18105 AGGAGACTGCAGTGGGAGAAA | 29089 ACATCAGAGATAAGCACCTCACTTG | 40073 |
| 6448 GCTTCTGAGAGGGCTACAGTTG | 18106 TGTTGCTGATGGGACATTGAGTAT | 29090 CAGCTACCACCAAGTGCTTCTGA | 40074 |
| 6449 CACACTCTGGGCAATGGTGTT | 18107 GGAGGCTGAAGTCACTGGTTCAA | 29091 GTTGTGAAGTAGCACACACTCT | 40075 |
| 6450 CACTCCTGAATCCTCCTCCCTAACA | 18108 GGACGCGGTACAACGAACTTG | 29092 CCATTCCTTCCCCACTCCTGAAT | 40076 |
| 6451 GCACTTCAATTCAGCATGTCCAAA | 18109 GAGGACTTAGGTTTAGGGTGGAATG | 29093 GGGGTTTCTAAGGCACTTCAATTC | 40077 |
| 6452 CATGCAGATTCATAGCCACTCCTAGA | 18110 CCCACTCCTTACAGCTGGTCTTC | 29094 GGGACAAAGTCTTTACATGCAGATTC | 40078 |
| 6453 GGGCAGATTTTTGATGTAGGTTCTTAG | 18111 CCAGTCTTCTATGGGTCTCCCAGTT | 29095 GGTTAGGATTGAGTTGGGCAGATTT | 40079 |
| 6454 CAAGCATCTACATCCCTTTCCAGAGA | 18112 GGACACCACCCTGTAACTCTGA | 29096 GCCCACACTCAAGCATCTACATC | 40080 |
| 6455 ACAGACAGAAGCATGGTCTTAGGTA | 18113 GGGGTGATGGTAAGGAGGTTTAC | 29097 TTGGAGAACTTACAGACAGAAGCAT | 40081 |
| 6456 CCACGAACCTGTCTTTGCCATT | 18114 CCCCAGAAACTGCATGTCACATTAC | 29098 AGGCACACCACGAACCTTGT | 40082 |
| 6457 GGAGCAGTGGAAAAATCCCACATC | 18115 GGGCTGGTTTGTTTAGAGGTTCAA | 29099 GGATTGCACAAGGAGCAGTGGAA | 40083 |
| 6458 GCACAGCTTTTCCTCGGTGTT | 18116 GGAGCAAACAGGAATCATCTGGAA | 29100 TGGGAGAGGGCACAGCTTTT | 40084 |
| 6459 GGTACCCCAGGATATGCAAGTCTTC | 18117 GAACAGTGGGATTCTTCTTCACATCAA | 29101 TCTGAAGATTTGGTACCCCAGGAT | 40085 |
| 6460 GGTCACCACATTATTTCCGTCTTATCTCTT | 18118 GGAGCAGAGCAGTTTGGCTTCA | 29102 CTCATACCCTCTTGGTCACCACATT | 40086 |
| 6461 GGGGAGCTTTGCCATCACATCT | 18119 CCTTCCATAGGCTCCAGTATCCAA | 29103 AAGCGAACTGGGGAGCTTTG | 40087 |
| 6462 AGCCAAGACACACATAGAGCAA | 18120 CTGATTAGACCTCGATGGATACAGATAC | 29104 CGTTGCTCCTAAAGCCAAGACACA | 40088 |
| 6463 CCAGGTTCCCTGCTGGAAGTAT | 18121 CCCCAGAATCTGAGAGGGAGATGAAC | 29105 TGGCCTGGGTTGCCAGGTT | 40089 |
| 6464 GCATTGTGTGGGTTCTGGTTTCT | 18122 CCATGAAACACCCACTATACCTACA | 29106 CCTGGAGGCCTGGCATTGTGT | 40090 |
| 6465 CCTCCGACCAGATTGAGAACTTG | 18123 GGGTGGGGATCAATAAGAGGAAAG | 29107 GCTACAAGTTAAATCCTCCGACCAGAT | 40091 |
| 6466 GGAACACCTCTGGGCACTTG | 18124 CTGGCACAAGCATCACTGTCA | 29108 CCAGCTCCAAACACAGGAACA | 40092 |
| 6467 GCAAACTGGCAGGAGTTGGAATG | 18125 CACTGCTTGTACTTGGTCCCTTTG | 29109 GCTTCAAAATGCTTCCTGCAAACT | 40093 |
| 6468 GGGTTTCGCTGTTAAGAAAGGACCAAA | 18126 CGAAGATTCAGTGCGTGCATTCT | 29110 CGGAGTGTCAGGGTTTCGCTGTTA | 40094 |
| 6469 GGGAAGCTCTCTCCAAGCATTACT | 18127 CAGTCCTGCCTTCTTCTCCTT | 29111 TGCCTATTCTATGGGAAGCTATCTCT | 40095 |
| 6470 GCCACATAAACATAGCCACAGAGGAT | 18128 GGGACACCGCTCATTTGGAA | 29112 ACAGCCAGAATGCCACATAAACA | 40096 |
| 6471 GTGTGGGGTCTTCATGATTCACT | 18129 TGCCAGCCAGATGCCTAA | 29113 TGCAGGGAATGGGGTAAGGAA | 40097 |
| 6472 ACCTGACCTTCCTGCTTGTTTG | 18130 CCATAATTCAAATCCAGCCTCAGGAATG | 29114 CTTTGAGGCTAGAAAACCTGACCTT | 40098 |
| 6473 GAGGGCAGGACTTGATCATGAGGTT | 18131 CCCATACTGATGCAGTGCTAGAGAT | 29115 TGTCCTTGAGGGAGGACTTGA | 40099 |
| 6474 TCATCTGTGAGCAATCCTGCTT | 18132 CCTGGTGACACAATTGGGTAAGAATGTTAG | 29116 GTCCCTCTAAGCTTTCATCTGTGA | 40100 |
| 6475 GCGTGAACACGTTAGGGACCTT | 18133 AGGGCCAAGGCTACCAGTGAA | 29117 TTTCCTCTTTGGAGCGTGAACA | 40101 |
| 6476 CCAGGTGCCGCTCAATCCCATTT | 18134 GGGGACTGGAAGTCATTTCTGATG | 29118 GCAACCTGAATGCCCTCTCCTT | 40102 |
| 6477 GCATTCACAGGACAAAGACCATTAG | 18135 GGTGTCAATGGTGCCTCACA | 29119 GCTCAATGCATTCACAGGACAAA | 40103 |
| 6478 TGACAGCTCCACCATAATTACTTGA | 18136 GGTACCTTCCTTTGAGGATTGCTACA | 29120 GGGTGTAAATGACAGCTCCACCAT | 40104 |
| 6479 CCTGTTGATAAGGCCCAGGACAAAA | 18137 CGTGTTTCCAGCAGGTGTGT | 29121 CCCTTTCACTCCACCCTGTTGAT | 40105 |
| 6480 GTGGCAGCCATAGCTGAAAGT | 18138 GGGGACACAACTACTGATGGATAC | 29122 TGCCCAGTGGCAGCCATA | 40106 |
| 6481 CAGCTCGTTCACGTCTCAGTCA | 18139 AGGTGAGAAGCAGGGCAAAG | 29123 TGGACTTCCCCAGCTCGTT | 40107 |
| 6482 CCCTGCTTCTCTGGTGCATTG | 18140 CCCATGCATCGAGACACTCTTTC | 29124 GGCAAACATCCCCTGCTTCTCT | 40108 |
| 6483 TCCCACTTTGGTGAGACAGGAA | 18141 CTGGAGAAAGACATTGCTCCCATCA | 29125 TGCATAGCTCCTTATCCCACTTTG | 40109 |
| 6484 GGCAGTAGTAGGGTGCTGATTC | 18142 GACCTGGACATAAGAAGGAAGTTCT | 29126 TCGTGGGCAGGCAGTAGTA | 40110 |
| 6485 GGTTGCCATAGCTGCTTCCTCAA | 18143 CCAACAGGAATTAGAAACTCCACATC | 29127 CCTGGGAACTTTCTGGTTGCCATAG | 40111 |
| 6486 CACAGTGCTGTCCTAAGAATGTGT | 18144 GAGCATCACAGCTCCCATGTTCA | 29128 CAATTAAGCATCACAGTGTCTGTCCTA | 40112 |
| 6487 GTGGGCCACTTGCCTCTTT | 18145 GACCACTGACAAATGCGTGAAG | 29129 TGTCCAGCTGCGGTGAGT | 40113 |
| 6488 GCTCCTGATCTGAGAGAGAAAGTGTGT | 18146 TCCGGTAGTGCTCCCTCTGTATG | 29130 GCCAGTGGCCTGATCTGA | 40114 |
| 6489 GTGGTGAAGTGGATTCCTCTCTGAT | 18147 GGGTGCTCCAAATGCCTGAA | 29131 GCTCCCCTGAGATTGTGGTGAA | 40115 |
| 6490 GCCTCAAGGCCTAAGAATATCAGT | 18148 CCTCAGCTGACATTGTGTAATGCTA | 29132 TCTTCAATTGCCTCAAGGCCTAA | 40116 |
| 6491 GCCCCTCCTCCTTACATGGATAAC | 18149 CCATGCCCGGCCTGTTTGTA | 29133 CCAAGTAATTCTGCCCCTCCTCCTT | 40117 |
| 6492 CGCAACCAAACACCCTTATTACTAGAGA | 18150 CCTTTAGGGAGCATCGGGAATC | 29134 CCCTCGCAACCAAACACCCTTA | 40118 |
| 6493 GGAAGTCTATGTTTGAAAGGAAGCCAACAT | 18151 GCACAAGCAGCAACATTTCCTT | 29135 TGGTGTTCGGAAGTCTATGTTTGA | 40119 |
| 6494 CAGGTTGTAGGTAAAAATGGGGTCAGA | 18152 TTGTCATACATGCCGTCGTTCGTA | 29136 GCTGAGTAAGATAGCTCAGGTTGTAGGTA | 40120 |
| 6495 GCCCCATCCATTTAGGATACT | 18153 GGCTGGAAAAGGCAACCTACTCT | 29137 TCCACAGCCCCATCCCATTT | 40121 |
| 6496 GCTAATCTTACAGGAGAGTATGGGAAAC | 18154 GGACAGCACTGAAGGACAAGGAGTA | 29138 GAAGGCTGTCAAACTGCTAATCTTAC | 40122 |
| 6497 GTGAGCCATTTGAGACTGGAAAAA | 18155 TGAGATGGTCACATCCTGTTCTCTAA | 29139 GGAGCATGTAAGCTAGTGAGCCATT | 40123 |

FIG. 36J10

| | | | |
|---|---|---|---|
| 6498 GGTCCGTCCTATGTCCTATTCCAA | 18156 CTCCCCTGTCAAAACTTCCTCTTGA | 29140 ATGCGGAGGTCCGTCCTATGT | 40124 |
| 6499 GGTGAGGCTTAGCCGTGTTCT | 18157 GCCTGACACCTGAATTTCTACCTTGT | 29141 TCAGGAGTCCAGGTGAGGCTTA | 40125 |
| 6500 GCAGCCCTCTACTGGTTTATGGAA | 18158 CCTTCTGGCCCTAACAGGTTCT | 29142 AGCTGTTGCAGCCCTCTACT | 40126 |
| 6501 ACTGCCGTGGAAACATCAAGT | 18159 CTGTCACCACAAGCCACCATCA | 29143 GGATAGTGGAAACTGCCGTGGAA | 40127 |
| 6502 GACCACCTAGGGGATCAAGGAA | 18160 CCTAGGAGATGCTTTAAGGATGATGT | 29144 AGGCCTGAAGATATGACCACCTA | 40128 |
| 6503 TTTCACTACTGCTGTAGGTATGCTT | 18161 GGCTCTGGACAAGGAAGACAGA | 29145 CCAGAGCTGTAGCATTTTCACTACT | 40129 |
| 6504 CCACACTCTCAAGATCCTGTTGGTTA | 18162 GAGGCTCTGCAGAATGTTCCTAA | 29146 AGGCTGTCACCACACTCTCAAG | 40130 |
| 6505 GTGTCAGACATGGCGGCAAAT | 18163 GCGGCTGCACAATTAGAGTAGAGA | 29147 GTTCCCCAGGAGGTGTCAGA | 40131 |
| 6506 GTGAGTGCCTCTATCTGGAAAGGAT | 18164 CTCAAAGGCCCAGGTCTATCTGATG | 29148 TCACTGGAGTGAGTGCCTCTAT | 40132 |
| 6507 GTTGGATGCCTAATGATTTCCCTTCA | 18165 TCCTCTCCTCAAACAAGGGATATTTG | 29149 GCCAAAGCAGCACTGTAAGTTG | 40133 |
| 6508 GGTGGGATGCTTTACGCAGAGA | 18166 GGGAGACTGCATGTATTTCTGTCTGT | 29150 GGAGCCAGGTGGGATGCTTT | 40134 |
| 6509 GGGGTTCTGTTTTCTCCCATTCTTC | 18167 GTGATGGGCCTGAATCCAGTATTATG | 29151 CCATGACCTGTGGGGTTCTGTT | 40135 |
| 6510 CCTGGCCATCAAAGTGGGACTTC | 18168 AGGAGCCCATACATGGGGAAT | 29152 AGGCCACTCCTGGCCATCAA | 40136 |
| 6511 GAAGAACACCATTGGATCACAGAAC | 18169 CCTGGGCTTGTGGCCATATT | 29153 GGAGAAACAGAGAAGAACACCATTG | 40137 |
| 6512 GCCACTCTTGGGCCTGATACATT | 18170 GCAGTGAATCCCTTGCAAAACT | 29154 GCCAGATGATCAAGCCACTCT | 40138 |
| 6513 CTCCATCCTCTCTCAGAACCTCAGTT | 18171 CTCATCTGGTCCAAGCTTCTGT | 29155 CTGGGACTCCATCCTCTCTCA | 40139 |
| 6514 GAGACGCTCTCCCATATCCAGTCTA | 18172 GGCATGTCACACACTCCTACAT | 29156 CACGGAGACGCTCTCCCATA | 40140 |
| 6515 CCGTGGCACAGAAAGGAGATGT | 18173 GGTTCAAATCCTGGCTCCACTATC | 29157 AGAGAAAACCGTGGCACAGAA | 40141 |
| 6516 GCCAAGACTAATCCTGATGGAGTGAT | 18174 CCTCAAGGGACCCAATTTGAAGA | 29158 TGGTCAAGGACTGCCAAGACTA | 40142 |
| 6517 GGGAGAGTAGGGATTTTACCTTTTGCATTC | 18175 TCCGTTTTCAGGGCTGGGATA | 29159 AGCACAAGGAGAGTAGGGATTTTTAC | 40143 |
| 6518 GTTTCACGAACCTAAATGTGGTGAT | 18176 GGAGGCGAGAGTCCTTTCCTTTTG | 29160 GTTTCCAGGAGTTTCACGAACCTAA | 40144 |
| 6519 CCCAGCTCCATGGCAAACAT | 18177 CCCTCCTGGTGTCTTCCAGAAA | 29161 AAGACTGTGGCCCAGCTCCAT | 40145 |
| 6520 AGGGCCAGGTAGCTTACTGAAG | 18178 GACTCTGCTTTCACGGATGGGATT | 29162 AAGTGGTGGAAGGGCCAGGTA | 40146 |
| 6521 CCGCAGTGTCCACCTCAGT | 18179 AGGCTGAGGACTAGGCTCTGAT | 29163 AACCTCACAACCCGCAGTGT | 40147 |
| 6522 ACAGGTACAGCCATACTCAAAAAGTAG | 18180 TCCCTGGTACACCTTTACACAAATC | 29164 ACAGAGAACAGGTACAGCCATACT | 40148 |
| 6523 GCCACTGGGAGATGTGTCATAAAC | 18181 ACAGCTAGGCCCTGGGAAGAT | 29165 TCAGCTAGCCACTGGGAGATGT | 40149 |
| 6524 AAGAGAGCTTGGGTAGACAGTTTC | 18182 GGAGGAGGTGGTGGACACAAAT | 29166 CGTGTGCTAATGAGGAAAAGAGAGCTT | 40150 |
| 6525 GGCCTTTGCACGTGGAGTTT | 18183 TGGAGCTGAGACCTCTGGGAT | 29167 TCTAATGGGGCAGGGCCTTTG | 40151 |
| 6526 TCTCAGCTCCCAGGATTTCTGT | 18184 GAGGAAAAACACAGGGTGAGGGTTT | 29168 CCACTCCTCCTTCACCTCCTTTCT | 40152 |
| 6527 GGTCGGGAGTGATGGGTTAGTGA | 18185 GCAGGACTGCCCACCACAAG | 29169 ATGGCGCAGGTCGGGAGTGAT | 40153 |
| 6528 GCCCAGGACTGATGACAGGTA | 18186 TCCAGGCCTCCAGGACTTT | 29170 TGTGTGGAGCCCAGGACTGA | 40154 |
| 6529 CTCTGCACTTCTACCCAGGCAAT | 18187 GGCTACTCACTCAAGACCTCTGTCAA | 29171 TCCCGAAATTCATCTCTGCACTT | 40155 |
| 6530 GAGGACTATATGTGGGAGTGCTTGA | 18188 GGGAACCCATTTCCGTGTGTTG | 29172 TGATCTGATCTTGGATGTGAGGACTA | 40156 |
| 6531 GTTGCCTCTTTAATGCTCTGCAAAT | 18189 GCACTCAGAGGAGGGGTGTGTTAT | 29173 GTCCCTAACACCATGTTGCCTCTT | 40157 |
| 6532 CCTTTTCAGTGTACCCAGGATTCAT | 18190 ACATGGCAGGCTCCTTCACT | 29174 GCTTCTGAGTGCTTCCTTTTCAGTGT | 40158 |
| 6533 TCATGTGCCTCAGAAAGTCATTGT | 18191 GTGTGTTAGATTCTTCCCTGACATTGTTTC | 29175 AATGGGATTATCATGTGCCTCAGAA | 40159 |
| 6534 CAGATCCCTCTGCTGGTACAGA | 18192 AGCACTGGTCTGGAAGTGAGA | 29176 TGGGGTAGTGAAGGATTGATTCAGA | 40160 |
| 6535 GGCTTTAGTTGGGTGGCGTAGT | 18193 GCATTATGCCAACGTGACGTT | 29177 GGTCAGGAACCAAGTTTAGGCTTTAG | 40161 |
| 6536 CCCATAGCACAGACCAGTTGGATGA | 18194 AGGCACGCACCACCATGA | 29178 GAAAGAGTCACCCATAGCACAGA | 40162 |
| 6537 GCAGGGGTTGGTTTCATTTTGGAT | 18195 CAAAATACACCACTGGCCATAACTT | 29179 TTGTTTTGCAGGGGTTGGTTTC | 40163 |
| 6538 CATCACTCTGTCCTCGAGTAGGTT | 18196 GCCACCACACCCAATCTCAT | 29180 CTGCAGAGAAATCTGTCATCACTCTGT | 40164 |
| 6539 CGAGAAGAAGTAAGCTGGGATACAGA | 18197 GGTGACAGGTTAGTGATCGTGTGTT | 29181 GGACAAGACAAGTGCGAGAAGAAG | 40165 |
| 6540 CTCCTGGTGGTTTGACTCATCCTA | 18198 GCCAAGAGCCAATGGCAAAAG | 29182 CGGTTTTCTCCTGGTGGTTTGA | 40166 |
| 6541 GTCTCATCAACAGTCACCTGTCA | 18199 CGCTAGTTCATTCACCGCCTTCTT | 29183 CACGGCTGGATGTCTCATCAAC | 40167 |
| 6542 GTTTTAAGAACCCAGTGAGTGACAAGA | 18200 TCCACAACCCCATGCTGTTAC | 29184 CTGGGGTCCAGTAAGGAGTATGTTT | 40168 |
| 6543 CTCACACCCCTTGTAAGCCATTG | 18201 CCAAAGCAAAAGCCTAACCTTATGAAC | 29185 CAAATTCTAACTCTCACACCCCTTGT | 40169 |
| 6544 GGGGCTAAGATTCTAACCCAGAGTTTGT | 18202 GGATTCCTTTCCAGTAACCAAGACAAT | 29186 CCGGTGGGGCTAAGATTCTAAC | 40170 |
| 6545 GGCAATAGACAGCATCTAGAATCCAT | 18203 CAAGTTGTCTTTATTGCTGCTGCTT | 29187 TACCGCAAGGCAATAGACAGCAT | 40171 |
| 6546 CCAGCAGGAATGTTAGCACTCACCTA | 18204 AGGTTACTTACAGTTGGAGGCTTAG | 29188 GGCATAGCCAGCAGGAATGT | 40172 |
| 6547 GGTCTGCAGCAGTTCTAGCTCTCA | 18205 CGACACACGTCCACGAACACAA | 29189 TCCTGGGGTCTGCAGCAGTT | 40173 |
| 6548 GACCCTCCTGAAGATGTTTCTACTCT | 18206 GGCAGCAGCTGTCCTGTGTA | 29190 GAGCAGACCCTCCTGAAGATGT | 40174 |
| 6549 TTACATTGACAGCAGGGAACAGAT | 18207 GGGCTGTGCATCTTAGGGTCAT | 29191 GCTGAAGTGCAAGAGGATCGTA | 40175 |
| 6550 CTGGTGTTCCCAGTTCAGAAGCAT | 18208 CATGACCACTGTGACAAAACAAGACT | 29192 CCTGGGATGGGAAACTGGTGTT | 40176 |
| 6551 CCTGCCTGAAGGTCCCTTCTTA | 18209 GTGTGCTCTAAAAGTGGTCTGTAAGTGA | 29193 GTTAGTTAGTTCCTCCTGCCTGAAG | 40177 |
| 6552 AGACCCCAGACACTGAAGGAA | 18210 GCCCCGAAACCCTAGTCCTTTCT | 29194 CCAAATTGTGACTAGACCCCAGACA | 40178 |
| 6553 GGCTCAAGTCTGGAGGCATT | 18211 CAGGACCAGCAAGTGGGTTCA | 29195 GAGTTGTTTCATTTGGCTCAAGTCT | 40179 |
| 6554 CTCTGGCCCTGGTAGTAAATGAGT | 18212 ACAGCAGCCTTACATAACCTTTCA | 29196 GCTCATGAACTGTAGGCCCTTCT | 40180 |
| 6555 GGACTTTCTTTACCCTCATCCCTTGT | 18213 GGTTACAATATTTGCAGGAAGCCAAGA | 29197 TTAGCCCAAGTACAGGACTTTCTTT | 40181 |
| 6556 GCACCTACCAGTTGTCAGAAACA | 18214 GCCATTGCCTTTTGCCTCAGTA | 29198 CCACTAGATAACAATAGCACCTACCAGTTG | 40182 |
| 6557 GACCAGTTCACTTGTCCACTGTA | 18215 CTGTTCATTTGGCCCTTTTGTATGA | 29199 GCCCTGTAGGCCAGTTCACTT | 40183 |
| 6558 CCTGCTCATGGAATGTGGTTGA | 18216 GCAATATACTGAGAGTGACTTGGGTGATT | 29200 CCACAGTTAACCTGCTCATGGAA | 40184 |
| 6559 CAGCGTCTTTTACCTACGTTTTGTTC | 18217 GGGGCTGCTTCCCAGGTTTAT | 29201 GCTCCTGATGAAATTTTCAGCGTCTT | 40185 |
| 6560 GGTGTCAGACATTTCTGGGTACT | 18218 GAGGTCCTCTCCGTGATTAAATAG | 29202 AGCCGATTGGTGTCAGACATT | 40186 |
| 6561 GTCAGATCAACCCATTTATGCCTGAGA | 18219 CCAAGGTCTGATCACAAAATTCA | 29203 GATGAGAAGAGTCAGATCAACCCATT | 40187 |
| 6562 GGAGAAATGCTGTTGCAGACTCTA | 18220 AGAGCTGGACCTAAAAGCAAACA | 29204 GGGCTATGAATTAAGGAGAAATGCTGTTG | 40188 |

FIG. 36K1

| | | | |
|---|---|---|---|
| 6563 GGGGCTGTTAGGTGGCACAA | 18221 GGGTCTGCATGATATGCTGGTA | 29205 CACCTCTATGTGGGGCTGTTAG | 40189 |
| 6564 GAGAATAACCATGATGGAGGGGAAA | 18222 TCACAGAGACTGGGTCGATCT | 29206 GCTTAGGTGAAGGAGAATAACCATGA | 40190 |
| 6565 GGTTCCCCAGATCAAAGAATCGAAGA | 18223 AGCAGAGAACAGAGTAAATGACCTATC | 29207 TCAGAGGGTTCCCCAGATCAA | 40191 |
| 6566 CTCTTATGCCCTTGGCCATACTCT | 18224 GATCTCTGGGAGTTGAGTTGTTGA | 29208 TGTCTCTCATCCTACCTTGACTCTTA | 40192 |
| 6567 CCTGTATTGGCTGCGTGAGT | 18225 ACCAGGTGGCTGGGTGACAT | 29209 GGACCAAACCAACTGAAAACCTGTA | 40193 |
| 6568 GGGTAGAGGGACTGGTCTACCAAA | 18226 ACTGACCCCAGGAGTTTCATCT | 29210 AGAGGCAGGGTTGGGGTAGA | 40194 |
| 6569 CCACTGTTTTCTCAGAGCTTCACTT | 18227 TGGCCTGACTCTCCCGATTTG | 29211 TTGACTCCATGTCCACTGTTTTCT | 40195 |
| 6570 GAGTTGATCCAGGATTCGGTATTTTG | 18228 CCTGGGGCTGCATTTGTTGCTA | 29212 TTCAGTGGGAGGGAGAGTTGA | 40196 |
| 6571 GCTTCTCCAGCATCACGTCTCT | 18229 CCTCACTCAGGAAGAATGTGTCCTT | 29213 CCAGATGACTGCTTCTCCAGCAT | 40197 |
| 6572 GACGAGGTTTAATCAACTAGCTGTGACATT | 18230 GAACGTTTGGTAAGGCAGACATACA | 29214 GGAAAGACAGAGGACGAGGTTT | 40198 |
| 6573 ACCAGGGGAACTAAAGATGACAAG | 18231 GGTGGGTAGCCATCTAGGCTTTTG | 29215 GCTGGAAAACCAGGGGAACT | 40199 |
| 6574 GGGGAAGGCCTAACACTAAGGTGAT | 18232 CCCAGGAACAGTAAAGCATCATTC | 29216 TGCAGACATGGGGAAGGCCTAA | 40200 |
| 6575 TTCCTTGGTCCTCCGAGGCATA | 18233 TTCTGGGCCTGCCTTTGACT | 29217 GCCAAGATTGAGCAGCATTTCCTT | 40201 |
| 6576 AGATTATCTCTGCTTGGATACCGATTC | 18234 GCATTTCACTAGAGATGTGGGCTTCA | 29218 ACAAACACTTGCTACACTGAGAGA | 40202 |
| 6577 GGTGGTGTTCGGCCTGATCTT | 18235 GCACGGTGATCACTAGGCTGTT | 29219 TTCGTCACGCTGGTGGTGTT | 40203 |
| 6578 CGACTCTGAGCCAAAACCCATAG | 18236 CACACCAGTCTGCCTGAGTACA | 29220 CCACCTGGGAACGACTCTGA | 40204 |
| 6579 GTGGGAGGATGACTTTGGAGCTATG | 18237 CCACAGAGCTAGGAAACTCGTGAA | 29221 GGCAAGTACTATTCTGTGGGAGGAT | 40205 |
| 6580 TGATAAGTGCCTTCTGCAGGTTTT | 18238 GCCTTCCCCAGAGGAATGTTGT | 29222 TTTGTACAGGGCTGGTACTATGATAAG | 40206 |
| 6581 GGACTGAGTAGGGGATGGCTTGA | 18239 CGACCAGCCCCATCCTGTTTTT | 29223 GCTGAGGTTTTCACATTGGGACTGA | 40207 |
| 6582 GACCCCGTTTAGTCCTAACCTCAATC | 18240 TGTAAGGCGAGGAGGACGAT | 29224 GCTGCGGACCCCGTTTAGT | 40208 |
| 6583 GCCCCTACTTTGGGACAAGAACA | 18241 GCCCTTAAAGATTAGGGTGAGCATGT | 29225 GCTGCCTTTATTAAGCCCCTACTT | 40209 |
| 6584 GGATACAGAAGATGGGAGGCATAG | 18242 CAGTCTTCCTTTGCTCCTAACCAA | 29226 GTTAGCACAGCTGACCTAGGATAC | 40210 |
| 6585 TGTACTGGCGAAGAAACAGAAAGT | 18243 GAAATTCCCCTGACGTTCTTTCCAA | 29227 AGAGAAGAATGTACTGGCGAAGAAA | 40211 |
| 6586 CCGGACTAACAGGGCTTGGTATCT | 18244 GCTTCCCGTCTCCCCAACAA | 29228 TGCCAAGGGCCGGACTAACA | 40212 |
| 6587 GGCCTCCTTGTGTTTACTTGTTG | 18245 CATGTGTCTGGACTTGTCAGATGT | 29229 AGTATCGGGCCTCCTTGTGT | 40213 |
| 6588 CAGCCCAGTGATTGTCCATCTTC | 18246 AGCGGGTAGGCCATGATAGAGA | 29230 GAGGCAAATATCAGCCCAGTGA | 40214 |
| 6589 CTCACCTGTCTTTGCAACTTTGGTT | 18247 GGCTGTAAACAGAGGCATTTGGTA | 29231 TGGGAGCCTCACCTGTCTTTG | 40215 |
| 6590 CAGTGTGGGTAGAGGGCAAGAA | 18248 GGAAAGGGTAGTATTGGGATTACAGACA | 29232 CATTTCAAAGGCAGTGTGGGTAGA | 40216 |
| 6591 TCCACTGGTCTATGGCCTGACA | 18249 GCACCGGTGTAAGAGCAAAC | 29233 CCTTCCACGTCATTCCACTGGTCTA | 40217 |
| 6592 CCAGGGAAGCTACTGATGTGGAATTA | 18250 TGGGGAGGAGCCAGGATCT | 29234 GGACTTGCCAGGGAAGCTACT | 40218 |
| 6593 GCCAAGGACAGATGTGATCTGATGTA | 18251 AGTCGTGCTGTGGGACAGT | 29235 ACATAAAGCCAAGGACAGATGTGA | 40219 |
| 6594 ACCTCTGCAAACAAGGGATTGA | 18252 GCTGGAAGATTTTCTGCCTTTTCA | 29236 GCAGCAGCCCAGGGTTAAA | 40220 |
| 6595 CTCCTAACCCACAGAGGAGTCT | 18253 TCTTTTTCCCTCTCTGGGGATCA | 29237 GCCACAAACCTCCACTCCTAAC | 40221 |
| 6596 GCTGGTTCGTCCCCTATTCATC | 18254 AGCCTTCCAAGGAAAAGAAAGGAA | 29238 CCTTCTAGGGCCTCTAAGCTGGTT | 40222 |
| 6597 GAAAGAGCCAGAAGACTCAGCAT | 18255 GCTGGAACAAAGAAAGCAGGAGAA | 29239 TCCTGCACGTGAAGAAGAAAGA | 40223 |
| 6598 GGCCCAATAGGTGCTGACCTT | 18256 GCTGGGTTTCCCTCTAGCTGTT | 29240 CCTCTCTGGAAAACTGGCCCAATA | 40224 |
| 6599 AGTTGAGAACTGGGACATTAAGGTATG | 18257 AATAGCCATTCCCTGAGCTT | 29241 GTCCCTGGGGCAAAAGTTGAGA | 40225 |
| 6600 CCAGTTTTGAGGATCACAGTGACA | 18258 TGGAGCTCCCAGCCTGGTATAA | 29242 GGAGCTTCTGGCATCCAGTT | 40226 |
| 6601 GCACCAGGATGTATGATGGGAGGTA | 18259 GCCTGCAGCTGGCTCTCTA | 29243 ACTATGTGGAGCACCAGGATGTATGA | 40227 |
| 6602 CTGGAGACATCCACGCCATTCA | 18260 GCCCTTAGAGTATACTGGGCTCTTTC | 29244 TCGACGACACCACTGGAGACA | 40228 |
| 6603 CCCTTGAACTTGAGCCCTTTCCAA | 18261 GTCAAAGCTGCAAAAGGGCAGATAAC | 29245 CTGCAGAGTGCCCTTGAACTTG | 40229 |
| 6604 ACCTTCCTGGTGCCTGTGATG | 18262 TGTAAGGCTTTCTGGGATAGGAGAT | 29246 GCTTTAGCTACTGTGGTCACCTT | 40230 |
| 6605 GCGTGGAGATCTGGGCATTAAG | 18263 CCACCCCAGGATGTAAGGTACTCA | 29247 AGCCAGCAGAGCGTGGAGAT | 40231 |
| 6606 GCATCCACCCATCTTGAAAACTTC | 18264 GACGTCAGGCATAGTGATGGAT | 29248 GGCAAAGCATCCACCCATCTT | 40232 |
| 6607 GCCACCAGATGGATGGCTATTCT | 18265 GAGGCCAGTGCTGATCACCTAA | 29249 TGAGCCTGCCACCAGATGGAT | 40233 |
| 6608 AGCTTCTGTGATGAGAGGACACT | 18266 AGGCAGACGGAATGAACTTTCT | 29250 GGGGAGAAATTCCAGCTTCTGA | 40234 |
| 6609 TGAGGAAGAACCAGGAGACTCA | 18267 AGCTCCCCAGGAGAAAGGATCT | 29251 AGCCATATGTCTCTTTGAGGAAGAAC | 40235 |
| 6610 CCCATGTCACTCCTTTTCGTTCCTA | 18268 GCATGTGCCAAGGTCCTGTAAC | 29252 CCCCTACTCCCATGTCACTCCTT | 40236 |
| 6611 GAGTCCCCTTGTGTAAGAACCATCTTC | 18269 CACAGCCTGTCGGCATTCTA | 29253 CCCTTGTGTAAGAGTCCCTTGTGTAAG | 40237 |
| 6612 GAGTCATGAGGTCCTGTTTCATCT | 18270 CCTACAGTTGATGCCAGGTGTTG | 29254 CTCCCACTATCACTGGGAATGAGT | 40238 |
| 6613 CCCTCTGATTATGACATCTCTAGGGAACA | 18271 CTGTGGAAGGGTATGCCTCAGAAG | 29255 GCCCACATTTCTACCCTCTGATTATG | 40239 |
| 6614 GCTCTTCGAGTCATTTCTGGTCATTC | 18272 GGGTGCTTTCTATGGGCAAAAG | 29256 GATAGTAATGCAGCTCTTCGAGTCA | 40240 |
| 6615 GGCCAAAGGCTGGTGTCTT | 18273 CAAACGTATCAACCTAAAGTCCAGAAG | 29257 GCCCAGATTCAACTGGCCACAA | 40241 |
| 6616 TGGGACCTGAACAAACCAGGTA | 18274 CACCATAGATTGAGGTGGCATTTC | 29258 ACAACAAACATGGGACCTGAACA | 40242 |
| 6617 CCTGAGCGAGTTGAAGGAATTGTGT | 18275 CTCCTGAGTTCCTGCTTCGTT | 29259 AATAGGACCTGAGCGAGTTGAAG | 40243 |
| 6618 CCCAGCAGCTTTCTTAGTAGGTA | 18276 ACCAGCTGTCTTTTTGGTGTAAACT | 29260 TCACCCAGCAGCTTTGCTT | 40244 |
| 6619 GGCTAGTCCACTGCAGACTGA | 18277 AAGCAAGACTGGGAGAGAGGTA | 29261 CACACACACCCCAGGCTAGT | 40245 |
| 6620 GTGCCCAACCTTGGAGATGGTTA | 18278 CTGGCTCCACCAACTCACCTAT | 29262 TCCTAGCCTGTGCCCAACCTT | 40246 |
| 6621 CTGGGTCTGTGACCTTGCTGTA | 18279 CCATTTAAGTGTGGGCCTTGTGT | 29263 GCACCTTAAGAGCTGGGTCTGT | 40247 |
| 6622 CAAACCCCAAGTCCTCGTTTTC | 18280 TGGGACCCTTCCACACCAA | 29264 TCCCACACCAAACCCCAAGT | 40248 |
| 6623 CCCTCCTAATTTGGGTTGCCTGAA | 18281 CAACCAAGGTTGAGAACTACTGAGTTTG | 29265 AGGCTTCTTGGCCCCTCCTAA | 40249 |
| 6624 CCACTTCTGACAGCTAACCTGCTGTA | 18282 GGGAATGGGACCTTGAGTTTCA | 29266 TGTCTACCTCTCTGCCACTTCT | 40250 |
| 6625 CTGCAGATCGGACCGGATAC | 18283 GGGAATCCGACGAATGGATGAAAG | 29267 AGGGTGTGGGCCTGCAGAT | 40251 |
| 6626 CAAGGTCTGCTTGCTGTGTGATG | 18284 GCAAGTGGAAAACTAAAGCTCAGAGATG | 29268 CTGTGTCTGAGCAAGGTCTGCTT | 40252 |
| 6627 GGACTGGAGTTTCTTCAGAGTAGTTG | 18285 CCAGAATCCACTCACCAGAAAATG | 29269 CCAGCAGAGATGGACTGGAGTTTC | 40253 |

FIG. 36K2

| | | | |
|---|---|---|---|
| 6628 TGTGCGTGGATTTCAGTCATGT | 18286 GGTCCCGTTTTGTGAACCAATAG | 29270 GGATTCCAGAATGTGCGTGGAT | 40254 |
| 6629 CCGTTTGCCTTCAACCCTGAGA | 18287 GACCTTAAGGGCCACCCTAACT | 29271 CGAACCCCGTTTGCCTTCA | 40255 |
| 6630 GGCATCAGCAGTATCCGTTCCTT | 18288 ACCAGAGACAGGCCTGGAACA | 29272 CCGAAATCAAGGCATCAGCAGTA | 40256 |
| 6631 CCCCACATCCAGCCACCATT | 18289 GAAGGTGAAGCAGGAGCAAGTATTAAG | 29273 AGTTCACGGTTCCCCACATC | 40257 |
| 6632 GCTGCATTTGGGTCGTTTTGTTTC | 18290 GTCAGGCGGTGGAATTTTCTGCTA | 29274 GGAGGCTCCTAAGCTGCATTTG | 40258 |
| 6633 GGACTCTGTGCTTTGGCCTGAA | 18291 AGCCGCTCTCAGACTCAGGAAT | 29275 GTCATGGTGGACTCTGTGCTT | 40259 |
| 6634 GGCCTCACACGCACGTTTC | 18292 GACCTTTGAACAGCCTGACTGTAG | 29276 GGTAAGAACCCGGCCTCACA | 40260 |
| 6635 CCTGACCACGTTATTTATTGGTTGGAA | 18293 GCCTGCATCCTTGTTAATGTTGGTT | 29277 GAATATTCCTCTCCTGACCACGTT | 40261 |
| 6636 GCTGGAACAGACCTTAAAGGCAATG | 18294 GGCCTGTTTGAACTGCAAGAAAAG | 29278 GCTAACGCTGGAACAGACCTT | 40262 |
| 6637 CTGGCTTTGGAATCGGTCTTTG | 18295 ACCTGCAACCAAAAAGTCATGAGA | 29279 CGGTGTTACACTGGCTTTGGAA | 40263 |
| 6638 ACAGCGAGGAAAGGAAGGAAATAG | 18296 CAGGCTGCCTTTTGCAGACA | 29280 GATGAAATCCTAACAGCGAGGAAAG | 40264 |
| 6639 GGAAACAAAGCTTGCCTAGAGTTTCT | 18297 CCCCAGCTTGTTTTCGGAGAGA | 29281 CGTTCTTCCCGTGGTGGAAACA | 40265 |
| 6640 GTCCGTGTCAGTGTGTGACT | 18298 CAAGAGAGTGGACTTCAAGACAAAAC | 29282 CAGTCCTAAAGGAGTCCGTGTCA | 40266 |
| 6641 GGCAAAAGCCACGTATTTCTCTCCAA | 18299 CCACAGAATGCCCACGGTAACT | 29283 TGCTGGCAAAAGCCACGTA | 40267 |
| 6642 ACTGTGTGGAGAGTAAATGGGATTC | 18300 ACACTAGCCATTCCAAAGGTAAAA | 29284 GACATCCAAAACTGTGTGGAGAGTA | 40268 |
| 6643 AGCCATTGCGAGACCCTGATG | 18301 CCATGCTGTGTGTGTCTGCAT | 29285 TGAAACTGGGGCAGCCATTG | 40269 |
| 6644 GAGGCCCTGAAGCTGAGAACAA | 18302 GCCTCACACCACTTTCTAGAACACA | 29286 AGAATTTCAAGTGAGGCCCTGAA | 40270 |
| 6645 GTGACCCCTCTTAACCGCAAATG | 18303 TCCAGGGAATTGGGGTAAATCAAA | 29287 GGCCACGTGACCCCTCTTA | 40271 |
| 6646 GGTTTCACCTGTACTAGAGGCATTC | 18304 CACCACTCCTGCCCATGAAGAA | 29288 GCTGACTTGGTTTCACCTGTACTA | 40272 |
| 6647 CTACCCACTGTGGACACATGTAA | 18305 TTGGGGATGCTGCGTTGT | 29289 GTGTGAGAAGGATTCTACCCACTGT | 40273 |
| 6648 ACTCAGGGGCCTTTAGTTATGATG | 18306 GGTGTAACCTGAGACTGGGAATACTTG | 29290 GCTAGAACTACTCAGGGGCCTTT | 40274 |
| 6649 GCCTCTGTACCTCTCTCTGCATT | 18307 CGTGGGGAACCAGTTGTTGCATAA | 29291 TGTCTCTGAGATGAGCCTCTGTA | 40275 |
| 6650 GGCCCAGCCTTAAGTTCATCA | 18308 CCCAGGCTGTGTGCTTTCAA | 29292 GGGCTTCATGTCCACCTCAGAAA | 40276 |
| 6651 CTCTGTCGCTGACACTGGATGT | 18309 TCTGGCGATGGGAAGACCAT | 29293 AGCTCACTCACGGGCTCTGT | 40277 |
| 6652 GTCAGAATGATCCCGAGAGTGAGTT | 18310 CTCAGCCTCCGAGTCCTCATCTAT | 29294 ACGTGCTGTCTGTTTGTCAGA | 40278 |
| 6653 GCTCACACACTGTCTCATTTCAAC | 18311 GTGGGGTTGATCATAGCATCTCCTT | 29295 CCCTCATGCAAAGCACTTGCTCACA | 40279 |
| 6654 CTCCCTTTTCCTCCACGAGGATT | 18312 ACGAGCAGAGCACCTGTGA | 29296 TTCCTCTGGCCCTCCCTTTT | 40280 |
| 6655 CTATGGGCCATTTACCCATTGAAC | 18313 AACTTCACTGCAGTTTGCTAGTT | 29297 TTGGTTTGACTATGGGCCATTTAC | 40281 |
| 6656 CAGGGAGTGTGTGGGTTTGGTT | 18314 GCATGGGCCAAGACATACACAAG | 29298 TAGACTGGCAGGGAGTGTGT | 40282 |
| 6657 GGGGTCACACCAAAGGGATTGA | 18315 CCCCTACTACTGAGAACAGACCGTTT | 29299 AGGCAGGGGTCACACCAA | 40283 |
| 6658 CCCTACATTCAAGGACCAGGTTGA | 18316 CACTACTGCATCTCAGTTCCTGTCA | 29300 CCCTGTGGAATCCCTACATTCAAG | 40284 |
| 6659 CGCTTGCTGACTGTTCCTTTG | 18317 CTCAGCCCATAGACTTCGTGTGT | 29301 TGGATGGCGCTTGCTGACT | 40285 |
| 6660 GGCTTCACAGCTGCAGCAAA | 18318 TGGTCAGAGGGCAGACGAAT | 29302 ACACGGCCATGGCTTCACA | 40286 |
| 6661 CCAGCACTGGAAAGAGTAAGTCATTG | 18319 TCCAGTGTCCCACCTTGGTA | 29303 GGCCTGTTAACCAGCACTGGAA | 40287 |
| 6662 GCAGCTGAACAGTACAATACCATGT | 18320 GACAGTTTGCCAGTCATTATCCACTTC | 29304 AGCCAGAGCAGCTGAACAGT | 40288 |
| 6663 CACGTGGCTTTGCACACAGT | 18321 TGGAGTAGGTGAGCTTGTTGGAT | 29305 TGCCTGGACACGTGGCTTT | 40289 |
| 6664 GGGAAGTTCATCTTCATGGGTTTG | 18322 CATGTCTCTTTTCCACAGGACATTTG | 29306 GAGGGAATGATTAGGGAAGTTCATCT | 40290 |
| 6665 GGAGGCCAAATGCAGATGAGT | 18323 CCCTTCCACTTGGGGCAGAATA | 29307 CTGATGTGCATGGAGGCCAAA | 40291 |
| 6666 GCTGGCAACTGGAAATGGGAAATG | 18324 GCAGAGAAGGGATCAGAAAGACTGT | 29308 GCAGTGCTGGCAACTGGAAA | 40292 |
| 6667 CCTGAGAAGCACTCTCCCTTGT | 18325 GAAGGCAGTGGCTGATAAAGATTTG | 29309 CCTCCCTCCAGCACCATCT | 40293 |
| 6668 TGAAGGAGCACAATTGCAGGAT | 18326 GTGCTGTGGACAAACTTTCCATCT | 29310 CCTTTGGGTAAATATGAAGGAGCACAA | 40294 |
| 6669 CACGTGATACCAACAGTGGATGT | 18327 CCCAGCTCCAGATTCCTGAAC | 29311 GTCTCAGGAAAACACGTGATACCAA | 40295 |
| 6670 GAGCTCACCAGGAAGTATAGCATCT | 18328 GTCAGTTTAACCTGCCCAGAAAGT | 29312 GGGGAGCTCACCAGGAAGT | 40296 |
| 6671 CCCTGTACTCTGCGTCTGTCT | 18329 GTTGTGAAAGATTGGGGATTGTGACAT | 29313 GGCACTGCTCAGATTCTCCCTGTA | 40297 |
| 6672 GTCATCCCTCATCAAGGGCAGAA | 18330 AGGATGAAGGCAGAGAGGACAT | 29314 CAACCCTGGTTGCTCTGTCA | 40298 |
| 6673 GCGAGGGGTATGGGCTAATAGTTG | 18331 GGTACCACCTCCTTTCTTCCAA | 29315 TGTGCTGCTAGCGAGGGTAT | 40299 |
| 6674 TGTCCTGTGTCCCAGCTCTAGT | 18332 GCATGGGCATGTGGGAATTGA | 29316 CACAAATTAGGTAGCCTGTCCTGTGT | 40300 |
| 6675 CCAAAGTGTCACCAGCAGAGACAT | 18333 CCTTCCCATATTGGGTCAGTGTCTGA | 29317 ACCTCCAGGATGCAAGCCAAAG | 40301 |
| 6676 CTGGGGATGAATCTGCTTACCAT | 18334 CCAGCATCCCTACCTTCGAGAAAC | 29318 GGGGACATCTGGGGATGAATCT | 40302 |
| 6677 CAGCGATAACTTCTTCCACTCAA | 18335 GCAAGACAAAGTCCACCCCACTTT | 29319 AGGCTCCAACAGCGATAACTTC | 40303 |
| 6678 GGACCAGCCTCTACTTGCTACTGT | 18336 CCCCATGTTTGCAGTGGAGTTC | 29320 TCCCAGGACCAGCCTCTACT | 40304 |
| 6679 TGTAACCTAGATGACCATGCGTTT | 18337 CGAGGAAGCTCTCCATCTCATTAGT | 29321 GCCCTGATTGCTGTAACCTAGATG | 40305 |
| 6680 GCCAGCTTTTTGCTATTCCTTCCAT | 18338 GCAAGCATCTGTACTTCCTCCAT | 29322 GACTTCAGAGCCAGCTTTTTGCTA | 40306 |
| 6681 AGGGGTTAGGCGGAAAAAGTATG | 18339 CCTGTTTCTGCACTCTGAGTCAT | 29323 CCATGATAGGTTTTGATAGGGGTTAG | 40307 |
| 6682 GGAGAGACAATCAACTATGTCTCTTGTGA | 18340 AGGACCAAGGTTCAGCAGCCTAT | 29324 GACTAATAGGATGGAGAGACAATCAACT | 40308 |
| 6683 CCTCTTTTCCCTACTTCCCACTTC | 18341 GGCTTGGGAGCATTTGCAGTT | 29325 TCATGTCATCCCTCTTTTCCCTACT | 40309 |
| 6684 CACTTGGCCATAAAGCAATTCTCAAC | 18342 CTGTGATTCGTATGACTTTGGGCTTT | 29326 TCAACCACACACTTGGCCATAA | 40310 |
| 6685 GACGGCAGCAGAGGATTTGA | 18343 GAGCTGCTCAGGCTGCTTA | 29327 TCCCGGTATTCGTCGCTAGA | 40311 |
| 6686 GAATGCTGCCAAAGGGAACTGA | 18344 CCAGCTTTGATTCCACACTGATTT | 29328 GCTCAGGTGAATGCTGCCAAA | 40312 |
| 6687 GCAGAGGAAGTTAGAGGTGGGATATT | 18345 GAAGCAGCTGAGGTTCTACCAA | 29329 GCTGGGCTTGCTGTGAAAAAG | 40313 |
| 6688 GTGGACTTTCAGCGCCAACT | 18346 AAGCAAACACCGTATCACTCTGA | 29330 GACTGGGTGTGTGGACTTTCA | 40314 |
| 6689 CTCCTAACTCACGTCCGGGTAT | 18347 AGGAGCCGGTCCTCACTGTAG | 29331 TGCCAAGGTCATCCTCCTAACT | 40315 |
| 6690 CCAAGGGGACATTTAACGCTGTGA | 18348 GTGGATCCCCTCTTCCTGAGTCAT | 29332 ACATTCTGCCAAGGGGACATTTA | 40316 |
| 6691 GACTTTAGAACTCCTGCTACCAACATT | 18349 GACCTGATTGTCCTGGTGGAGGTA | 29333 GGCTAACAGGAAACCTCTAAGACTTTA | 40317 |
| 6692 GGGAGTGGTAAAAGGCTTGGACTTC | 18350 GGCCCAATCAGATGCTTTGGTCAT | 29334 GCAGGGCTGGGAGTGGTAAAA | 40318 |

FIG. 36K3

| | | | |
|---|---|---|---|
| 6693 CAAGGTGTCAGTCTGCCTTGT | 18351 CACCCTTCTACCTTGCCATTAGTAT | 29335 GGAGAATGTCCTCACAAGGTGTCAGT | 40319 |
| 6694 TGCCTGCAGAAGGGGATGTGA | 18352 CCAAACAGTGTCGGGTGTTGA | 29336 TGGGGAACACTGCCTGCAGAA | 40320 |
| 6695 AGGGGAGGAACATGAGGCTGAA | 18353 GCCAAACGTGCTGAGTCTTG | 29337 CCCAGGGTAAGGGGAGGAACAT | 40321 |
| 6696 GGTGGCTTCAGGAATAGGGGACAA | 18354 GGAAGGGGAGGAAAAAGGGAAA | 29338 CAGTGGGTGGCTTCAGGAAT | 40322 |
| 6697 GGTTCTAGGATCTGTCTGGGAGATCAA | 18355 AGATACGAGGCTCGACATTTTACTAAG | 29339 GCCCTGTGGTTCTAGGATCTGTCT | 40323 |
| 6698 ACTGCTCCTAAGATAGGCGATTTC | 18356 CAGCTGGACGCTTGATTAGTCT | 29340 GACCTGATAGCAAAACTGCTCCTA | 40324 |
| 6699 CACCAAGCATACCTGAGTCATACCTA | 18357 CAGGCAGGGCGTGATATGT | 29341 CCCATACGTGCACCAAGCATAC | 40325 |
| 6700 AGCTTCCATCCGTCCCATCTAT | 18358 CCCTGCATCGGTGGCAAAAT | 29342 CAGGGAAATCCCAGCTTCCAT | 40326 |
| 6701 CGATAGCTACCCTTGCTTTTTCCTCTT | 18359 GGCCAGCTTTGAGTGTTACAGAAC | 29343 GAAACCGATAGCTACCCTTGCTT | 40327 |
| 6702 CCTGCTCTAGGCTGCAAGTGTT | 18360 CCAGCAAACACACCAAGGAAGT | 29344 ACCCTCGGCTCCTGCTCTA | 40328 |
| 6703 CTGGACTCCTGCTGATAGAGTCTTG | 18361 CAGGGATCAATAAGGCACTTGGAGTA | 29345 CCCCTGGACTCCTGCTGAT | 40329 |
| 6704 GCCCTTGATCCTCCTAGGCTATTG | 18362 GAAGAAACAGAGAGCAACTGAGACTT | 29346 CCCTGCAAATACTGCCCTTGA | 40330 |
| 6705 AGTGGCTGAGAATGAGACCTCTA | 18363 TGCCCTTAAACCATGGCAGATG | 29347 GGGTTGCCAGTGGCTGAGAAT | 40331 |
| 6706 CCTGTTGGTCCAAATCCTTACTGA | 18364 GAGCAGTTTGGAAGAAGTCCTATCAT | 29348 TGCAGTGAGGGTTCCTGTTG | 40332 |
| 6707 GACTGTGGTTTCAACACCTTATACCTA | 18365 GTGAAAGATTTACCCCTTATGGTCCTA | 29349 TGCCTGCTTGACTGTGGTTTC | 40333 |
| 6708 CCTTCTGGCTAAATCTACCTGCTCTTC | 18366 GGCTGAGGCAGTCAGAGTGT | 29350 CAGGTCTCTCCTTCTGGCTAAATC | 40334 |
| 6709 CCATGTGAGGTAGATAGGATTTGCTCTAGT | 18367 GGGACCTCTAGGGTTTCAGCTTCT | 29351 CTGCATCATAACCATGTGAGGTAGA | 40335 |
| 6710 CTCACAGGCCAGGGATTTCAGA | 18368 AGTGGGAACTTCAGAGCTAGACTT | 29352 CGGCAGCCTTCATTCTCACA | 40336 |
| 6711 GAGCTTGAGATCCTTTCTGAAGAAGTT | 18369 CGAATTCCTTGTCCTTGTAGCCTTTC | 29353 CAGCTTGAGCTTGAGATCCTTTCT | 40337 |
| 6712 TGTATTTGGGTGCATGAGTTGGTT | 18370 CTGAGATAGGTCATCTCTTGAAGACAGAGT | 29354 GGGGAAACTGCACCTTGTATTTG | 40338 |
| 6713 GGGTCCCTAATTTTGGTGATGACT | 18371 GCTAGCAGAGCTCAGGAAAGTTG | 29355 TGCTGCTGATGGGTCCCTAA | 40339 |
| 6714 GCAGCCATTGTCTGTAGGACTTGAT | 18372 ACACATGACTGTAGCCAATTCCTT | 29356 ACTTCAAAGCAGCCATTGTCTGTA | 40340 |
| 6715 GCAAGCTCATTTGCAAGGTAGAGAAC | 18373 TGCTCTTAGAAACCAAACCAACTCT | 29357 CTGTTTCATGGTTGCAAGCTCATTTG | 40341 |
| 6716 CCTTCTTGAGTCTGATCACTCGTT | 18374 AGGAGACATGGGACAGGTATGTT | 29358 GGGGTCTCCTTCTTGAGTCTGA | 40342 |
| 6717 GGGATTTCCCACACTTCTCCTCTT | 18375 CCAGGGCTACACAATAGAGGTTTCT | 29359 CCTGGAGGGATTTCCCACACT | 40343 |
| 6718 CCACCTCGAAGCTTTAGTACCCTAAG | 18376 GGAAGGAAGAGAGAAGCCTCAGTATC | 29360 GTACTCATCCACCTCGAAGCTTTA | 40344 |
| 6719 GACCATCCACAGACTTAAAGAGGAA | 18377 GCTGAGGACGGCTGCTTGATA | 29361 GCCTGTGATGGCTTTCTGTTGA | 40345 |
| 6720 GCTCCAGCCTAGATACAACACTTG | 18378 CACATGACCCGTTCTGGGTAAC | 29362 GCAGTTCAGTGCTCCAGCCTAGAT | 40346 |
| 6721 GACAGCCAGCTAACACTGTGGAA | 18379 GACCCTTGAAGGAATGTAGGCAGTA | 29363 GCCTCAACAGACAGCCAGCTAA | 40347 |
| 6722 CCACGAAACAGGACCATGACA | 18380 GCATACATGCTTCACTGCACTTC | 29364 AATGGTTGAGTCCATCCACGAA | 40348 |
| 6723 ACCCAGACACGGCTTGACTCT | 18381 CCCCTTTGTCATTGAGGAAAGAGTTT | 29365 ACTGAATTCCACCACCCAGACA | 40349 |
| 6724 CCACCGTCTATGTCAACGCCATT | 18382 GAAGGTCACTCTGGCTTCATTGT | 29366 GACATGAGGACCACCGTCTATG | 40350 |
| 6725 TGGAGGCAGAGGTTTAGAGAGAA | 18383 CCTGGGTTAATTCCCTTCCCACTCT | 29367 TGGAGAAATGGAGGCAGAGGTT | 40351 |
| 6726 CTGTCACCTCTTTCGTGGTACAGT | 18384 CACGTTCATCATAGCTTGTCAACACT | 29368 GGAACTGGATGCTGTCACCTCTTTC | 40352 |
| 6727 GAGGCGAGATAGAAAGTAGTTGGTGAA | 18385 GGTTCCTTCCCATGGCTACACT | 29369 GCTCACACTACTGAGGCGAGATAG | 40353 |
| 6728 GTGGTACTGAAACCCCAGTTTAGCTT | 18386 GAGGAGTTCCCAGTAATGCAACTAT | 29370 CTGCTGGTGGATGTGGTACTGA | 40354 |
| 6729 TGCCTTAGTGCTGGCCTCTCT | 18387 CTCACTTAGAGTGTTGCTTTAACTCCCATT | 29371 GGGAAGGGCTTATCTGCCTTAG | 40355 |
| 6730 ACCAAAGCCGTGTATTCGTTTATTC | 18388 GTTTACACCCTCAGTCTACACAAGAA | 29372 AACCCAACCAAAGCCGTGTA | 40356 |
| 6731 GGACCAGGTTTCTAGCAGTGAGA | 18389 GATTTCACGGCAGAGGTGTGT | 29373 CCCTGTCTGTAGGACCAGGTTTCT | 40357 |
| 6732 CACACAGCCATGGACATTCAGA | 18390 ACTAGCTGGAATGGTGGTAAAGAATAC | 29374 GGACAGCAAAATACGCCAATATCACACA | 40358 |
| 6733 GATGTAATGCTCAAGAGGCTGAGA | 18391 TCTTCTGACAGCAGTGCTACTCTA | 29375 ACCCCAGTAAAGATGTAATGCTCAAG | 40359 |
| 6734 CACCAGAAGCAGTTTGTCTTCAGT | 18392 CCCTGAGTTAGTTCAGTGAAGGTGTATTG | 29376 TGGTAAAGATCACCAGAAGCAGTT | 40360 |
| 6735 GCAGTCACACCAGGCTCAAATC | 18393 CAGGTTACTACTGCTGGTGTGCTT | 29377 AAGGCCTGGGCAGTCACA | 40361 |
| 6736 CTGGCTGCAAATATGTGCCTGTTAC | 18394 CTGGATGAATGGCTGTACACACAGA | 29378 TGGCAGCTGGCTGCAAAT | 40362 |
| 6737 CCCAAAGTCATCAATTCTTCCTGAGA | 18395 ACTGCTGTTTGGGGATAAGCAT | 29379 GGGCTCCTCCCAAAGTCATCAA | 40363 |
| 6738 CCCTACCTGCATCTCCTCAAAG | 18396 GCAAAACATGGCCTCTAAGCCTGTA | 29380 GCATTTTACTAAACCCTACCTGCAT | 40364 |
| 6739 AGAGTGGCAGCAGTGGGAATAG | 18397 GGCTTTCCAAACACGTCTGGAGTT | 29381 GGCCCCGTTGGTGATATGATGAGA | 40365 |
| 6740 CGGTTTTACCCTGAAAAGAAACCAAAC | 18398 CTCCCTGCCTGTGCCTCTATTT | 29382 GGCCTAGAATAACGGTTTTACCCTGAA | 40366 |
| 6741 ATCTGAGAAGTAGCACTAGGGAGAA | 18399 CCAATTAGTCTGTCAAGGTCCCTTTC | 29383 GTGAGTCACTGGCCAATCTGA | 40367 |
| 6742 GCCTTGACAAACAATGTGAGCAAT | 18400 GGGATGGGAAGAAGGGCTTACTA | 29384 CACGAGAAAGCCTTGACAAACAA | 40368 |
| 6743 GTTTGCCTCTTGGGCTCATTG | 18401 TGGACCTGGAGGCAGTAACTTG | 29385 GGCCTGACAATGTTTGCCTCTT | 40369 |
| 6744 CAGAGGGTCTGGTAAACTCTGGTA | 18402 TGAGGCTGAACCCATCAGAAGA | 29386 GCAAGTTGTTCAGAGGGTCTGGTA | 40370 |
| 6745 CCTGTCTTTGAATGGCTCTCCTCAGA | 18403 TCCAGACCTCGTGCTGCTT | 29387 CACCGGGATCATTGTCCTGTCT | 40371 |
| 6746 GTGGGAGAATAGTGGTTCTGCCTAT | 18404 CGTTCTTCAAAAAGCAGACTGGACCAA | 29388 GAGAAGGAATGACTGTGGGAGAATAG | 40372 |
| 6747 CACCCATGCTGTGGGACTCTTGA | 18405 GGTTTTCACTAAGCCCCCTTCA | 29389 TGTGTCTCCTCACCCATGCTA | 40373 |
| 6748 CAGCAGAAACAGTGGGATGTAGT | 18406 CTCGCTTAAGATCTCACTTTGAGTAAC | 29390 GGTGTGCCAGCAGAAACAGT | 40374 |
| 6749 ACCTGTGCATCTGCCTCTGTTG | 18407 GTCTGTGGGTGATGAGGACCAT | 29391 GCTGTCAACACCTGTGCATCT | 40375 |
| 6750 GCCTGCTTACATCCCACTCAAAAG | 18408 GGGAGCTGGGATCTGAGTAAGACT | 29392 TGAAACTTCACAGCCTGCTTACAT | 40376 |
| 6751 TCTGAGTCTCTCCTTTCAGGACAA | 18409 GGCATTTCTAGACCCACCTTGTATC | 29393 GTGGATGATGTCATTTCTGAGTCTCT | 40377 |
| 6752 CCCTTCACTCATTCCTGGGGTTAG | 18410 CGCTCCCAGGAACCAAGGTATT | 29394 GGGCCTCTCCCTTCACTCATT | 40378 |
| 6753 GCATGGCAAAGACCACTTCCTT | 18411 GTGGTAGGAGTAAGGAATTTGCAGAAAC | 29395 GGCTTACACTGCATGGCAAAG | 40379 |
| 6754 GGCAGGGTGTAGGGAGAAAAG | 18412 TCTAGCTCATCCCCAATGTTCTTTC | 29396 TGGGCTTGGCAGGGTGTAG | 40380 |
| 6755 CTGGCTGTTGATGAGGAAAAGGGTAT | 18413 CCCGGGATTTGTTCCCTAAACA | 29397 AGCTGGCTGGCTGTTGATGA | 40381 |
| 6756 CACAGGGTGTCAGACTTTAGGGAGTA | 18414 GCCTGGGGTAATGAATTCTGCTGAT | 29398 ACCCACAGGGTGTCAGACTT | 40382 |
| 6757 GTGAAAGGAGGTGCTGTTAGTAATTG | 18415 GCCTCAGACCCTGGCACTCA | 29399 TCGGGGCCCTAGATAGTGAAAG | 40383 |

FIG. 36K4

| | | | |
|---|---|---|---|
| 6758 GTGCCATATTGACCATCTTCCTTTTAC | 18416 CCCAACCTTAACCAAAGGAAGCAA | 29400 GCTGTCCCAGTGCCATATTGACCAT | 40384 |
| 6759 CCCACCTTCAGGGTGTGTGATG | 18417 AGCCCCTCACCGGAAGTCTTATC | 29401 TGGAAACCCACCCACCCTTCA | 40385 |
| 6760 GGTGGTGGAAATGTTCCGATGA | 18418 CCTAGGTGGAGTCTTCATTCTCTCA | 29402 CCAAAGGAGTAATGGTGGTGGAA | 40386 |
| 6761 GTCCTGGACCATGGGCAGAT | 18419 GTCTGTGAATCTCACACTCCTCACA | 29403 TGGCCAGCTCAGGGTTGA | 40387 |
| 6762 CTGTTTCACTTGCACTGTGTGT | 18420 CAGTTAGGGCTGCTTGTCTTAGTCT | 29404 TTGTGAGGACAGCAGTCTGTGTT | 40388 |
| 6763 CCGTAGACTGTCCAGAGAGATGACA | 18421 GACTCTGTCACAATCAAGAGAAGGAATG | 29405 TGGGGCTTTCCGTAGACTGT | 40389 |
| 6764 CCAAAGCACGAAACGCCTTGT | 18422 GGCTCCCCAACTATCATGTATGTCAAATG | 29406 AGCAAGGGCCAAAGCACGAA | 40390 |
| 6765 TCCATGCTACAAGGGCAGAGT | 18423 GACTTTGCAAGCCATACAGCTTCT | 29407 CAGCCACACTTACTTCCATGCTACA | 40391 |
| 6766 GGACACAGAATGAACCACTGACTGA | 18424 GGGCTCACACAAAGCTGACTTC | 29408 GGGGAGGGAGGACACAGAA | 40392 |
| 6767 GACAGCTTAGACAGAAACCTCTTTTG | 18425 CCCCTGGAGCTGCTAATTTGA | 29409 CACCTGGAAATTGACAGCTTAGACAGA | 40393 |
| 6768 GCCGAAGATCTCTGCATTTCACA | 18426 GGAAAGGAGAGAAATTGAAGGCATTTG | 29410 GGAAGAGAGCACCTGGAGTTTC | 40394 |
| 6769 TGCCGTGGAACGGTCTGTTT | 18427 TCAACTGAGATTCAGAGCCCTAAGA | 29411 TAAGTCCTCCTGCCGTGGAA | 40395 |
| 6770 GCAGAGACAGAAGGCAGGGTAAGAAA | 18428 GCAGGAGATCCCCTTTACCCAGTT | 29412 AGGGTGCTGGCAGAGACAGA | 40396 |
| 6771 GGGATGCAACTATCTCCTTCCCATT | 18429 GCCAAGTTCCAGACACCATCACA | 29413 CACTCTTTCTTGGGATGCAACTATC | 40397 |
| 6772 GTGTGTGGATGAAAACTCTGGTCTCTTA | 18430 ACATCATGGATAGGCTAGAGGTTATGA | 29414 TGGGTGGAAGTGTGTGGATGA | 40398 |
| 6773 GCATCTGGCATGCACTCTTCACTTAG | 18431 ACAAGGCAGGAGGAGCATTAC | 29415 AAGGGGCAGGACAGCATCT | 40399 |
| 6774 CTCCAGACCTCTTGAATTGACTGA | 18432 GCTGCTCCAAGCACAGACCTA | 29416 GGAAGGAAGCATCTCCAGACCTCTT | 40400 |
| 6775 GTTCCAGTAGAGCTGGATACATACAA | 18433 CCTCTCCCACCCTTCTGTACTCT | 29417 CCATGGAGGATTCATGTTCCAGTAGA | 40401 |
| 6776 CTGGGCCATTTACCATATGTCAGGAA | 18434 TGGACAAATTCCAAGTGCTCACA | 29418 CCTGCTTAACCCTGGGCCATTTAC | 40402 |
| 6777 CCATGTGGCAGGTGAGGATGT | 18435 TGGAGCAGGATTCCGGTAGGTT | 29419 AAGGTCAACTTTCACCTCCATGT | 40403 |
| 6778 AGGAAGAGCGTATGTAGAGAGCAT | 18436 CCCAGTTCATTTCCTCGTGTTCT | 29420 GTGAGGAAGAAGGAAGAGCGTATGT | 40404 |
| 6779 CCCAGAATTCCCCTGCTGAAGA | 18437 GCATGGGTACTGACCCGTTTCT | 29421 GGAAGGGAAGCCTTTCCCAGAAT | 40405 |
| 6780 GCTGTGGTTTCAGAGTCTCACCCTAA | 18438 CCCTGGAACTCGAGAGATGCTT | 29422 GGCTGGCTGTGGTTTCAGAGT | 40406 |
| 6781 CACTCCAATGCCTCCTGTGGTT | 18439 CCTTGGATCCTGGAACTGTGCTT | 29423 TGCTCACCCTCTCACTCCAATG | 40407 |
| 6782 CCCTGTGAGACTTCATCCCCTTCA | 18440 GAGGAAAGGATTACATTCCGGAGAA | 29424 CCCAACCCCTGTGAGACTTCA | 40408 |
| 6783 GGGGAAGTTTTTGAAGGCAAAACAA | 18441 GCCAAAGATAACGGATTCAAGGCAACT | 29425 AGGGTTCAGGCAAGGGGAAGT | 40409 |
| 6784 AGGGGATTAAGAGGCAAAGGAATG | 18442 CAGGGACCTGGGCAGAAAACA | 29426 TTCTGTCAGGAAGGGGATTAAG | 40410 |
| 6785 CTGGGTTCAAGTTTTGGCTCTTC | 18443 CCCAGACAGCTGCGGCTAATAA | 29427 CCCAAGTCTTTTCCTTCTGGGTTCAAG | 40411 |
| 6786 AGTGCCTTCGTAAGCGATTCA | 18444 GGGTCTTCATTTTCTGCCGTACCTATAAAC | 29428 GTATTTCAGTTCCTAGTGCCTTCGTA | 40412 |
| 6787 CTGTAGACTTTGGCTTATTCGACCTT | 18445 CAGCACAGAGTTTTATCCTCCTCTAC | 29429 GCTCCATCTCTGTAGACTTTGGCTTA | 40413 |
| 6788 GCTGGTCCTCTGGTTTTGTAACCCTATT | 18446 CCCCTTACTCACCTGGCCAAAG | 29430 CTTTGCTGGTCCTCTGGTTTTG | 40414 |
| 6789 CCATGGTCAGCATGATATCCTCAA | 18447 TGCACCAGTTCCTCCGTGAGA | 29431 CGGGGCAGTGTACAGGAGTA | 40415 |
| 6790 AGGCTCGCCCTCTCCTCTT | 18448 GGAGCCACTGGTCAGAAGACA | 29432 TCCTCTGCCCTCCCTGCTA | 40416 |
| 6791 GCTCTCTAGAAGCGCTTTCCCAAA | 18449 GAAAGCAGACCCTGAGACCAA | 29433 TCCCTGCACTGCTGCTCTCTA | 40417 |
| 6792 CTTTCAATTCCAGAGCCTGTCCCATA | 18450 ACAGAGATCATAGGTGGCATCCTT | 29434 AAGCAAGAGTGGCTCTTTCAATTC | 40418 |
| 6793 CCAGAACTACGGTTTCAAAGGAAAGAAG | 18451 GCTTCCACCTCCACATTCCTGACT | 29435 CCACTCTCGAGAACTACGGTTTC | 40419 |
| 6794 CGGCAAATGCAGCACAAAATC | 18452 GAATAAAATGCATCCACGCTCACT | 29436 TCCCCAGATACTCGGCAAATG | 40420 |
| 6795 CCTGGTTCAAACGGGAGCGTAT | 18453 AATACGCCCCAGCCCTTGTCA | 29437 GGTTGGCTGAAAAACCTGGTTCAA | 40421 |
| 6796 GGATGCTGTCGATGTCACTCT | 18454 CTGTGTACCAAGTGGATGGATGA | 29438 TGGCTTAGGGCCCAGAGGAT | 40422 |
| 6797 CTCCACCATAGGGAGTGACTTTG | 18455 GGGCAAATTTAGCCACCCATGAAAG | 29439 GCAAAAGCTGTCAACTCCACCATAG | 40423 |
| 6798 TGTTCCCACCTCGCCACAAA | 18456 GCGTGAATGCGTGGGAAACA | 29440 TGCCACTGATGGCCACTGTTC | 40424 |
| 6799 GGAGTCTTTTTCAAAGCGTGGGTAAC | 18457 ACACAGCCACATACCACACATC | 29441 CCCATCTCCACTTTTGGAGTCTT | 40425 |
| 6800 GCAGTAAGCACCAGTGAATATCTGATT | 18458 GGGAGTCACCAGCAGAGTCATA | 29442 GCTGCAGTAAGCACCAGTGA | 40426 |
| 6801 CCAGAGATACTTGAGATGGTCACACT | 18459 TTGCAGGATGACAGACCAAAGTTA | 29443 ACGAGAACATCCAGAGATACTTGAGA | 40427 |
| 6802 TTGCCAGAGTGCTGTCATGT | 18460 CAGGAGCCTATGCTGAGGTGTAAG | 29444 GGGCCTTGATTTGCCAGAGT | 40428 |
| 6803 AGGATTGGCATAGGAACAAGTGAT | 18461 CAGAATCCTATATGCTAGGCTCATAACCAA | 29445 TTGCCGGAATGAGGAGGATTG | 40429 |
| 6804 CCGTCTTTGTGCCACCTGTTG | 18462 GGGAATTCTCCAACCCCATTTCT | 29446 CTCTAGCCTTTCAGTCCGTCTTTG | 40430 |
| 6805 GGCACAGATTAACTGCGTCTGACT | 18463 TGGCCATAGAGGGCTGAGAGCTT | 29447 GACACACAGATAATGAAGGCACAGA | 40431 |
| 6806 GCGTATCTTCTGCATACACTAGCTT | 18464 TCCCAGTGCCCACTTCACT | 29448 CCACGTGGCGTATCTTCTGCAT | 40432 |
| 6807 AAGGCGATGGGAACCTCAGA | 18465 GGCTGATTATCGGCAGAATTTGGTT | 29449 CCTCAGCTGTCAGCCAGCAA | 40433 |
| 6808 GCCAGAACCTGGTCTGAACTCCAA | 18466 CCACACTAGGAATGTGGGACACAA | 29450 GCACTAACGTAGTAGGCCAGAAC | 40434 |
| 6809 GGGGAAACCATGAAGGCTTGAA | 18467 TCATATTTCTCCATCCCAGCTGTTAC | 29451 ACACTGATCCTTATTGATGGGGAAAC | 40435 |
| 6810 GGCCACCATTGGCAGTATCATC | 18468 GCTAGATGATGATGTCCTCTACCAAA | 29452 ACAGCACGGCCACCATTG | 40436 |
| 6811 CGTGGGTGAAGCGCAGAGTA | 18469 CATCCAGCGTCACATTCTGTCT | 29453 AAGCATGCCCGTGGTGAA | 40437 |
| 6812 TCAGGGCATAGGGCCTAGAAG | 18470 GGTGTCGGGCAAGACTTGTTTC | 29454 TGGCCTGGCTTCAGGGCATA | 40438 |
| 6813 GCCCACAGAGACCATCCATCT | 18471 GCTCTGGGCTGATTGAGTTGCATTC | 29455 ACAAAAGAATGGAGGCCCACAGA | 40439 |
| 6814 GTGGGATTCAGCCATTCCTGCTA | 18472 CCATCACCCGAAGCCTCACTTT | 29456 GAGCTAAGTGAAGTATGAGTGGGATTCA | 40440 |
| 6815 CCTCAGACAGAGCTGGGTTTAAATTCT | 18473 GCCTTAGGCCATGTACAATGTGA | 29457 GGCTTAGAGCACTCCTCAGACAGA | 40441 |
| 6816 GGGGACAGCAGCGTTCCTT | 18474 GGCTGCACAGACCACTCAATTATC | 29458 GCCCCTTGCCCACATCTTAGT | 40442 |
| 6817 TGCTACTGGGTGCCAGGAA | 18475 CTGTATTATCCATCACATGAGGGTCTTG | 29459 ACCATATGCCGGGTGCTACT | 40443 |
| 6818 CCTGCCACATGTTCTATCTGTGTCT | 18476 CTCACCATACGGTTGTACTCACA | 29460 TTTTCCTTACTGATCCTGCCACAT | 40444 |
| 6819 CAGTGATTGTGCTAAGGCCAGTT | 18477 CATGGAGGATTTCAAAGCAAGGAAGT | 29461 GGCCAGCACAGTGATTGTCCTAA | 40445 |
| 6820 GGGATTCTCTAGGAGGAGATAACTTTCTGA | 18478 GCTGTCACAGACTGCATGGAA | 29462 TTGAATGGGATTCTCTAGGAGGAGAT | 40446 |
| 6821 GGAGCAGGTTGGAGGTTAGCAT | 18479 CACCATCTTGGTCATCTCTTTCTTTC | 29463 GCTCAATTCGGAGGAGCAGGTT | 40447 |
| 6822 GCTGTGGAATGCAGTTGAATGACTTCT | 18480 GGTGAGTACCCTAGCAACCAGAAG | 29464 TGGCTGTGGAATGCAGTTGA | 40448 |

FIG. 36K5

| | | | |
|---|---|---|---|
| 6823 TGCTGAACGTCACACAGTGAT | 18481 ATGGCCCCTGGAACTGGAAA | 29465 TGGGGAGTGAAGATGCTGAAC | 40449 |
| 6824 GCAATCTTGGCTAATGAGACCATTT | 18482 CATGGCTTTCTGCAGACCATTTT | 29466 GCCCATGGCAATCTTGGCTAATG | 40450 |
| 6825 GCCCTTCTATTCTACACTGACGTAAA | 18483 GTGATATGTGTGCAGGTTTCTCTGTTT | 29467 CAGCTCTGAATTTGGCCCTTCTATTCT | 40451 |
| 6826 GGAGAAACAACCACCATGGGAATGA | 18484 TGAATGCTGCAAGAGGAAATGGAA | 29468 GGAGCAAACACGTGGAGAAACAAC | 40452 |
| 6827 CACAGTGCTGACTTCCTTTCTACT | 18485 GACGCCATGTGCTGTAGATTACT | 29469 GGCTTGATCACAGTGCTGACTTC | 40453 |
| 6828 GGGCCACCTGGATGTAGACTTTTG | 18486 CCCACAGACTGATTCAGAGTCGTTAC | 29470 TCAGGGCCACCTGGATGT | 40454 |
| 6829 GGGACAAATCTTCCTACCCCATTC | 18487 GAGGCCGAGCAGCATTTGAT | 29471 CGAAGTTATGGCTGGGACAAATC | 40455 |
| 6830 AGTACTGGGATTTGCTACAGAGAAG | 18488 TCAGTGGTGCAGCATGCTTAG | 29472 TGCAGCACAAAGTACTGGGATTT | 40456 |
| 6831 GGGGAGGTATCAGAGCCTTTTTCTGA | 18489 GGGTGGCACAGATATGAGGAAACA | 29473 GGGGTCCTGGGGAGGTATCA | 40457 |
| 6832 CCATGAAACTCAATGACACTGTTTCTGTCA | 18490 GCACAACCATGTACCTTTGGAAATC | 29474 GCCCTCCATGAAACTCAATGACACT | 40458 |
| 6833 CTGATCTTGTACTGCTAGCCCTTATAG | 18491 TGCCTCATACAGACCCGACAT | 29475 GCCCTTTGAAAACTGATCTTGTACTGCTA | 40459 |
| 6834 AATGGCAATGACCCAACATGAAG | 18492 ACATTTGCCAACCCCTGCTT | 29476 GGCTGCTTCCCTAGAAAGACAACA | 40460 |
| 6835 GGAGGAAAGCAGGGATGCATGT | 18493 GAGGCAGTGCCAAATATGAACTGATAC | 29477 TGGACACCCGTCAAGGAGGAAA | 40461 |
| 6836 CTGTGCCTCAAGGAGACAGTGA | 18494 CAGATCCCAAATGCCCTCCAACA | 29478 ACGCTGCTGTGCCTCAAG | 40462 |
| 6837 CTGCTGTCAACAGGACAGTGAAA | 18495 GCTTCTTGAGGCTAGGCTTGGAACT | 29479 TGGCCAACAGACTGCTGTCAAC | 40463 |
| 6838 ACTTCGGGAGCCACAGTCCAA | 18496 GTGTGTTGCATCTCCAGCTAATG | 29480 GGACAGCAAAGGCTGCTTGACT | 40464 |
| 6839 CCACCTTGTTTTAGATTTTGGCTCTGA | 18497 CAGCCTCCAAGTTGAACCTAGT | 29481 GTGGGATGCCCACCTTGTTT | 40465 |
| 6840 CAGACAGGCACCTTTCAAACTCTTCT | 18498 AGGGCCACCTCTCTGGGTTTTA | 29482 CCCCATCAGACAGGCACCTT | 40466 |
| 6841 TGCTGATACAGTGACTCGGTACT | 18499 GCATTATGGGGTTGTGGGTTGT | 29483 GCAAGACACCTGAGATGCTGATAC | 40467 |
| 6842 GGGAGCCAGTCATTAATCGAAATGT | 18500 CCCGAGGAAGCATTTGCTGTGA | 29484 ACAGCATGGGAGCCAGTCAT | 40468 |
| 6843 GTGCCTTACCTTTGCCAGTTCTGT | 18501 GGCATGGTTCTTCCAACTCCAAGT | 29485 CCTGCAGACAGTGCCTTACCTT | 40469 |
| 6844 CTGAGACTGGATTGGGATAAGGAGATG | 18502 GCCTGGCCACCTATCATTGT | 29486 GGCATGGTAGACTGAGACTGGATTG | 40470 |
| 6845 CCCCAGCTTCATCTCCTTGGAA | 18503 TGTGGCAGTGGAAATCCCAAA | 29487 CCTTCTGCCCCAGCTTCATC | 40471 |
| 6846 GCATGATAGGAAGTGTGCGTGATAG | 18504 GCCAGCACCCCACAAATGTTAC | 29488 GCGTGATAGGAAGCGTGCAT | 40472 |
| 6847 CACCTCCTGGTTAGAGGCATTC | 18505 TGCAGTTCCATTTCCAATAGTCACA | 29489 AGAGAGCTTTCACCTCCTGGTTA | 40473 |
| 6848 ACACTGAGGACAGGAACTACTGA | 18506 CCCCAAACTGGATGTTTTCCCTCAT | 29490 GCTTCCGAGAGGTTACTGATACACTGA | 40474 |
| 6849 GTGAGTGTGGTTAGTACCTCCTAATCTT | 18507 CCCACCCATGTCTGTTCTCTATTT | 29491 CCAATTGATCCAGTGAGTGTGGTTAG | 40475 |
| 6850 GTCTGGCCATTCCAGGGAGATT | 18508 TGAAGGAACCTCCCTGACCTTT | 29492 CCCACCATGTCTGGCCATT | 40476 |
| 6851 CAGCCTTGTTGCTGGAGGGAAT | 18509 CCACCTGTTCAGGGCCACTA | 29493 AGGTTCACGCAGCCTTGTTG | 40477 |
| 6852 CGAAATTAACAGAGTTCTCTCTGGTTCCAA | 18510 CTTCAACTCTACATTTCTGAGGGTCAT | 29494 GGGCTCCAAAGTCGCGAAA | 40478 |
| 6853 CTGGAGCAGGAAGGCTTGTTAC | 18511 CCCCTACACACCCATACAGACA | 29495 ATCCAATGAAACTGGAGCAGGAA | 40479 |
| 6854 GTGTTCCTGGACATGTGTTTGATACCTA | 18512 GCAATTTGCTTAAGGACAGGGATTGTATC | 29496 CGGTGTTCCTGGACATGTGTT | 40480 |
| 6855 ATGGCCCAGCCTCTGAGTGA | 18513 CTCCCTCAAAATTCCCTGGTTCT | 29497 GTGGGCAACACCGAGAGATG | 40481 |
| 6856 GCACCACGAGCTTGGACTTTCA | 18514 GCCTCAGCCTCCCAAACAA | 29498 CCCACAGCACCACGAGCTT | 40482 |
| 6857 GCGATGCTTCTGGATCTGCAA | 18515 TCCCTGGTGTGGATCTTATTTCATC | 29499 CAACCGCTTGCGATGCTTCT | 40483 |
| 6858 CCAGCCTCTGAAGGAATTGGTCTATG | 18516 GCTTCCCTGGAGACCACAGT | 29500 CCTTTTCCAGCCTCTGAAGGAA | 40484 |
| 6859 TCCCCTGATGGAGAGTTGCAT | 18517 GGGTCTTCGACTTAGCATTTAGTCT | 29501 TCCACAGGAAACCTCCCCTGAT | 40485 |
| 6860 GCAGTGGAAGATAGGCAAGAGGAA | 18518 GCTAGCTCCTGTTTCCATCAGCAT | 29502 CTTTAGCAGCAGCAGTGGAAGA | 40486 |
| 6861 CCAACAGGATTGTCGGTGAATTG | 18519 GCTTGGTCCAAAACCTCATTGATTTAC | 29503 GAAGGAAGAGCCAACAGGATTGT | 40487 |
| 6862 CCACCCTGAATTTCTAGGTGTGAAC | 18520 ACACGGTTGTACATGCGTAAGA | 29504 AATACCCTTCCACCCTGAATTTCT | 40488 |
| 6863 GCTCACTACGAACCTGAGACCTA | 18521 GTGTGGAGGAAGGGGAAGAGTTC | 29505 CGGAGATACCAGCTCACTACGAA | 40489 |
| 6864 GACCAGGAACACATCTTGAGAGTTAAG | 18522 CCCCCTTGCTTTCATGGTAACACTT | 29506 GAGAGATGACCAGGAACACATCTTG | 40490 |
| 6865 CCTGCAACTAGCAAATTCGGCTTTT | 18523 GTGGCTCCTTTTCACATAGTTGTTT | 29507 GGATGCCCTGCAACTAGCAA | 40491 |
| 6866 TGAGATTCACCACTCTTCCTGAAC | 18524 GGACATGGGAGCAGATTTTACACT | 29508 CCCCAAACCCTCTCTGAGATTC | 40492 |
| 6867 GGTGCAACAGACTGAGAGCAATCTA | 18525 GCACACATGGGTTCTCAGTGAT | 29509 TGCAGGGTGCAACAGACTGA | 40493 |
| 6868 GAAGCAGTGGGTGAGATATAGGATGAT | 18526 CCCCTAAAGCCATTTCGGTTCTTC | 29510 CTGTGAAGCAGTGGGTGAGAT | 40494 |
| 6869 AGTGAGGCTCAGTGCCATCTTG | 18527 ACATGGATAGAAGGCTCGGCTTAATG | 29511 CATGTTTGGTGTGCAAAGGATGA | 40495 |
| 6870 GGCCTTTCCAACCCGATTGAGTA | 18528 CAGTTTGGCCCATGCTGATG | 29512 AGTTGTGTTGGGCCTTTCCAA | 40496 |
| 6871 GGTCCCATGTAGGGAAGTCTCTT | 18529 CAGAACCCTCCTGAATAATGGAAGT | 29513 TGACCTGTCTGGTCCCATGTAG | 40497 |
| 6872 ACGCAGACAGGGACCAGAT | 18530 ACCAGGCCACTCCCTTGTGT | 29514 GGAGGTCAGAGACGCAGACA | 40498 |
| 6873 CAAGTTTCAAGGAACAGGCACTAAG | 18531 GGCTTTCCTGGATGGACAAACAGAT | 29515 GGATGCACAAGTTTCAAGGAACA | 40499 |
| 6874 CAATGCTGGGATCTTTCCTCCAA | 18532 AGAATCCTGTCTATTTACAGGGGTAGA | 29516 CACACTTCCTTCAATGCTGGGATCT | 40500 |
| 6875 CCGTTCGGTCAAAGGACATGCAA | 18533 CAGTTGGCCCAGTCAACCAA | 29517 GGCAAATAGACAACCGTTCGGTCAA | 40501 |
| 6876 GCTACTCTGGGTGGTTCTAACTGTTG | 18534 CTGGCAGTGATCTCTCTTTTCTCT | 29518 TCAGGCTACTCTGGGTGGTT | 40502 |
| 6877 CTGCCAATAGCTAGGGGAGCAT | 18535 CCCACAAGACACTACCCACTCCAT | 29519 GTGTTTGTCCTTCTCTGTCTGCCAATAG | 40503 |
| 6878 CCAGGTTAGCATACAGAAGGCCAAT | 18536 CTCAGGAACTTTGGAGCATAGATCA | 29520 GGCATCCAAGAAGTTTCCCAGGTT | 40504 |
| 6879 CTCCCTAGTGCTTGGTGCTACT | 18537 CATGACAGTTAAGGGGAGAAGGAAAA | 29521 CTCCAACCTCTCCCTAGTGCTT | 40505 |
| 6880 CGGATTTGGAGTAGTGGGCAATG | 18538 GGCATGTTTACTCCACCAACAACA | 29522 CCCACTTGGTTCGGATTTGGAGTAG | 40506 |
| 6881 CCCATCGGGAGAATCACACACT | 18539 GCTTGAGAACTGAGGTGCCAAA | 29523 GTGTTGAACCCATCGGGAGAA | 40507 |
| 6882 GGCTCTGGAAGAGAGTAGGCAAAT | 18540 GCCATCTGCTGCTGTTAGCAT | 29524 AGCGCTAGGCTCTGGAAGA | 40508 |
| 6883 CCGTATCTCCTCCAGTCCATTACTGT | 18541 GACCTTAGGCAAAGAGGTAACACAAC | 29525 TCAGTTGGACTCACACCGTATCT | 40509 |
| 6884 ACACCTTTGCTGATCTCTGCTATAC | 18542 GAGAGCTGAGTTTAATGAGAGTTGAGGTT | 29526 GGGCACATTCCATCAACACCTTTG | 40510 |
| 6885 CTGTTCCTGCAGATTACTGCTACTGT | 18543 TGGAGAACTTGTGTTGTGTTTGA | 29527 CAGTGTTCTCTGTTCCTGCAGATT | 40511 |
| 6886 CCTGTGGTTCAAGCCTCCAAT | 18544 GCTTCTAAAGGATACGGTGAAAGTGTAG | 29528 CTCATCCTAATACTGACCTGTGGTTCA | 40512 |
| 6887 AGATCAGGTTCTAAGGGTCATACCAA | 18545 ACAGTGGTAGAGATGCAGAAAGATG | 29529 CCCATAGCCAGTCAAAGATCAGGTT | 40513 |

FIG. 36K6

| | | | |
|---|---|---|---|
| 6888 GGAGAGAGGCTAACTGACATATACTGGTAA | 18546 GAGGTTCAAATAACCAAGTGGAGAAG | 29530 CTGAGGAGAGAGGCTAACTGACA | 40514 |
| 6889 GCCCAGTGTCTGATGTGTAGAAAG | 18547 CCCAGATTCAGTCCTGTAGTGTAAC | 29531 GGGAAAAGCCCAGTGTCTGATG | 40515 |
| 6890 GAACAAGGGATGTCTCCTCTTCAA | 18548 GGGTGAGACAAACATAGGTTCTTTACTTG | 29532 TGGCATTTGCAAGGGGAACAA | 40516 |
| 6891 GCAAGGACACAAGCGAAGAGACT | 18549 TCGGGACCAGCCATCACT | 29533 AGGGAGGAGGCAAGGACACAA | 40517 |
| 6892 GCACCATGGGTTTGCCTCTACT | 18550 GCACTGTTCCAATGTCCAGGTT | 29534 TGTGGGGCACCATGGGTTT | 40518 |
| 6893 AGCCTCCTATGATTCCCAGAACT | 18551 CTGGGAGTAGGCATTAACCCATTG | 29535 CCACCCACAACAAGCCTCCTATG | 40519 |
| 6894 GCAGAGGTTCAGAGGGAAAGATGTTC | 18552 TCCAGCCCCTACAGAATTCTATTTTTC | 29536 AAGGAAGGGGCAGAGGTTCA | 40520 |
| 6895 GTCATCATGTGACAACCTCTGACT | 18553 GCTCAAGAGCCACACGAATCT | 29537 CCATTGAGCCCAGGTCATCATGT | 40521 |
| 6896 GGCACGAGTAAGTGTGTCTGA | 18554 GGGCTGTCACCTCTTCTGTGA | 29538 GGGGTGAAAGGCACGAGTAA | 40522 |
| 6897 GGCCTGCATGGGTCACTATT | 18555 ACGCTTCATTCCCTCAGTCTCA | 29539 GCAGTGACATGGCCTGCAT | 40523 |
| 6898 CCAGTCTGTCCTTGAAAACAACACA | 18556 GTCTGGTTGCGCAGTGAACA | 29540 CCGAGACTCATCCAGTCTGTCCTT | 40524 |
| 6899 GCATCCGCCTTAGATAAACAAAGAA | 18557 GCCCTGCTACCCCTTTCCTATT | 29541 AGCTCTTCTGCATCCGCCTTAG | 40525 |
| 6900 CACATTGACTTCTTTCCATGCCCTAT | 18558 GCGATGCCAGGAACATCTCT | 29542 CCTACTCGTTAACTCACATTGACTTCT | 40526 |
| 6901 CCCTGAAGTGAGTCAGGAGCTGTA | 18559 TGGCCACACAGCCTACCTT | 29543 ACCTGCTGTGTACCCCTGAA | 40527 |
| 6902 TGCCATCCCATTGAGGAGTGA | 18560 CTACCTAAACCTCTAATCACCTAAGACTTG | 29544 AGGCCACTTGCCATCCCATT | 40528 |
| 6903 CCATCTTTTCTAGAGTGGGAATTGTCT | 18561 CCAGAGCCATGAGAGGAAAAGGATT | 29545 CGGCATCACTACCATCTTTTCTAGAGT | 40529 |
| 6904 CCTGGCCTCTGATTCCATCCAAAC | 18562 GGGTGATGTGAGATTCCCTTAACTCT | 29546 GCCACCCTGGCCTCTGATTC | 40530 |
| 6905 GGGTTTTGCTTTGTGGTGGTGTTG | 18563 GCACTCTCAAGGCGTAAGACCTTTT | 29547 GTGGCAGAAAAGATGGGTTTTGCTT | 40531 |
| 6906 AGGCACCCATTCCTGTCACTTG | 18564 ACATAAGCCCATGCCAGGATAATAAG | 29548 GCCCTTTCCAGGCACCCATT | 40532 |
| 6907 CGAATGGGTATCGATGTCCTTGA | 18565 CCAACCAGCCAGTCCAAAAG | 29549 CCTCCCAAGTCAACGAATGGGTATC | 40533 |
| 6908 TGACTGCGTTGAGCTTAGAAGTTA | 18566 GTCAGGCTGCGTCATTGCTA | 29550 GTGACAAGTTCAAATGACTGCGTTGA | 40534 |
| 6909 GTCCAAGTCCAGCCTTCACA | 18567 CAGAAGAACGAGGAAGGAACTGT | 29551 TCCTGAGCCTGTGTCCAAGT | 40535 |
| 6910 GCTGGGAACCTTGGCCTGTATATC | 18568 GGAGGAGCTGGTAAGAACTAGTCA | 29552 AGGCCACGCTGGGAACCTT | 40536 |
| 6911 GCTTCCTGTTTCCACGTAGGTTTC | 18569 CCACCAGACAACTTTCTCCTCTT | 29553 CTTCGTCCTTGCTTCCTGTTTC | 40537 |
| 6912 GGCTGAAAGGATGGTGCTAT | 18570 GAGCAAAGAATGTGCTATAAGGGAGAT | 29554 GCTGTCACCTTTGGCTGAAAG | 40538 |
| 6913 GAGTGGCTAACTGGTCCTAAATTCAAA | 18571 GCATGTGGGTTTTCCAGCAAAT | 29555 CAAGACAGATCCTGAGTGGCTAAC | 40539 |
| 6914 GCCTCAAACTCCTGGGCTCAA | 18572 ACTGTCCTTGCTACTTGAGAGACT | 29556 CCTCACTGCAGCCTCAAACT | 40540 |
| 6915 CCCTCTGGCAGTGTGTTAGCAGAT | 18573 ACAGGTTCTTTCAAGCAGGATTTC | 29557 TGGGTCCCCTCTGGCAGTGT | 40541 |
| 6916 GGCTTACACTGCCCTCTGAGATAC | 18574 GCCAAGCACATAAGCCATGCTA | 29558 AACGCTTCAGTGGCTTACACT | 40542 |
| 6917 CCAGAGTTCCCTCTTTGGGAATCAGA | 18575 TCGCTGGATTTCTCCAGGATTAC | 29559 TCCCCTCCAGAGTTCCCTCTTTG | 40543 |
| 6918 CAGGACTTGTGTCTGTGGCTAAAC | 18576 GCCCAGATGGAGACACAGCTT | 29560 GAGCTGAAAGGCACAGGACTTG | 40544 |
| 6919 GCTTCTCGTGACTCATTCATGTTT | 18577 GTCACAGCCTGCTTGCCTAT | 29561 AGGAAATCAATTGCTTCTCGTGACT | 40545 |
| 6920 CCCTTGTCTCCAAGTGAGCTATTC | 18578 CAGAAATAGGACCTTTTGGGGTTCATTC | 29562 TCTGACTTCCCTTGTCTCCAAGT | 40546 |
| 6921 CGTGGCCTAAACTTTTCCAAAGACAT | 18579 GAGTGGACACAGATCCCACACA | 29563 CCACCACACGTGGCCTAAACTT | 40547 |
| 6922 GGTGATGGCTGATGAGTGGTT | 18580 GCCTCCTGTGTGAAGGTCGAAA | 29564 CAGTTCAAGCCCAGAGGTGATG | 40548 |
| 6923 GTCACTTGCTCACCCCAATGA | 18581 CCTGCCCCAAACTCCAAAGA | 29565 TGGCCCTGAGCTTGTCACTTG | 40549 |
| 6924 CCTGTGTGGGACAGTAAATGTAGGTA | 18582 TAGGTGCCCGAGGCCAAAC | 29566 TGCCTTCCTGTGTGGGACAGTA | 40550 |
| 6925 CCTTCAGGTACTGAGGGTGTCTCT | 18583 GGAGGACAAAAGGAGCTCTATTCAA | 29567 GCTGCCTGCCTTCAGGTACT | 40551 |
| 6926 GTGAAGGGACTACTGAAAACTGAACA | 18584 CCTGGAGTGTGGGCAGGTATTTTC | 29568 TTTTGGATGTGAAGGGACTACTGAA | 40552 |
| 6927 GGCTCCATCTAAGATTTTCAGGAGTCA | 18585 CTGGTGATCACTTTACCCTTCTGTGA | 29569 GTCTGGCTTGATAGGCTCCATCT | 40553 |
| 6928 GTGTTCCCCAAAACAATTCCCAGTT | 18586 TTCAGAGTCCCGTGAGTTATCCTA | 29570 TGGGGTGTGCATCAGTGTTC | 40554 |
| 6929 GCAAGTCTCCTAGTTACGCAAGTCA | 18587 CAGTTAAGCCTCTTTGATGGGAATG | 29571 GGCAGATTGATGGAGCAAGTCTCCTA | 40555 |
| 6930 GGTGAAATCTCAGCTCAGTTCTTTCAGATT | 18588 TCTTAGGGGAGGCCAGACCAA | 29572 GGTGGGCAGCAGGTGAAATCT | 40556 |
| 6931 AGACGTAAGAGCTATGTGGCAAA | 18589 GGTGGAATGTCTGTGGAATGTTAGTGA | 29573 GCAAGCTGGAGACGTAAGAGCTA | 40557 |
| 6932 GCTTTCTGTGATTGCCAATACCATT | 18590 ATGACAAGCAGCTCCGTTTA | 29574 CCTAAGACATGTAACGCTTTCTGTGA | 40558 |
| 6933 GCACACAATATGCCATTTCCTCTGAA | 18591 CACCAGCTGCCCTCTAGGAA | 29575 CAGGGAAACACACAATATGCCATT | 40559 |
| 6934 TGGGAAATGGTGTTGCCTCATAG | 18592 GACTTGAAACATTGCTTCCTACCTA | 29576 GTGCACAGAATGGGAAATGGTGTT | 40560 |
| 6935 CTGACATGCCAAGTGCCCAGAA | 18593 CTGTTTCAATCCTGGACTGTCTGT | 29577 TCCTACACGTGGGCCTGACAT | 40561 |
| 6936 GGCAAAGACCTGAAGAATGACGAT | 18594 ACCCCTTCCCTGCTTCTTGT | 29578 AGGAGATAGAGGCAAAGACCTGAA | 40562 |
| 6937 CGCAGCTACAACATAAGCCAAA | 18595 GGCTCTCAACATGCAGACCTTGAT | 29579 CCTGTACTCAGAAACGCAGCTACA | 40563 |
| 6938 CGCACATGCATCCTCTGGTACT | 18596 GGGAGGAGGTAGGAGGTTGTAAA | 29580 GGTGGCAAAGCCGCACAT | 40564 |
| 6939 GGAAACTGTGCATCCTAGTTCTGA | 18597 GCCCAGGGGACTATTTTGTCTGT | 29581 GGGCTATGGAGTCAGGAAACTGT | 40565 |
| 6940 AGCTGAAGCTGCAGGAGGAT | 18598 CCCTAATGGTCCAGCCAACATAC | 29582 GGAGGAAAAGGCTTAGGAAGCTGAAG | 40566 |
| 6941 TGCCTCCAGATCTAGTAATACTGCTT | 18599 AGCGCCTGTGAACTCAGGAATG | 29583 TCCTGTGGTTGCCTCCAGAT | 40567 |
| 6942 CCACAACCTTTAGACTGAGGTCTT | 18600 GTAGTCCACCATCCTGATAAGGTTAAG | 29584 TGCCGATTGCAGACCCACAA | 40568 |
| 6943 GCAAAGCACTGGCCACATTG | 18601 CCTTATACCCCACCTCCACGAA | 29585 GCCTTCCAAGTGAGAAGCAAAG | 40569 |
| 6944 CACACTGGTTAAAAGTGGCATGTATGA | 18602 CGCAAAGGATTTTGTCCTTCACT | 29586 ACCTCACTATGACACACTGGTTAAAAG | 40570 |
| 6945 GGAAAGCAGCTGGCACTGATGA | 18603 CAGCAGCAGCAAACTTGTCTATT | 29587 GAATGTTCTGCCATCTTGGGAAAG | 40571 |
| 6946 CTCCCTTCTATAATACCACTCACAGATAG | 18604 CACCGGTGGGTTTGTAGCAGAT | 29588 GGGAGACGGAAGTTCTCCCTTCTATAATAC | 40572 |
| 6947 GCCGTGTTTACGCTCTTCTTG | 18605 TGTCCTTGGGAGGAGAGCTAGT | 29589 TCTTGAATGCATTGCCGTGTTTAC | 40573 |
| 6948 GCCATTTACACCCGTTCCACAGT | 18606 AGCTACGGCCCATGACAAGA | 29590 CCAGTGCAGGGTGCCATTTACA | 40574 |
| 6949 CCGAGAGGCACAGACCAATGAAGA | 18607 CCAGCTTAGCCCTAAATAAAGCACAGT | 29591 CAGAGTCCGAGAGGCACAGA | 40575 |
| 6950 GGATAGTGAGTTCCTCGTGGATAA | 18608 GGTGTGGGACCATGGAGACAAAT | 29592 CCATACCTCCTTTACTGGATAGTGAGTTC | 40576 |
| 6951 CCTCCCCATTCTGAGGCACTCTTA | 18609 CAATTGCAGTAAGGGAGAACACAAAC | 29593 TGCCTTGACCTCCCCATTCTGA | 40577 |
| 6952 GCCCAGGAGTTGACCTTTCAAT | 18610 GGCCTTATCATGATCTGAGGATGAAGTT | 29594 CTGCAGAAATGCCCAGGAGTTG | 40578 |

FIG. 36K7

| | | | |
|---|---|---|---|
| 6953 AGGAGTATAGTAAGTTCTCGGTAGCAT | 18611 GTTGCAATCTAGTGGCAGTTTCTAAG | 29595 GGGTTAGGTGACTCTAGGAGTATAGTAAG | 40579 |
| 6954 TGAGCTTGTTCTGGTCCTTATCTTT | 18612 GATTTGTTGTTAGGTCACTCCAACTTC | 29596 GCCCCTCAATTTGTCTATGAGCTTGT | 40580 |
| 6955 CGGGTAGTAAGCACACAGCAA | 18613 CGCTCTGAGACAGCCATACATTTG | 29597 TGGCAACGACGGGTAGTAAG | 40581 |
| 6956 GGAGAGTAAAGCCACCATCTAAGGGTTA | 18614 CCAAGGTCACTGCCTCTCATGT | 29598 ACTGTCTTGTGACCAGGAGAGTA | 40582 |
| 6957 AGGGGCACTTCCAAAAACATAATCT | 18615 CAGCTCCGTCCTTTCATTCTTACA | 29599 CGCATTCAGGGGCACTTCCAAA | 40583 |
| 6958 CTGGGAAACAGTCATTACCAACATAC | 18616 CTTGTCTGCTGGGCTGTTCTA | 29600 TTCTCTGACAAAGACTGGGAAACA | 40584 |
| 6959 GCAGTGACAAGAAATTAGGCCAAGTCTA | 18617 CAGGGATCAGACAGAGACATTGTT | 29601 GTTCCTTGCAGCAGTGACAAGA | 40585 |
| 6960 GCACACAGTCAGTTCATGGCAAAG | 18618 AGTACAAGACTGTGAGTCAGGAGAT | 29602 TGGTTGGCAGCACACAGTGA | 40586 |
| 6961 TTCCTCCTGAAACGGAAAGAATGA | 18619 GTGAAGCCAGAGGTGCTCTT | 29603 GGAGGCATCTCACTTCCTCCTGAA | 40587 |
| 6962 TGGAACCCTAATCCTGTTCAGCTA | 18620 CTCTGAGCAACAGAATTCCCACAGAT | 29604 CACCCTACAACTAGATGGAACCCTAATC | 40588 |
| 6963 CTGTCTTAGCTGTCAGAATACCAACTGT | 18621 CTGTGCCACCGTCTATGTAATTTATGT | 29605 GCATCCCTATTACTGTCTTAGCTGTCAGA | 40589 |
| 6964 CAGTGCCACAGCACTTCTCA | 18622 CAACAAGATTCAGTGCCAGGAACA | 29606 GAGAGTTTGGGCACTGGTGAT | 40590 |
| 6965 GCTACTCTCACGGCCCTCTTCTA | 18623 GAATATAGCGGCCAGAGTGATGA | 29607 GCCTCCAGGGTGCTACTCTCA | 40591 |
| 6966 CCTCTCAACGAAGGCATAATGCTA | 18624 AGAGGACGTGGTTATCTTGTCAATG | 29608 TCATCTCTCCCCTCTCAACGAA | 40592 |
| 6967 GTCACCATTTCTGGATAGTCTGAGGAA | 18625 GGCTTCATAGCCATCTTCAAGGACCTA | 29609 ACTTTCACAGTCACCATTTCTGGATAG | 40593 |
| 6968 TGACCCAGAAGAGTTTGGAGTTG | 18626 GCCTACTTCTCACATCACAGCTCTCTA | 29610 GCTGAGCTTTCGTTTTGACCCAGAAG | 40594 |
| 6969 AGTGAATTGAAGAGGGCAGGAAAT | 18627 CATGTAAGAGCCTTCAGATCCTGTCT | 29611 AGCCAGATTGCAGTGAATTGAAGA | 40595 |
| 6970 GTGGCAGTGGCAAAAGAACACAA | 18628 CGAGTCCATGTGCAGAAAGAAC | 29612 GTAGTGGTGGCAGTGGCAAA | 40596 |
| 6971 GGTCTGTGCTCGCTTGGTTA | 18629 GGCTTGTCCTGCTCTCCAAACACT | 29613 CTGCCTCATTCCAAGGTCTGT | 40597 |
| 6972 GAGTAGTCCAGGTTATCCTCAGAGTCA | 18630 GGAGAAATCCCTATTCTCCCTGTTG | 29614 GAGGGAAGAGAGTAGTCCAGGTTAT | 40598 |
| 6973 GCTTCACTTGGCAGCTGTTTC | 18631 CTGTGTAAGCAGGATCACCGATCT | 29615 GGTTTGGACACCATGCTTCACTT | 40599 |
| 6974 GCTGGGGAGAGTGTCTTTGGATTTTG | 18632 GAAACTGGTCCGGAGGATGAGA | 29616 GAACTTTGCTGGGGAGATGTCTT | 40600 |
| 6975 GCATGGCAGAAGCTAGAAAGAAAGGAT | 18633 AGGGAGAGGCAAATAAGTATGTGTAAC | 29617 CAGCCAAGAGCATGGCAGAA | 40601 |
| 6976 CCTAAGTGGTTGGTTCAGAATTCACT | 18634 AGGGAGCTAGTATGGTCTTTAGAGTAA | 29618 GGGCATACGGACCTAAGTGGTT | 40602 |
| 6977 TCAGCATGTAGCCTTGCCAAA | 18635 CCTAAATCGTCTGCTGGTGTCCAT | 29619 CAGGTTTGGGTTTATCAGCATGTAG | 40603 |
| 6978 GCCCATTATTTCCCCACTACTCTCT | 18636 TCCTCCTCCCACCTCCTTAAAA | 29620 TGTCCTGACTCCTGCCCATT | 40604 |
| 6979 CCAGCTAGACCGGAAAGTACAGGAT | 18637 CACCACCAAATCAGAGAATTGCCTTT | 29621 TGCCTCCCACTAGACCGGAAA | 40605 |
| 6980 TGCTGCTCAAGTGTTTCCTTCT | 18638 TGGAGACTGGTCATGTACACACA | 29622 CCCTTCTGACCATTGCTGCTCAA | 40606 |
| 6981 CCTTTCTAGAGTGGTGCCATTATCTCA | 18639 TGGTTTTCCATCTGCTCACTTTTC | 29623 CAAGGACTTTGGCTCCCTTTCT | 40607 |
| 6982 GGAGGCCTTTCTGAACCATCTT | 18640 GAATGGTGGAAGGGTAATGTCAATG | 29624 TCATCTTCTCAAGGAGGCCTTTC | 40608 |
| 6983 CTGTTGTAGGCCTGAGGCATTG | 18641 GTGATAATCTGCTCCTAGCTGAACA | 29625 ACTGAGCCTGGCCCTGTTGTA | 40609 |
| 6984 GGGCTACACTGATGACAGCTT | 18642 GGACAGGACAGAGGATTCATGCTAATG | 29626 AGAGCCCTTGGGGCTACACT | 40610 |
| 6985 GCTTTGGAATTTGGGGTGACCTTTC | 18643 AGACTGGATGCTGAAATCCTTGAA | 29627 GGAGAACCACTGAAGCTTTGGAAT | 40611 |
| 6986 GCCCTTGTTCATGGATAAAGAGCATTTG | 18644 TCATGGCTCCCCTCACTTCCTA | 29628 GAGCAGCCCTTGTTCATGGAT | 40612 |
| 6987 CCAGATGCCCATGATAGTCCTTTTC | 18645 CCAGGCCAGTTCTGAGAGGAAACA | 29629 GAAAGTGACCAGATGCCCATGAT | 40613 |
| 6988 GAGGCTGATGGAATGGTAAAGCAA | 18646 GGGTGACAGCTTCTTCCTAATGT | 29630 TGGTGATGAGTATGAGAGGCTGAT | 40614 |
| 6989 CCCTCGGTTACAGCAACAGTTC | 18647 GCATCCAGTTATCCAGAGAGCATGAGT | 29631 GTGTGTGTAGAGTTCCCTCGGTTAC | 40615 |
| 6990 GGGGATCAACGAGAGCCTAGAGT | 18648 GTCAAGGGAGACTAGTAAGTGGGTCTT | 29632 TAGCACCCACACGGGGATCAA | 40616 |
| 6991 CCCAGAGATAGTTCCTACTGACCTT | 18649 CAGAGAAGCAAAATGTGATCTGTGT | 29633 CTGAGGACAGACACCCAGAGATAG | 40617 |
| 6992 CGCCAACAGGGTTTGGAGTAGT | 18650 CAGGCCTGAGAGAAATTCACAGTTG | 29634 CCTTGTCAGGGTTTCGCCAACA | 40618 |
| 6993 CCTGACCATCTTTGCAAATCAGGCTTTA | 18651 TGCAGAGGACCCACTAGTCCAA | 29635 CGTGACTGCCCTGACCATCTTT | 40619 |
| 6994 GGGTACCAGTCCTTCCACTTTTG | 18652 GTCGTTAGGCGATGCATGATTGTAA | 29636 GGCCTGGGTACCAGTCCTT | 40620 |
| 6995 GCTTGGGGCAAGAGTTGTTTAC | 18653 GCGGTTTGAGGTATAAATGGAAGTGA | 29637 ATTGCCCTGCTTGGGCAAGA | 40621 |
| 6996 CAGGGTGACTGACATGGGTTT | 18654 GACATGAAGACTCGCTTTGCAATTGTATTC | 29638 TCGTGCCACAGGGTGACTGA | 40622 |
| 6997 AGGAGTTGCCTCTGGGTCAGTT | 18655 GGCACTAGAGGCTTAAGCACAACTT | 29639 AAGCCTGCTTTCCTAGGAGTTG | 40623 |
| 6998 GAAGATTGGGCATGGTTACATCCATATAC | 18656 GGTTTAGGAAGCCTCTCTCTCCAA | 29640 AGTGAAGATTGGGCATGGTTACA | 40624 |
| 6999 CCTGCCTCACTGCTCCTTCT | 18657 GACAGTTTTCACTTTGCAGGAAGTA | 29641 TCACGGTCCTGCCTCACT | 40625 |
| 7000 GGGAGGAACCAAGTTCCCATTG | 18658 GGCCAAATTATGGGTGGGTTAGCAA | 29642 TACCCCTCCTGGGAGGAACCAA | 40626 |
| 7001 CAGTATCACAAGCCTCACTTTGGTTTC | 18659 GGTACTGGGCATTGTACTTGACT | 29643 CAGAAGGAAGCTACCAGTATCACAA | 40627 |
| 7002 CAGAAGTGGTATTCTGGGCATGAAC | 18660 GCTTCCATGAGCTGTCCTCAATCT | 29644 CTGCAGTTGGATCAGAAGTGGTATTC | 40628 |
| 7003 GCTGCTACTTCTTCTTTTGGCTAACTTC | 18661 ACCCTCTCCCAGCCCTGAAAA | 29645 GGCCTGATTCATGTCTGCTGCTA | 40629 |
| 7004 CTCACACAGCCTTCTGGGATCA | 18662 GGGCTCTCTGAGTGAAGGATGT | 29646 CACTGAACTAGTTGGTTCTCACACA | 40630 |
| 7005 CCATGTAAGGTGGGTGGAAGGAA | 18663 GTGGCCTTCCTCTGAATGAAGT | 29647 AGCAATGGAAAACACCTCCATGT | 40631 |
| 7006 GGGATCTCTCACTCCACAGT | 18664 GACAGACAGAGGTAATGCGGTATACTTG | 29648 TGCAAACATCTTTGGAAGGGATCT | 40632 |
| 7007 GGCCAGGTTAGGAAGGCTTTA | 18665 CCATCCATGTCCCAATCCAGAGTT | 29649 GGATCTAGTGATTGTTAGGCCAGGTT | 40633 |
| 7008 GGAGGCTGTAGTTGCTCTCATATCTA | 18666 GCACACAACACTACCCATTTTCTGA | 29650 CCCCACAAGTAGGAGGCTGTAGT | 40634 |
| 7009 CAGCTTGGTAACCCACATAAATACTCAAC | 18667 CGATTGTATTGCCTTTGCTCCTTTGT | 29651 TCAAAACAGCTTGGTAACCCACAT | 40635 |
| 7010 CCATAACCACACAGGAAGTCTGATG | 18668 GGCCAGAGATAGCATCCTCTGAAT | 29652 GGAATGTCCACTCCATAACCACACA | 40636 |
| 7011 GAGGAGCCTGGAACTGACCAAA | 18669 CGAGCCTGCTCCCCTTACA | 29653 GCCCGAGGGAGAGATTGAAGA | 40637 |
| 7012 GGGAGGAATGTTTACTTTGCCTTGACA | 18670 GCCTCCAAAGTGACAGGAGTGA | 29654 CCGTAGCCTGGGAGGAATGTTTAC | 40638 |
| 7013 ACTCGCTATCCTTTTCATGTTGGAT | 18671 GGTGGGCAAGGATGCTACTCAA | 29655 CCATTGCAGAAACTCGCTATCCTT | 40639 |
| 7014 GCAAGAGGAATGGACAGTAGAGAAG | 18672 CCTGGGCAGTTCAGCTTGTTGT | 29656 GTCAGCTACTGGGCAAGAGGAA | 40640 |
| 7015 CTTAGCGTCACACAGCAGACA | 18673 TTGCCTAGAAACGGGTCTGA | 29657 GCTTCAGCTGTCTTAGCGTCACA | 40641 |
| 7016 GACCTCACCATCATCCATGTGTTC | 18674 GCCCTCAAAGACCTCACAGATT | 29658 TCTCGCTCTGACCTCACCAT | 40642 |
| 7017 TGCTCCCCTGAGATGAGACT | 18675 GCTCCTGACCTCACAACAACTTTCT | 29659 TGGTGACGGGAGTTGGAATG | 40643 |

FIG. 36K8

| | | | |
|---|---|---|---|
| 7018 AGCCATCTACCACTGTTCTTTCAAT | 18676 GGCACAAACCTGAGAACTTGAAC | 29660 CCATTTCAGCCATCTACCACTGT | 40644 |
| 7019 GGGCAAATTCCCCGACATCAGA | 18677 CCTAGCCAGGTTTCCGTTTAG | 29661 CCAACCTCAGAGGGGCAAATTC | 40645 |
| 7020 GGTATCCGAATGGAGGACCAAGTAAT | 18678 GCGAAGGACGTCAGCGATGTAA | 29662 GTTCCCTGGAGGTATCCGAATG | 40646 |
| 7021 GGCCCGCCTCAAAAATCTACCAA | 18679 GATTGTGGTATAAGGTGGGTTTAGTTG | 29663 CCTTGGCCCGCCTCAAAA | 40647 |
| 7022 TGGCCAATAGAATGTGTGAGGAAT | 18680 CTCTCAAAGGCTTTTACCTGGGAGTA | 29664 GGCATGGCTGTGACTTGCTTTG | 40648 |
| 7023 GGGCGGAAAAGATACACCCCATAA | 18681 CCAACCTAGCCCCACTAATTTCT | 29665 CACACTGAAAATAAAAGGGCGGAAA | 40649 |
| 7024 CAGCATCGCAGTCCTGTTATTTC | 18682 CAGAAAGTTCACCAGAGCACAATC | 29666 CGGAATGAGGATGGCAGTTACA | 40650 |
| 7025 CACGCTTAGATTTCAGTGAGCAAGA | 18683 GGGAGTATGCCCCTTTGCTGTT | 29667 GCCTGTGCCATCACGCTTAGA | 40651 |
| 7026 CACTGGTTTCTAGGACCATGTAAAAG | 18684 GTCAGCAAGAACCCCTTCAAGT | 29668 ACAAGGAAGCTGTCACTGGTTT | 40652 |
| 7027 GTGAAGATCCACAGCTCGGAATAC | 18685 GCTGTGGTGATCGTGGTTGT | 29669 AGGAGCACGGCTGTGAAGAT | 40653 |
| 7028 GCTAGGTGGTTACTTTAGGTTGGATAG | 18686 TCTTTCCCCATCTAGAATGCTCTTTTC | 29670 GCTAGAGGATCGCTAGGTGGTTAC | 40654 |
| 7029 AGGTAACGCACTGACTTTTGAGT | 18687 CAGGCTGCTCTTGGGAAGTT | 29671 GCTCCGGGCTTCAGTTTTAGGTA | 40655 |
| 7030 AACTCGCCAGGGCTGTTGAT | 18688 CTCCCTAGAGAATCCTAAGACCAACCAA | 29672 AGGGTTACGGGCAGAGAACT | 40656 |
| 7031 CCTCCTCAGATGACCAGAGAAATC | 18689 GCATGGCTGAAGCTGAATCTTG | 29673 CCCTCTCCACCCTCCTCAGA | 40657 |
| 7032 CCTCAGTCAGGTTTCCAGAAGGTACT | 18690 GCCCACAGTGGTTCAGTCTTAG | 29674 GTGTGAATGCCCTCAGTCAGGTT | 40658 |
| 7033 GCAACCGGTGCCACCATAGA | 18691 GCCGGAGAGCAACGCACAT | 29675 ACACAGTGCTGGCTGCAA | 40659 |
| 7034 CCCCTAACTCGATTGCCAACAGAA | 18692 GCAGGCTAAGATTACTCGTCTAAACA | 29676 GAAGCTCTTACCCCTAACTCGATTG | 40660 |
| 7035 CCTGGGAGGTAAGCCCATTGTAAG | 18693 GAACTTGAATCTGAAGGGACTATGGAT | 29677 TGATGGGCTTCCTGGGAGGTAA | 40661 |
| 7036 CCAGACCTCAGAAATGTCCTGTTC | 18694 GCAGGCTGTGAGACCATGAAAT | 29678 TGGTTGACTGCCAGACCTCAGA | 40662 |
| 7037 GGAGACTGGCTTTGGCAACACA | 18695 CAAGGAGACAGATCCTTGGGAAAG | 29679 TCTTGGCAGACAGGGAGACT | 40663 |
| 7038 TGCCCACACAACCTGGTGCTT | 18696 GGCAGGAACTCAGGACTCAAGA | 29680 GCAGCTTGCTGCCACACAA | 40664 |
| 7039 GGATCTTGCGTCCAGGCCTTT | 18697 GCCACCCTCCACTACACTCCAT | 29681 TGAGGGCCTGCTAGGATCTTG | 40665 |
| 7040 TGGGTTTAGGCGGCATCCTT | 18698 CCAAGAGGAACTTTTTGGCACTGA | 29682 GCAGTCGCCAACTTCTGGGTTTAG | 40666 |
| 7041 GGCCTGCATCAAACAGGGAAT | 18699 GCCCACCTTTGGCCTTCTCT | 29683 GTCAAAGCTGGCCTGCATCA | 40667 |
| 7042 GCTGGATGGTATGTAGCCAACT | 18700 GGGGAGAGGCACTGAATACCTT | 29684 ACTGCTGCCCTCTGCTGGAT | 40668 |
| 7043 CCCCAAAGTCTGTGCTTTTCCTACT | 18701 GCTTACAGTAGATGCGGGAAGA | 29685 CCTCTCCAACCCCAAAGTCTGT | 40669 |
| 7044 CCTCTGGAGCATTGCCAGATCA | 18702 AGCTGAGCATCGGTAAATTCCAA | 29686 TGGTCTTGCCCTCTGGAGCAT | 40670 |
| 7045 GGATTCCAGCAACTTTCAGCAGGTA | 18703 CCATGGCTGACCATGAACTCTAC | 29687 GCCTGTTGGAGGATTCCAGCAACT | 40671 |
| 7046 CGCTTGTCCCAGGATGGACTTAG | 18704 CACCCAGATGGCTGATTGTCTCTTC | 29688 GCAAGGAGCACATCGCTTGG | 40672 |
| 7047 AGGGCATGTCCACTGCATTC | 18705 GCATGCCTGGGAGGTAAAGAATTG | 29689 TGTGAGTGCAGAGGGCATGT | 40673 |
| 7048 AGTGGGTCTGTTCCTCAGTAATTC | 18706 CTGCTGGGGAACCAGTTGCATA | 29690 ACTTCCGGGTAGTGGGTCTGTT | 40674 |
| 7049 GCAAATGGCCTGGCTAGAAGGAA | 18707 CCACGCCTCTCAGTGGTAGAAT | 29691 GGGTTTCACGTGGGAAGGCAAA | 40675 |
| 7050 GCTGTGTACCAGAATCTTCTGTTTTGT | 18708 CTGGCTCATATCCTACGAATCCATCT | 29692 AGGACTAGCTGTGTACCAGAATCTT | 40676 |
| 7051 GTCCTGAGAGCTGTCCCTTTATG | 18709 GTCTACACTGATTTCTGGAACGATGA | 29693 CAGCTTACTGGCTGTCCTGAGA | 40677 |
| 7052 CCAGACTTGCCTTCAAGCATGTTA | 18710 GCAGTTATCAGAAACAGACAGAGTAGGTAA | 29694 CCCAACCAGGGATATCCAGACT | 40678 |
| 7053 GTCCATCTCACTGCGGAGAAGTT | 18711 CCTGCCGACTCATTCTCCCTATG | 29695 CCATCACAGCCTGTCCATCTCA | 40679 |
| 7054 GGCCGAGTCAAACAAACGATGTTG | 18712 GCCCACAACTCAGCTAGCCCTAA | 29696 CACAGAGCCCGAGTCAAACA | 40680 |
| 7055 GCAGTTTATCCTTGGGACAGACAGT | 18713 GCATGCAGGAAAGTCAAATCCAT | 29697 GGAAGGGGCAGCAGTTTATCCTT | 40681 |
| 7056 CCAAAGGCCAGGAAGAGGGTAT | 18714 CCAAATTTCTGGCCTCCACTTG | 29698 TGGGGAAAGTGCTGCCAAAG | 40682 |
| 7057 CTGAGGAAGTCCATGTTTCCCCTTA | 18715 TCTCTCACGACAGCAATTGGTTAT | 29699 GGGTCAATCGTTGGCATTATCTGAGGAA | 40683 |
| 7058 TCGCCCCTTGAGTGAGAGAAGA | 18716 CAGCTGTTGCCCAAGCTTCATC | 29700 TTACCACCTCGCCCCTTGAGT | 40684 |
| 7059 GCACTTCCAGTTGCAGATACCTT | 18717 GGCCTGTAGTGGGAAGAAGTGAA | 29701 CATTTCATACCTTGCACTTCCAGTT | 40685 |
| 7060 CCACCCTGATTTCGGCTTTGTGA | 18718 GGTCCAGGTCTGTGCAGGAATC | 29702 CCAGCCACTAATTTTCCACCCTGAT | 40686 |
| 7061 CATCCCTGAATTGTCAGTTGTTCCAT | 18719 CTCAACACAATGCTCGTCACACA | 29703 CCATGTCTGTCATCCCTGAATTGT | 40687 |
| 7062 CGGCTCCATCCATCAGTTCCTGAGAGT | 18720 CACTGAATGGCATGGGGAGAAATGT | 29704 GCAGCCGGCTCCATCAGTT | 40688 |
| 7063 GCCTCTGGCTCAAGATGTCTCACA | 18721 ACCACAGCCCCTGCTGACTT | 29705 AGGTAGATGCCTCTGGCTCAA | 40689 |
| 7064 ACCGGGAGAACGCACTTCA | 18722 GTTCAGTGACTCTCACCCACAAGT | 29706 CCTCTGTCGTATCACCGGGAGAA | 40690 |
| 7065 ACCTCCTTTCCCCAGCATGAAG | 18723 GCCAGTGACTTTGATGGGAGAAGA | 29707 CCGATGCTGCCTTAACCTCCTT | 40691 |
| 7066 CCTTCCAGAAGCCAAACACAATCTCA | 18724 TCCAAGGCCCCTTCTAGACTTG | 29708 CTGCTCCTTCCAGAAGCCAAAC | 40692 |
| 7067 GTCTCGATGTAAAGTTGAGGACTCT | 18725 AGCCTCCTGAGGCCAGAAAA | 29709 GGACAAACCCAGAGTCTCGATGTA | 40693 |
| 7068 GAGGCTAGTTAGCACCAAGTCTGA | 18726 TGTCCTAAGCCCAGTGCAAGA | 29710 CGAGGTTTAAGAAGTGAGGCTAGTT | 40694 |
| 7069 AAGGATGTACCTGCAGGGTTATCTAC | 18727 CTGCGAGTGTGCCAAGTATTTGAT | 29711 ACAGAAGACCCGAGAAGGATGTA | 40695 |
| 7070 CACCAAGATGGGTGATGATGGTT | 18728 CCAGTGAGGAACATTGCCTGGAT | 29712 GCAAGATGCTGTTTTCTTCACCAA | 40696 |
| 7071 CGTCTCAGTGACTTTGGCAGTGAT | 18729 AGCCGGCAGGAGGAGGAAGA | 29713 TGAACCCCGCTCTGGTCAGTGACTT | 40697 |
| 7072 GACTGTTGTGGTGCAGCTTGT | 18730 GACCTGGCTGAAAAGTCTGTAAGT | 29714 AAAAGAAGGCCCTGTAAACAGACT | 40698 |
| 7073 GCTTCAGGAAGCCTTTAGGAACT | 18731 GGTCCTAACTGCCCCTGTTCA | 29715 AACCGGGACAGACGGCTTCA | 40699 |
| 7074 GATAATCAGGTAGATAGGATGACCTGTTC | 18732 GCTGGGGAAAGAGGCTGAGTAA | 29716 GCAGAGGAGGATTTTGATAATCAGGTAGAT | 40700 |
| 7075 GGGCAGCTCTGAACTGTCATTG | 18733 CCTTTGCAGTTCACCAATGTTTTGT | 29717 TGATATCGGGGCAGCTCTGAA | 40701 |
| 7076 GCCAGAGAAACCTAAGCTGAACATA | 18734 GGGTTCTGGTGCTTGGGCTTTA | 29718 GGCTGTATTGCCAGAGAAACCTT | 40702 |
| 7077 GCAAGCACTTGTGTGAAGTATTCCAA | 18735 CAAGGTGTTAATTGACCTCTCTGTTGA | 29719 CCAGAAAAGCAAGCACTTGTGTGAA | 40703 |
| 7078 CCTTTATTCCTGAAGGATCTGGGTTGT | 18736 CCATGCCCTGGGATTAAGGTCAA | 29720 AGCTACCCAAACCTTTATTCCTGAAG | 40704 |
| 7079 GACAGGTGTCTAAAACTTCTTCCTGTA | 18737 CTGCAGGTAACAATGCAACACAAG | 29721 GGCCATGCTTGACAGGTGTCTAAAACT | 40705 |
| 7080 GCTGGCCCTTTAAATATCCCAGAGA | 18738 TGCAACGAACTTTCTCCTCCAT | 29722 GGGAAAAATAGGTGCTGGCCCTTTA | 40706 |
| 7081 TGGCCCTCAGAGTCACAGTGTA | 18739 CCTTCCTGGGACATGAATGTGA | 29723 CTAGAAGGGTGGCCCCTCAGA | 40707 |
| 7082 TGACTGAAAAGCACCCTAGCAACA | 18740 CGGGAGGGAAGGGGAGAAATTAG | 29724 GGTGGGCTGCATATGACTGAA | 40708 |

FIG. 36K9

| | | | |
|---|---|---|---|
| 7083 | AGCAACTGTGCTTTTGAGAGGAT | 18741 GTCTCTGAAGTCCAGGCTAGTGAT | 29725 GGCAGTGCCTTTGGGTAAAGCAA | 40709 |
| 7084 | CCAAACCTCAGTAAATGGGGAGATT | 18742 GCAGTGAGGGGCAGAAATTAGT | 29726 ACAACTTTGACTTCCAAACCTCAGT | 40710 |
| 7085 | GGAAGCCCAAACCTCAAGGTAAGA | 18743 CTTCTTCTGACTACAGGGCTTGTT | 29727 CCTACAGAGGGAAGCCCAAAC | 40711 |
| 7086 | GTGCTTGCGGCTTGCAATGA | 18744 TGGCAGACTACTCAAACACATTTTC | 29728 AGCAGCCGGGCAAGGGAAT | 40712 |
| 7087 | CCCGTTTTGAACAGTGAGTCAATTC | 18745 AGGGCCCAACAGTCTGGAAGA | 29729 GTTCTTCACCCGTTTTGAACAGT | 40713 |
| 7088 | CCAATTCTCTGGTGATACTGCGAACA | 18746 GAGATGTTCATGTATGGCATGGTTTC | 29730 GCTTATGTCTCCCAATTCTCTGGTGAT | 40714 |
| 7089 | TCTGGGCAGAGTTAAGAAGGAAGA | 18747 TGGCTGTGGCAGGCTATTCT | 29731 TGTTCAGGATCTGGGCAGAGTT | 40715 |
| 7090 | CAGTTCCCATGTGTGCTGTAGA | 18748 CCCTGAATCTGAAGAGCCAAATCT | 29732 ACAGCCCCTCAGCCAGTTC | 40716 |
| 7091 | CCAGGTACCGATTGGGCAGTTT | 18749 GGCGCCCTGCCATACAATAAG | 29733 TGGGAGGACCAGGTACCGATT | 40717 |
| 7092 | CCTTCCAAGGAGACTCTGGTACT | 18750 AACAGGCCGCTTAAGAGTTACA | 29734 GGAGCCTTGCATTCAGATAACCTT | 40718 |
| 7093 | CAGAGTCAGGTTAGAAGGGCTGAA | 18751 CTCAAGGTGACAGCTAATTGCAACA | 29735 GCTGGTGGTCAGAGTCAGGTTAG | 40719 |
| 7094 | GGGGTTGGGACTATGAGGAAGTGT | 18752 CCTCTCAATCTGCCCTGCAA | 29736 AGTTGAGATGGGGTTGGGACTA | 40720 |
| 7095 | TCCAAACACACATGCCTTTCTCT | 18753 CGGGATCGTGAGTAAGAGCCAAT | 29737 TGCCTGGGTTGCTCTTCCAA | 40721 |
| 7096 | CCACCTGGCCCTGTAGACATTTGA | 18754 CCTGGCCTTAGAGAAATTCACAGT | 29738 AATGACCACCTGGCCCTGTA | 40722 |
| 7097 | GGCTGCCAACTGTACTGGAACT | 18755 GCGCTGAAGCCCAGCAGTAA | 29739 CGGACAATGGCTGCCAACT | 40723 |
| 7098 | CTGTGACAAAGCTGGCACAAACT | 18756 GCCAGAATGGCTTGTAGGTTCCTTTG | 29740 ACAGGACAAACTTGCTGTGACAA | 40724 |
| 7099 | GACACCACCATGAATTCCAGCCTAA | 18757 GTCACTTGCATCCAAGAGTCTTCATT | 29741 GGCCCAATAGACACCACCATGA | 40725 |
| 7100 | TCCCAGTGGCTCTCCTTTCA | 18758 CGTCTGTGGTGAGAAGTGACTGT | 29742 CCACAGCCAATCAATCAGGGAATC | 40726 |
| 7101 | AGGTGGACTAAGTAGAAGTAGGGTATC | 18759 GAGAGCCAAATACGCACCCCTAAC | 29743 GCGGAAGCTATAGGTGGACTAAG | 40727 |
| 7102 | AGGTGTCAGGCTCCATGTCT | 18760 GAGAGCATCTCTCAAGCCAACA | 29744 CAGCCTCCTCTGTCTCTGGAAA | 40728 |
| 7103 | CCTCCTAACTTGACCCAGAGAGCTAA | 18761 CTGCTTCTCCCTTGGGAATGT | 29745 CAAGGACGACATTCCTCCTAACTTG | 40729 |
| 7104 | GCAATGAGGTGAAAAGCTTCTGTTCATAC | 18762 GCACCTTGCAGCCTTAGGAACT | 29746 GACTCGTTCATGCAATGAGGTGAAA | 40730 |
| 7105 | GCGTGTAGCTTTTCAGTCACTCT | 18763 ACTCCATTCCCAACCCTCTTCT | 29747 GCTTGGAAATGAGCGTGTAGCTT | 40731 |
| 7106 | GCTGGCTGTAATGAAGGAGGAT | 18764 GGACACCTGAAGTTCCTTGACAT | 29748 CCTCTCTTCCTTGCTGGCTGTA | 40732 |
| 7107 | CCGTGAGTGCCGTCATCTTGTA | 18765 GTGCCAGGTATGCTGGAAGACA | 29749 TGCCACAATGCCGTGAGT | 40733 |
| 7108 | CCTGTCTGTCAAAAGTCTCTTGCTTTG | 18766 GCTTCAGGGTCAGTGCAAGGTAAC | 29750 CCTCCACCTGTCTGTCAAAAGTCT | 40734 |
| 7109 | GGATTTTCGGACGCATCATTGAGA | 18767 GCAAGTCCAACAATTCGAAGACTAC | 29751 AAAGCACACGCCGGATTTTC | 40735 |
| 7110 | CCCATTTGTGCTTCCACATACTCT | 18768 TGGAAATGCTAGTACCTACTGCTCTA | 29752 GCTTTCCCATATGTTATCCCATTTGTGCTT | 40736 |
| 7111 | CCCTTACCTGGAGCATGGTGAATC | 18769 GTGGGAATTCAGCTCCACATAGA | 29753 TCTCTGTGGCCCAGTCCCTTA | 40737 |
| 7112 | TGGGCCTGTGTGCCTGATTC | 18770 GGGAAGTGACATACTTACTGCTCTGA | 29754 TCCCCTCAGTGGGCCTGTGT | 40738 |
| 7113 | GGCTGATGCATATTTGGGAGTACA | 18771 CCAAGGTGACATAGGCGGAAAG | 29755 AGGGCGATTCTGTGGCTGATG | 40739 |
| 7114 | GGCCAGTCACCCCAAAGACA | 18772 CACAAAGGGCAATGTCAAATGTGT | 29756 AATGGGAGAGGTGGCCAGTCA | 40740 |
| 7115 | GGGAAAAGGCCATTCAGGCAAGT | 18773 TGAACAATCCAGTTGTCCTCAGTTC | 29757 AATCTTGAGAACAAGGTGGGGAAA | 40741 |
| 7116 | CCAGGAGAAGAAGGCCAGTGATG | 18774 TGCATGATGGACAAGGAAGGTTAG | 29758 GGAGTTCAACTTTCCAGGAGAAGAA | 40742 |
| 7117 | GGGCCATGAACAGTGAAAGGATT | 18775 GCCCAACCTGGAAAGGCTTCTT | 29759 GGAATCAGGGCCATGAACAGT | 40743 |
| 7118 | CCACACTGTAGTCCAGTTGAAGGAAA | 18776 GCAAGCGCCTGAAGCTTGGAA | 29760 AATGCCCAGGCCACACTGTA | 40744 |
| 7119 | GCAAGTGTACCTGGTTGGACCAT | 18777 CCCAATAGAAGCAGGTCAGTACAGTTC | 29761 TGATCGTCGTTGAGCAAGTGT | 40745 |
| 7120 | GGTGGAATCCGTGAGCACAAAC | 18778 GCAGGAATGGACATGGGTTTAGT | 29762 GATGAGAATGAGGAGGGTGGAATC | 40746 |
| 7121 | CTCACATAGAAGAAACAGAGCAAGA | 18779 GGGGAGACCAAGGACCACTACT | 29763 GGAACAAGCTTTACTCACATAGAGAAG | 40747 |
| 7122 | GGCTAAACCTCCTGCTGCAATC | 18780 GTGATTTTTCCCAAGGTCCCTAAGA | 29764 CTTTTAAAACGAGCGTTGGCTAAAC | 40748 |
| 7123 | CTCCTATGCAGGTCTCAACTGGTA | 18781 GCTTATTTAAGGAACCAAACGGGCTTT | 29765 CCAGCCACCTTAGCTTCTCTATG | 40749 |
| 7124 | GCCATCCTGGTGTAGCTGGTAAG | 18782 GTGGCTGGCAGTACAGACACAT | 29766 TGGACAGCCATCCTGGTGTA | 40750 |
| 7125 | GCACTCATGCCATTCAGCAGGTA | 18783 CAGAGACAGAAGGAAAACCAGACTT | 29767 GCCGTGCACTCATGCCATT | 40751 |
| 7126 | CCGTCTGTGGTGTCATTGTGA | 18784 GGGAAGGCTCAGCACATACTTC | 29768 AATCCTCTTCAGGATTCCGTCTGT | 40752 |
| 7127 | CACTGGGCAAACAGATCATCA | 18785 GAGAAAGGAGGAGCTGCTTATAGAGT | 29769 AGGGAAACACTGGGCAAAC | 40753 |
| 7128 | GGGATCCTTCCTTGCCTTCACT | 18786 CTGTATCCTCTGAAGTTCCCTTGTGT | 29770 GGCTGTCCATTTCAGGGGATCCTT | 40754 |
| 7129 | GCAGAGAGATGGAGAGATGGTCTT | 18787 GGACTCCTTTGAGGTGTGGGTCTT | 29771 GGGAGCAGAGAGATGGAGAGA | 40755 |
| 7130 | CACCCTCCCTATAGAGCTTCAGA | 18788 CCTTGACTGTGGGAATGACATTGA | 29772 TGGAGTTAAGCACCCTCCCTAT | 40756 |
| 7131 | TGAGGGCAATGTCTTAGAAAGCATA | 18789 CCTCCAGCACCTCATCATCCAT | 29773 CAGCTACATTGAGGGCAATGTCTT | 40757 |
| 7132 | TCTGAACACAGCAAGACTCAAG | 18790 GTGACGTCCACCTGATGTCACAA | 29774 GGGGAGCATGGATTCTGAACA | 40758 |
| 7133 | GAAAGGTGTTGCATTTACTCTCGTATG | 18791 ACAGCTGAGGTTAAGCTTTGTTCA | 29775 GGGCAAAACAGACAGAAAGGTGTTG | 40759 |
| 7134 | GACTAGAGGAGGGTAGGAGGAAGT | 18792 CTGCCTGAAGCTCTGTTCCTTTC | 29776 GGAAGCGATGTTAGGTTAAGACTAGA | 40760 |
| 7135 | GCGTCATCCCTAGCACAATTTTAGACT | 18793 CCTCTCCTCAGCACATACTTC | 29777 CCTGTCCATCCCTAGCACAA | 40761 |
| 7136 | GGCTGTGAGGTTTAGATACACCCTTT | 18794 GCACTGGGAATTTGTGGTTAACATTG | 29778 CCCTGGCTGTGAGGTTTAGAT | 40762 |
| 7137 | GGCAGCCAGACATCTTCTCTAAAT | 18795 GGGACACTGTAGATCAGTGGTTAAA | 29779 TTTGCTCGGCAGCCAGACAT | 40763 |
| 7138 | GCATCAGCTAAATGCATGGTCCTT | 18796 ATGGCCCATGGGGTCACAGT | 29780 CGACAGCAGAGCATCAGCTAAA | 40764 |
| 7139 | TCTGACTTAGGTTTTCTTGGCTGTAG | 18797 TCCTGCAAGGAGACTGGAGGAA | 29781 GCCCTTTCCTCTGACTTAGGTTTT | 40765 |
| 7140 | GCCTGCAGTTCAATAAGGCTACTGT | 18798 TGTGGCAAACATTTATCTGGTAAC | 29782 GCCTCATGCCTGCAGTTCAA | 40766 |
| 7141 | ACTGAGCATGCTTTTGCTCTCAA | 18799 CCAGAGGGTGACATATTTTCTCATGT | 29783 GCCCCAATCACAAACTGAGCAT | 40767 |
| 7142 | CGGTCAAACATGAGGATGAGAAAACT | 18800 CCTTTCAGAGGACACCCTGATG | 29784 TGAGGGATTAACAACGGTCAAACA | 40768 |
| 7143 | CACCGTATAATTAGCGGGAAGTGT | 18801 CATGGCTAACAGCCTGGGTATTG | 29785 GAGGTCCAGTCTCTTTCACCGTAT | 40769 |
| 7144 | TGGAGGTGAGTGCTGAGACAGA | 18802 GACTTTCAGTAGGGTACCCCAGATTC | 29786 GCCACCTGTTTGGAGGTGAGT | 40770 |
| 7145 | GGGGAGGAAAGATGATGAGGGAAGT | 18803 CAGCTGCTTGCTAAATACTCCATTTGT | 29787 GGTTTGCGGGGAGGAAAGATGA | 40771 |
| 7146 | GGGTGGCCTAGTTGAAAGAGTGAT | 18804 GTCCTGCATCTCTCACCACTTAC | 29788 GGGATTGGGTGGCCTAGTTTGA | 40772 |
| 7147 | GAGCAAGCAAGCAGCACACT | 18805 GTGTGGAAAAGGTTAAGGAGACAGAA | 29789 GAGGAAGGGAAGAGCAAGCAA | 40773 |

FIG. 36K10

| | | | |
|---|---|---|---|
| 7148 CCTGTAGTGATTTCCAAGACCTCACCAT | 18806 TGCCTCCCAAGTAGGATAGAACT | 29790 GCAGCACACATCCTGTAGTGA | 40774 |
| 7149 GCATGTTATTCTCTCCAGGTCCAGAA | 18807 CCCGCTGAACAGGTTCTTGAGT | 29791 GCAAGCTGAAACTCTGGGCATGT | 40775 |
| 7150 GCAGTGTCTAGCACACAATGTCA | 18808 CCATCTAACCATCCACCTCATTTTTCAAAC | 29792 CATCCCTGGAATTAGCAGTGTCT | 40776 |
| 7151 CTTGCACAGTGTAGAATCTGAGGAT | 18809 CCAGAGCACTCCTCTCCCAAAAAG | 29793 GAAGAGTGAGCTTCTTGCACAGT | 40777 |
| 7152 CCAACCCTGATTCATTCCAGTAATGTT | 18810 CTTCTCAGTCTGTATGCCTGACTCT | 29794 GCCCAGGTTCCAACCCTGATT | 40778 |
| 7153 CCCTTCCTGTTCTCAACCTGTGT | 18811 GTATTACCGCAAAGGGAGCAAATG | 29795 GCTTCTAGTATTAGCCCCTTCCTGTT | 40779 |
| 7154 GGCTTATGAACCAAACCACTTGTCT | 18812 CCAGTATCCACTCTAACAGTCAAAGGAA | 29796 CCCCTGGGCTTATGAACCAAAC | 40780 |
| 7155 CACTGTTCTGTTACTGACAGGGAAAAAG | 18813 CTGCACACTGTTGGCAATGACTT | 29797 CCACCACCACACTGTTCTGT | 40781 |
| 7156 GGGCCAGCTTGTGGAGAGT | 18814 AACCCAGGAGCCTCAGAGATGA | 29798 GCAAAAGTGATTGGGGCAGCTT | 40782 |
| 7157 GCTGATGAGTCAAGTGCTATCTGT | 18815 CAGATCCACAAAATCAGGTCTCACCTATC | 29799 GGCTGGGAAGCTGATGAGTCAA | 40783 |
| 7158 CTCTTGTCTACTGAGCCATTGCAGTT | 18816 GGAAAGAAAAGGGTGCTCTGGAT | 29800 GGACCAGCTCAAATGTTCTCTTGT | 40784 |
| 7159 AGGAAGCACCAGGAACCCATCT | 18817 GGACAGATCCTGCCTGTACCATTG | 29801 CTCTGGAAGATGGTGGCATAAGGAA | 40785 |
| 7160 CACTTTGGGCTCCTCCTTCCTTT | 18818 CTGTAACTCCCATCCTAGCCTTCT | 29802 AGATTGCCACCTGGACACTTTG | 40786 |
| 7161 TGGGGATGACTACTTTTGCTATTGT | 18819 GGGGAGAAGAAAGGGAGGACAAA | 29803 GGGATGGTGATGGGGATGACTA | 40787 |
| 7162 GGGAAGGATTCCAGTGGTCGAT | 18820 GTGATGCACAAAAACAGGCACAA | 29804 GGGAGAGCAACAAGAGGGAAGGAT | 40788 |
| 7163 CTCTTGGAAAAGTGAGAGCGTTTTG | 18821 CAGGGCCTCCTGACCTGTTC | 29805 GCTACACAAACTGCATCTCTTGGAA | 40789 |
| 7164 CTGGGGTAGTATGTTTGCCCTTCTA | 18822 ACTTCATCCCTCGAGTTGTGTATC | 29806 GGTGACCTAGCTGGGGTAGTATGT | 40790 |
| 7165 GGTACCCGAAGAAGGCTATTCCAA | 18823 AACGTGGCCAGGCCTTCA | 29807 CTCCTGCAGGTGGTTCAAGGTA | 40791 |
| 7166 GGGCAGAAGAGTGGAAACAGCTA | 18824 GCAGCGTGAAAACGGACTAATACAAAAC | 29808 TTAGAGGCAGGGCAGAAGA | 40792 |
| 7167 GGTGGTGCCTTATTGCTGCAT | 18825 CTGCATTGTGAGGACACAGCATTC | 29809 CTCTACTTCCAAGGTGGTGCCTTA | 40793 |
| 7168 TGGAGTGGCAGGAGTCTTCA | 18826 GGATATCAGTTTGTTTCCCAGGCTTT | 29810 GAAATTCAGTGGGCTGAGAACCTT | 40794 |
| 7169 TCCTGCTAGGAGGGTGATCTCT | 18827 TCCTTCTCCCCTGTCTGTGAAG | 29811 TCAGCCCTCTGCATCCTGCTA | 40795 |
| 7170 GGTGGTACTGGCCCTGAACA | 18828 GGAGATGAGACTGAAAATAGGTAGGTT | 29812 TTCCACAGCAGGGTGGTACT | 40796 |
| 7171 GATTCCAGCTACCCCAGCTTTC | 18829 GCCTAGGATTCTTCGCAAGCAGGTA | 29813 GTGAGGCATGCGCAGATAAGATTC | 40797 |
| 7172 GATGAAGATGGCACTGGATGTTTC | 18830 TCGGTAGCTGTGGGAGGTAGA | 29814 CGTGCCTCCTGCAAGATGAAGA | 40798 |
| 7173 GTCCAGCATAGCCAGTCACTT | 18831 CCTTGGCACCTCCAAATACTCT | 29815 GGTGAAGGACTCAGTGTCCAGCATAG | 40799 |
| 7174 CAGCAAAGCTGCAATTTGTCTATCT | 18832 GAAATGGAGCCATTAGGTAAGGTGTT | 29816 GGTGACACTGCCAGTAACAGCAA | 40800 |
| 7175 CCTTGTATTCATTCCATACCTGCTCTTTG | 18833 GCTGGCATAGGTAGCCAGGAAAC | 29817 GCCCTCCCCTTGTATTCATTCCAT | 40801 |
| 7176 CCCAGACCCACCTTACAGGTTCT | 18834 AGGGGACAGGTGAGCCAGAAAT | 29818 TGAGCCCAGACCCACCTT | 40802 |
| 7177 TCTTGAATCAGACAAAGAGCACCAT | 18835 TTGCTGGGCTGTGGGCACTTC | 29819 CTGGAACTGCTGGTTAATCTTGAATC | 40803 |
| 7178 CATGGACTCAAGACTCCACACA | 18836 GGGGATCCACATGGTGAATGT | 29820 TCTCCAGCGTCATGGACTCAAG | 40804 |
| 7179 GGTCAGAGCAGGCATTGTTGT | 18837 TCCACCAGTCAGCCAAGACTCA | 29821 GGTAGAAAGAAACAATTCCAGGTCAGA | 40805 |
| 7180 TGGGTTTGAGGCACAGTTAGATG | 18838 TCCCAACTGCTTGTTGAGGTT | 29822 GGGTTTTCAGGGGTGGGTTTGA | 40806 |
| 7181 TGTGGACCAGAGCCTCATGTA | 18839 GGAAGCCATGACTAGGCTACAGT | 29823 GCAGATGGAGGTTACCAAACTTGT | 40807 |
| 7182 GGGGTGCCATTTCAGCTACCAT | 18840 CGCAGGCATGCTTCCGTTATAG | 29824 TGCTCTGTGGGGTGCCATTT | 40808 |
| 7183 TCTCAGCTCTTAGGCAGAAATCTTAC | 18841 CCAATGCCAGGGACACTTCT | 29825 CCCTCTTACCCCATTCTCAGCTCTT | 40809 |
| 7184 TCTGCCCTTACCTCCTTCTTCT | 18842 CTAGCTGTTCCTCCAAAGAGTAAGT | 29826 TCCCCTTCCTCTCTGCCCTTA | 40810 |
| 7185 ACCGAGTTAGAGCCTTGACTTTC | 18843 GGTGATTGTATGGGAAGCGGAATCT | 29827 AACATCTGCCGACCGAGTTAG | 40811 |
| 7186 GTCCCAGGTTAATGAGTCTAGAGGAA | 18844 CACAATTGCCTCTTTGGCAGTTC | 29828 CCCTTAAAGTCCCAGGTTAATGAGT | 40812 |
| 7187 CCCCTGATGATCCACACCCATT | 18845 CCACCTTGCCCAGTGAAGAAGT | 29829 ACCTGGATGCCCCTGATGAT | 40813 |
| 7188 CCATTGAATGTAGAACATGCCTCTCT | 18846 TGCAACCTGGTAGCTCAGAGT | 29830 GCCTTTGCATTGTTTGGCATTG | 40814 |
| 7189 GCCAGCACTTCTGGATGTTACATTG | 18847 GGTAGATCAGCCTTCACTGTGTGT | 29831 AGTTTTGCCAGCACTTCTGGAT | 40815 |
| 7190 AGGTTTCAGGCCATCCCTCTCT | 18848 GCACCATGGCAGGTCCAGAA | 29832 GGAGTTTGAGAGCCAGGAGGTTTC | 40816 |
| 7191 GAGACTTTCGCCAAGGTTTTCAGCAAT | 18849 GGTGCTGCAAACTGGTGCTA | 29833 CTGATCAAAGGGCAAGGAGAT | 40817 |
| 7192 GGAAGGGCTGTTTACAGAACAAGTACA | 18850 CCTGCCTTTGCCATGTCCAGAT | 29834 GCTAAGGTGGGAAGGGCTGTTT | 40818 |
| 7193 GGTGCCATAGAATTACTCCAAGGGTCTT | 18851 GTGTTTCTCACAATGTTCGGTGCTT | 29835 TGGGGTAAACGGTGCCATAGA | 40819 |
| 7194 GCAAGAGTCCATGATAGGCATGT | 18852 CCCAGTGCAAGGAAAGGGTAATG | 29836 GCCTAGAATTCAAGAGTCCATGA | 40820 |
| 7195 GCCTACACTATTTCATCCCATGGTAAAC | 18853 ACCTTGCACATAGTTGCATGTTG | 29837 GGGGATGGCAGCTTATGCCTACA | 40821 |
| 7196 ACTTTGTGATGTGTTCCTACCTCTT | 18854 GAGGAAGCAAGGGAGCTGTACT | 29838 CCCTAGGAGAAGACACTTTGTGA | 40822 |
| 7197 GACAGAAACCTGTTTGAACTCATGGTA | 18855 GCTAGGTTACTGTATGCCCTTGAAC | 29839 CCACCATGACAGAAACCTGTTTGA | 40823 |
| 7198 GCTCTAGAGTATGACGGGACACA | 18856 GACCTTTTCACTAACACTGGTGAGACT | 29840 CCATGCAACCCGAGGCTCTA | 40824 |
| 7199 GAGTGCTCAAAAGCTATTCCCAGTT | 18857 GCCTTTCCAGCTCTCTGTTCT | 29841 CCTAGGCACCTGAGTGCTCAAA | 40825 |
| 7200 CCTTGGCCTGAATCCTCCTACA | 18858 TGTGCAGTTAGAAGGGAGACAAG | 29842 GATTTGCCTCCTTGGCCTGAA | 40826 |
| 7201 GCAGCAGCCTGTGCTTTCAT | 18859 CATCCTGTTTTCTCCCTCCATTCA | 29843 GCTCATGGCTGATTCACTCACT | 40827 |
| 7202 ATGTGAGGTCACACTTCCTTTGAT | 18860 TGGTGAGGTATAGTGGAAGTTCAGT | 29844 CCCGTCCCAGGTGTCATGT | 40828 |
| 7203 GCCTGCTTTAAGACTTTTTGCAGTTC | 18861 GGTATCTGGAGAATGACTTGTTCCAA | 29845 GGCTGAAAAGGTGCCTGCTT | 40829 |
| 7204 AGGTGCAAAGGTAGAGGAACAAC | 18862 GCTTCGGTAATGCTTCAGGTGTGA | 29846 TTGGTAAGAAGAAGGTGCAAAGGTA | 40830 |
| 7205 CCAGGACTCTCTCGGTTGAGTT | 18863 GCGCCAGGGACAATTTCAGA | 29847 GGACTGTAAGCCAGGACTCTCT | 40831 |
| 7206 CTTGTCTTCTCAGGTTGCTTGTTT | 18864 GCCTGTCAGTCACATGCTTCT | 29848 CCCCTGCCCCTAAAACTTGTCTTC | 40832 |
| 7207 GTGACTGTAGCATTCCCAGTTCTCT | 18865 GGACAATGATGGAGAAATCCCTGTA | 29849 GCTGCCAACATCTGTGACTGTAG | 40833 |
| 7208 CCCTGATCAAATCATACCTGAAGTCAA | 18866 GGCCCAAATAACAGGAAGTGCCATAAT | 29850 GGAGAGAGAACCCTGATCAAATCAT | 40834 |
| 7209 GGGACTTTGGGAACACACAGCAT | 18867 TTGGGCTCGTGGTCTGCTTCT | 29851 ACGAACGCACACGGGACTTT | 40835 |
| 7210 CCAACACTAAAAGCAACCGTTTGAA | 18868 GGCTAGTAGACAGAAGTGTTCCTATAATG | 29852 CTGGTGCTTCAACACTAAAAGCAA | 40836 |
| 7211 GGGGCTGTATTGCAAAAGATGCTACT | 18869 GAGGGTTCAAACTGACAGCAGGATT | 29853 AGAATAAAATCTGCAAGGGGCTGTA | 40837 |
| 7212 GGATGGGAAAGAAATTGGTCTGGAAAGA | 18870 GGGCTCCAAAAGCAACACACT | 29854 CGAAACACACAAGGATGGGAAGAA | 40838 |

FIG. 36L1

| | | | |
|---|---|---|---|
| 7213 CTCCAAAGGAACCTTCCCAGTAAA | 18871 TCCACAGGCTAAGGGTAGAAGAA | 29855 GTGGAGCTCATCTCTCTCCAAAG | 40839 |
| 7214 CCTTCAGCCTTGTCACGCTTCT | 18872 CTGAGCATCAAGCTTGTCCTTCTTC | 29856 GTCTTTACCACCTTCAGCCTTGT | 40840 |
| 7215 ACACTATGTGCTTTTGCCACAGA | 18873 CCAGGCTGGGACCTAATTTCAGCTA | 29857 GGGCCCAGACACTATGTGCTT | 40841 |
| 7216 TGGACTGTGCAGGTGTCTGA | 18874 GAGAGACCTGAGAAACCCCGAATC | 29858 GGATCAGGCTGCTGGACTGT | 40842 |
| 7217 AGTCCCCATTATTGTGCTCGTT | 18875 AGCTGAGAGCAGTCTCTGGAT | 29859 GGTTGTAGAACTACAGTCCCCATT | 40843 |
| 7218 CAGGGTCTCCACTCTGTAACTTTT | 18876 GGTTGTAGTCATGATAACTGTGTGCAT | 29860 GGGTTAATTCAGGGTCTCCACTCT | 40844 |
| 7219 GTGGGCTAGAATTTTGGCTCTGACA | 18877 AGGAGCAAGCGCAAGCAAT | 29861 GGGGTCAACAAATGTGGGCTAGA | 40845 |
| 7220 ACAGTAGTGTGAAACCAGGGAAAT | 18878 CTCAGAGAATAAGAGGTGGCTTTCA | 29862 CGAGAAACGGATCATTAAACAGTAGTGTGA | 40846 |
| 7221 CCTCCGATTGCTTTTTGTGTTCCTA | 18879 CTCTGACCTCAGACATGCAGGATT | 29863 CCTAAAATACCTTCCTCCGATTGCTT | 40847 |
| 7222 CTGGCTTCAGAACTTTCTCCTCTAT | 18880 GGCAGACAGGATATTTAACGCTTGT | 29864 CGCTGGTTTCTGGCTTCAGAACT | 40848 |
| 7223 CAGGCAGGGAGCTTATTCAGATCTAC | 18881 GCAGAACCCTACAAAGAAGGTA | 29865 AGACTTCAGGCAGGGAGCTTA | 40849 |
| 7224 CCCTCAATAAACTGGGAGACCCATTG | 18882 GCTAATGACTGGACAGAGATTCCTTAG | 29866 TGCACACACAGCCCCTCAAT | 40850 |
| 7225 CAAGGCTGAGGAGCTCTGATTTTA | 18883 GCTTAGCGTGGTTTAGGCGAATG | 29867 AGGGTCCTCCACCCTCTGA | 40851 |
| 7226 GTAGGTGCAAACAAACTGGGTTTT | 18884 TCCATGGGGAGTGAAGTGATCTT | 29868 GGCAGAGAGTGAAAGGGAAGTAG | 40852 |
| 7227 TCACTCCCAAGCTCCGTTCT | 18885 GATGAAGTGGGGATGGTTGCAATAAA | 29869 CAACTTCACCAGGGGTTTATCACT | 40853 |
| 7228 GCCTGGGTCCAAAGGTAGAAGA | 18886 CCCAGTCTCTCTGTCTGTTTTCAAG | 29870 AGTCCAAGCCTGGGTCCAAA | 40854 |
| 7229 CTGAGGTGAATTTGTAAAGGGTCATTG | 18887 GGTCTGAAGGCCGTATCAGTTCT | 29871 CAGACCTTCATGCTGAGGTGAATTTG | 40855 |
| 7230 GGGGCTATAAAAGTGATTACAGCTCCTA | 18888 CCAGCAAGTTTGCACAAGACATTTCA | 29872 CCCCATCCAAGGGGCTATAAAAGTGA | 40856 |
| 7231 CCCAGCAGATGGGATGGAAACT | 18889 CCCTCTCTAGCTCCTTCACACA | 29873 AGTAGGGTGGTTCCCAGCAGAT | 40857 |
| 7232 CAATAGCATGGTGGAGTGCACATA | 18890 GAGTGAACCTTGCCTTACCTTTCT | 29874 GTGCTCATGCCAGCAGCAATAG | 40858 |
| 7233 GCATATCCTGCCAACTGTGTCA | 18891 GAGGGCGAAGGGGAAGTTTTGT | 29875 AGAGGAACAGAGCAGTTTTGCAT | 40859 |
| 7234 TGCCAACAAGGTGAAATAGCAGAT | 18892 CAGAGTGCCATGCATTGTGGTA | 29876 GCCCATGCCAACAAGGTGAA | 40860 |
| 7235 GCAGAAGGGAGAGTTTTGAGAGACT | 18893 GTCCACCTCCCATGGGTCATAA | 29877 GGGGATGAGCAGAAGGGAGAGTTT | 40861 |
| 7236 GGCTAAGCTGTTGCCAGGTTCT | 18894 CCTGAAAGGGTTAATCAGCTTCCAT | 29878 TTTCTTTCAGTGGCTAAGCTGTTG | 40862 |
| 7237 ACCTGCATTTCCGTGGTGAA | 18895 GGACTAGCAGATGGAACAAACACA | 29879 GGTTGTGGCTCTAACCTGCATT | 40863 |
| 7238 CAAGAAAGAGGAGCCGGAATGATTT | 18896 GGTGATTATGGGCAGCCATACATTG | 29880 CCTGGATATCGAGCAACAAGAAAGA | 40864 |
| 7239 GCATGGAATCTCAATATGGCTTGGAA | 18897 AGAATGTCACAGAAGAGGGAGAAAC | 29881 GAAGATGGCAGCATGGAATCTCA | 40865 |
| 7240 GCGGGGCTGTACCACCTAGA | 18898 CTGTTTCCCTCAACCAAGACAGAACA | 29882 ACAAGTATGGCGGGCTGTA | 40866 |
| 7241 AGCCCCAGAGATGTTAGGATGT | 18899 TCCAGGTCCCTGTTGGAGATGT | 29883 TCCGCCAATGGTGAGAGAAAG | 40867 |
| 7242 GGTAAACAGGAGGCAGAAACTGT | 18900 CCACTGCCCCATTTTTCACATC | 29884 CCAAATCCTGGGATCCTGTGAGGTA | 40868 |
| 7243 GCAGGCCAGAGTAAGAGCTTCA | 18901 GCTTGTCAACAAAGCCGGAACA | 29885 TCACGGGCAGGCCAGAGTA | 40869 |
| 7244 CCCTCTGTGGAATGAGGGTAGA | 18902 TGTAACAAGGGCCATGAAGACAAG | 29886 AGCAGCACCCTCTGTGGAA | 40870 |
| 7245 GACAGTGACCTGCTCCATTTTATTAAG | 18903 CCCTCCACCACTGGCATGTAAA | 29887 ACTAAGACAGTGACCTGCTCCAT | 40871 |
| 7246 CCCACCAATGAGTCACAAGCATCA | 18904 GCCACTGGCTCTATCCCCTAGA | 29888 CCAAACCATATCAATGACCCACCAA | 40872 |
| 7247 CCCTAACATGCCAGTTTCTACCATCT | 18905 CAAATGTCAGACCCTGGAGAACA | 29889 AGCTTCCCTAACATGCCAGTTT | 40873 |
| 7248 ACCCAGATGTTCCCAGACAGA | 18906 GTCACTAACTACAGGTGAGCAGCAA | 29890 TGATGTCAAGTAACTACCCAGATGTTC | 40874 |
| 7249 CTGCCCAGGTTTTGCAGGAAGA | 18907 GCATGCCTGCAGGAGAGATT | 29891 CCTGAGCCTGCCCAGGTTTT | 40875 |
| 7250 GCTGGATTTTGGGAGAGACAGGTT | 18908 CAAGCTCTGCTATTAGAGGAATCTGAA | 29892 GGAGGAAGGTGGCTGGATTTTG | 40876 |
| 7251 TGTCCCAGAGAACCCGATCTGA | 18909 CTCTGGGCAGGGAATCTCTGAAAG | 29893 TTGCCCCAGGTGCTCTGT | 40877 |
| 7252 GCTCCATCCCTTTCTAGGGCAACA | 18910 GCACGGTAAGAAAATGAGGCTTAG | 29894 TGTCCCAGCTCCATCCCTTTCT | 40878 |
| 7253 GGACTGGACACAGGAGCATCTT | 18911 CCTTGGATTTCAAAGCCTTCTGATCTT | 29895 AAGCTGCTGGGACTGGACACA | 40879 |
| 7254 GGGTTCTTTCCCTTGGCTGATT | 18912 AGGACACAGGCTAAAATCACAACA | 29896 CCTGCCCCAGGGGTTCTTTC | 40880 |
| 7255 CCTCTGAGGCAATACCGTGGAATC | 18913 GCTTGAGCGCTGAGTGCTTCATT | 29897 GCCATAAATGGGTCCTCTGAGGCAATA | 40881 |
| 7256 GCTGCTACATGTCTCAGATGAGTTTA | 18914 CCCATGTCTGTCGGAAACCAATGACATAA | 29898 GTATGGCTAGCTGCTACATGTCT | 40882 |
| 7257 GGACTACAGCCACCAAGTGATGATG | 18915 GGACCACACAAATCCTGTGACT | 29899 TTGCTTGGGGCAGGAGGACTA | 40883 |
| 7258 CAGGCTGGTAGCTGTCTTTGGTA | 18916 AACTAGAGCTTCCCAGGAGAAAAG | 29900 TGGGTGGGCACAGGCTGGTA | 40884 |
| 7259 GCACTGTCTTACTGCAAGGAAAAT | 18917 AGCCTAGTCTCCCAACTGCAA | 29901 GGCTGACATAGGGCACTGTCTTAC | 40885 |
| 7260 GTGCTTCAGCTGTTCCGTCTCA | 18918 TGCCTGGAGGGGAGGAGTATC | 29902 ACTGTGTGTGCTTCAGCTGTT | 40886 |
| 7261 GGGTACGGTAAATGATGATGTGCTT | 18919 GGCCACCAAGTCCACTGAGAAA | 29903 CGCAAATCAGTTAATGGGTACGGTAA | 40887 |
| 7262 AGAGCATCCCTAATCATGGTACAGA | 18920 CAGGTGTTCAGCAAATTCCTCTTTG | 29904 TGCTGGCAGAGCATCCCTAA | 40888 |
| 7263 GTGCAAGCCAGACATGATGAAACA | 18921 CCTGGCGTCGATATCACGGTTT | 29905 CCTCAGTGCAAGCCAGACAT | 40889 |
| 7264 CGACCGTCCACATGTTCCTTTC | 18922 AGAGGCTCTGTAGAGTTCAGACTT | 29906 TCTGGGCGACCGTCCACAT | 40890 |
| 7265 ACCTCCAGCCTTTAGCACTTAC | 18923 AGGGTGAGGTACCATCTTTCCAT | 29907 CTGCTTTCTCATACCTCCAGCCTTT | 40891 |
| 7266 GTGGAAACTTCAGTGGGAGAGTAT | 18924 CCTCATGGCCAGTTTTTCTCCTT | 29908 GGGATTGACAGGTGGAAACTTCA | 40892 |
| 7267 TGGAACCCTGAGCCACCTGTAT | 18925 GCAAGGCGCCTCCGTAAGA | 29909 CTGCAAGAAGGGCTGTGGAA | 40893 |
| 7268 GCTGCTGAAGAGCTCACAACCTT | 18926 GAGATACTCCAAAGCTCTTTCCTTCTAC | 29910 AAGACCCAGGCTGCTGGAAGA | 40894 |
| 7269 GTCCCATCACACCACAAAGGTT | 18927 AGAGCAGCGTGGAGAAGTGA | 29911 GCTGTGGGAAATAGTCCCATCACA | 40895 |
| 7270 GGGGCATCATCCAGTTTTTCTGTA | 18928 AGAGAAACCTGTTGTGCTCTTACTT | 29912 GGCTAAAGTTCAAGGGGCATCATC | 40896 |
| 7271 GTTTGGACTGTCTTCCCCTGTTG | 18929 GGAATGCTCCCACTGAATGATGAAC | 29913 GGACCAGTCCTTTTTGTTTGGACTGT | 40897 |
| 7272 GGGAAAGAGGTGCTTCTTCTGA | 18930 GCCATCCAAGCAGTCTTGACA | 29914 GCTGTGGTTGAGGAAGCACTA | 40898 |
| 7273 GACCCACCCAAAAACTAGCACTGT | 18931 GTGGTGTGTTCCGCTACCTAGT | 29915 TGCCATTGAATTGACCCACCAA | 40899 |
| 7274 GCTGAGATTTTGCCCAGTACGTT | 18932 GACTACAGGATTCGGAGAGGGAAAC | 29916 ACCCCGCCTTATGCTGAGAT | 40900 |
| 7275 CCTGTGCACACTTCTCCCTGAAACA | 18933 AGAATCAAGGTGGCTTCAGACTTC | 29917 CCCTGTACTTACCTGTGACACTTC | 40901 |
| 7276 GTCATTGCTGAGAGACTCTGTGT | 18934 CCAGTGCCTGGCTAAGTGTCAA | 29918 CATCTCCCCTAGTCATTGCTGAGA | 40902 |
| 7277 CTGGAAGGTGTGCAAAATAGTCTCT | 18935 TCCTTCCCTCCACGGGATTCT | 29919 TGGGGCAGCAATGTCTGGAA | 40903 |

FIG. 36L2

| | | | |
|---|---|---|---|
| 7278 GGTCCTCACTTCACATGGGTGTT | 18936 CCCCACAGGTCCCTAAGATGAT | 29920 ACCTGGGAGGTCCTCACTTCA | 40904 |
| 7279 GGGATGGTGAGTGGTGGAAGTTAC | 18937 GGGCCTGTCTGCAATCTCTTTG | 29921 TGGCTGTGGGATGGTGAGT | 40905 |
| 7280 ATCGCCCAGAAGGTGATAAATAAGT | 18938 CCCTGTCACCAGCAGGTTCAAA | 29922 AATCCCACCATCGCCCAGAA | 40906 |
| 7281 CCTTGGAAAACACTTTGTGGCAATAC | 18939 CTCTGAGGACAGACACGGTAAG | 29923 AGCAGGTAACCTTGGAAAACACT | 40907 |
| 7282 GCTGTCCTTTATAACAGCGTGGAAA | 18940 CCTGACAGCCTACGTGCAAAAG | 29924 GGGACCTAGACAAGTGCTGTCCTT | 40908 |
| 7283 GCCTGTTTCAGGGAGTTGCATTC | 18941 GCTGAGAAACCTCGACCTTCTATG | 29925 GCGTTTCCCACTTGCCTGTT | 40909 |
| 7284 GCTCCGCAGTGATGTGGAAGAT | 18942 GGTCTATGCATGCTAGGCAACT | 29926 GGATAGACGCCTCCGCAGTGAT | 40910 |
| 7285 CCAGACCCTGTTGCAGCAATATGTTTA | 18943 GATGCCAATTGAACACGGAAGTCT | 29927 GTCATATACCTTTATACCAGACCCTGTTG | 40911 |
| 7286 GCCTGGAAGAAGCCTGAATTGTTTC | 18944 CTGAGAGCAGTTACCTTCCTCTTT | 29928 AAAGATTTGCTTGCCTGGAAGAAG | 40912 |
| 7287 TGTGGGCAGAATGTGAGAAGATG | 18945 GACCTCGCCACTTTCTTGGAT | 29929 CCAGGGAATCTGTGGGCAGAATG | 40913 |
| 7288 GGCAGATACACACTGCAGACA | 18946 CAGTGTCCATCTGTGAACTTCTATCT | 29930 ACTGCGGGCAGATACACACA | 40914 |
| 7289 CACAGGTGCAAACCATTAATCACAGA | 18947 TTGCTTGGTGCGCCCATCT | 29931 AGGTCACAGGTGCAAACCATT | 40915 |
| 7290 CTGAACTCCTCACAGTCTCAGATACA | 18948 GTTAGAGCTGGAACAGACTTTAGAGA | 29932 CCTGAGCTGTTTCTGAACTCCTCACA | 40916 |
| 7291 CCTTGCATGCATACTCACCTCTA | 18949 CAGCATCGACTGTGATGGTTTAC | 29933 GTTCAGGGGTTTCTACCTTGCAT | 40917 |
| 7292 GTGATCCTCCCAAGTGGCTATTACTAC | 18950 GTCATTTCCTTAGGTGGGTGCAA | 29934 GGCTCAAGTGATCCTCCCAAGT | 40918 |
| 7293 GAGAAACCTTTTGCTAGGCATAAGTAG | 18951 CACGTGACCCAGTGGAAAAAC | 29935 TCACATGCCACCTCCTCTGA | 40919 |
| 7294 GCTTCCTCCGACTATCGGAATC | 18952 AAGCACGGGGCTGAGAAGAT | 29936 CCTCGCTATATCAGGGAGTAGCTT | 40920 |
| 7295 CACCAGGGTTCCATAAACACTGAGAT | 18953 TGTGACAAGAAACATGGGTACAGT | 29937 TGTGACCACCAGGGTTCCAT | 40921 |
| 7296 CCACCTGAGGAATGAGTAGCTGGAA | 18954 GGGAAGAGCTAGGATTTTCCCCATCT | 29938 GGTTGACTGCCACCTGAGGAAT | 40922 |
| 7297 GCTCTGCTATCCTTGGGTTCTTTT | 18955 GGGGAGCCACCTTGTGAAC | 29939 TCCATCTCTGGGCTCTGCTATC | 40923 |
| 7298 GTGAGTTTCCTGTGACCTAACCATGT | 18956 ACGTAGGAGCTCCACAACCTA | 29940 TGTGGAATGTGAGTTTCCTGTGA | 40924 |
| 7299 GCCACATGCACACTGAGCTTTC | 18957 TCTCCCAGTTCAGACCAAGTTGA | 29941 CCTCCTGCCACATGCACACT | 40925 |
| 7300 CTTGCCTTGGTTAGGCTTGCTT | 18958 CAGTCGGAGTAAGTTTCCTCAACGAT | 29942 GCTGTGTTTCCTTGCCTTGGTT | 40926 |
| 7301 GTCCCAAGAGGGTATGTGGCTAGA | 18959 CAAACCAGTCCTTCCAAGCCTTA | 29943 GGGAGGAATTTCCCTGTCCCAAGA | 40927 |
| 7302 CCCGGTCTTATTGACTGGACTTC | 18960 GTGGCTCAACACGGTAGATGTTTG | 29944 AGAGCCCATATCCCGGTCTT | 40928 |
| 7303 TCAACCTAGTTGGGTAGTGTTTTCA | 18961 CCCCATTCACATCTCTGCTCTTTTC | 29945 CAGAGCCAAACTGTATCAACCTAGT | 40929 |
| 7304 GGGTGGTCTCTTCAAACTGCAA | 18962 CCGTGTGTTGTGAGCATGAAGGTT | 29946 TGTAGCCAGGGTGGTCTCTT | 40930 |
| 7305 CGAGGGCCAAATGGGCAGAAT | 18963 CAGGTTACTCACCCACAGCAT | 29947 CCAAAATGCCGAGGGCCAAT | 40931 |
| 7306 TTGCCTCAGAGGAGCACACA | 18964 GTGACCACCCACATCATCACA | 29948 GGAAGGTCAATGTTGCCTCAGA | 40932 |
| 7307 GCTCCATCCAAAAGGCATGGAAGA | 18965 CAGTAGAAGGTACAGTCCCCAAAAG | 29949 GGGTTACCCTTGCTCCATCCAA | 40933 |
| 7308 GCTGCTGCATAAGCTGCAAGGTA | 18966 GGAGTGACTGCTTCTGCTTGAGA | 29950 CATGGCTGAGCTGCTGCATA | 40934 |
| 7309 AGCCTCCCTTCATCTCCTCTGT | 18967 GGAGAGAAGTAGGAGTGGGACAT | 29951 GGCTCTCAGCCTCCCTTCA | 40935 |
| 7310 GCCACACCATCTTAACTGGCATCA | 18968 GCTGTCAAAAGTGGATTTCACCAT | 29952 CACTGGATGATAGCCACACCATCT | 40936 |
| 7311 GCTCAAAGAGCTTCCAGAGAGT | 18969 TCCCTGGACACCACGATCTCA | 29953 CCCAAGCTACAGGGCTCAAAGA | 40937 |
| 7312 GCGGTCCACAAAATGAATGGCTTT | 18970 CCAAGCCCTCGTTCTGAAAGT | 29954 GTCCTGCGGTCCACAAAATG | 40938 |
| 7313 CACAGAGGCCTCCAATGCTGTA | 18971 GGGTTGGTTAGTCTTGGGGAACA | 29955 TTCTCACCTCCCACCACAGA | 40939 |
| 7314 GGTAGGAACTTTGGAGTCACCCTTTTC | 18972 CACAGAAGGAGGGTGTAATGTGA | 29956 GCAGTGAGTAGAGCAAGGTAGGAACT | 40940 |
| 7315 GAACAAGTGTGGAAGAGTGTGGTA | 18973 CTTTGCCTTTGCTAATGTCCATGT | 29957 GCAAGTGTGAACAAGTGTGGAA | 40941 |
| 7316 GAGGACAACACAGTGAACCAGAGA | 18974 TGGACAGTGCAGCTCTACACATA | 29958 GCAAGGTGAGGACAACACAGT | 40942 |
| 7317 CCTCTGAGTACCCTGTGGGAGTGAA | 18975 CACACATCCCGCGAGGGGAATC | 29959 GAAAGGTGTCTCTTTACCTCTGAGT | 40943 |
| 7318 CCAGACCCTGTGGTAGGTACAGTTG | 18976 GCATTGAACAGGCTCTTCCCTAGA | 29960 GTGGCATTCCAGACCTTGTGGTA | 40944 |
| 7319 GTCGGCTATGGCAGTATGCTAAC | 18977 GTTGCTGTGAACACCTGCATGAAA | 29961 GGTGTGCACTTGTCGGCTATG | 40945 |
| 7320 GATGCTAAGGTTGTTCGGCTAGAATTT | 18978 GGCTGAAAATATTTCCTCCATGGTGTT | 29962 CTGTGAATGTGATGCTAAGGTTGTTC | 40946 |
| 7321 GGATTCCGTCTATCATCCAGTAATA | 18979 GCATCTCCACACCTCCACTGA | 29963 CAGGCCCTTCTGGATTCCGTCTA | 40947 |
| 7322 AGGCTGGGGTAACCCTTGGAAT | 18980 GGCCATCATAGACCATTCATGCTA | 29964 TGCACGTAGGCTGGGGTAAC | 40948 |
| 7323 AGACCCCATATTTCTCCCTATTGAAC | 18981 GCAGATGGACGTGATGGGTAGA | 29965 CCCGAGCCTTAGAAAGACCCCATA | 40949 |
| 7324 GGTCAGGACCAAGAGTGGACAT | 18982 CCCCACAGCATTCCCAGTCTAC | 29966 ACAGAGCTTAAGGTCAGGACCAA | 40950 |
| 7325 TGCAAGTGTCCATACAGTCTTGAT | 18983 GGACAGCCCTCTGTTGTTTCTAA | 29967 CCTTAGTACTTAAGATGCAAGTGTCCATAC | 40951 |
| 7326 AGTGTTAACTCACAAGGGCTCATAC | 18984 GCAGAAGTGGGAGAAGTCTGTGTT | 29968 TTCCTGCCAGTGTTAACTCACAA | 40952 |
| 7327 GTCTCATGCAGAGTTGGTGACT | 18985 CTGTCAACAGGGCTTTCAAGCTA | 29969 CTCTGTCAGGACTCCAGTCTCAT | 40953 |
| 7328 GGGGCAAGTGGAATGGAAGTCA | 18986 CCCCAACACCCATGTATTTGTAGTGA | 29970 TGGGAGGGGCAAGTGGAA | 40954 |
| 7329 GGTGCAGATTAGCAGAACATTCTAAAG | 18987 CGCCAGTCCACATCAGAACACATT | 29971 CCGCTTGAGGAAAGGTGCAGATTAG | 40955 |
| 7330 GAAACTGAAGCCCGCTACTCA | 18988 CCCTAGCTAAAGGACACTCCTTATCA | 29972 CCATGGGTTGGCAGGAAACTGA | 40956 |
| 7331 GAGCCTCATGTCTTTGAAGCCTTTC | 18989 CAAGGAAGGCTCAAGTCTTCCTCAGT | 29973 GAAGGGTGAAGCCTCATGTCTTTG | 40957 |
| 7332 GACAGGTTTTGTTCTGGACAATAGGAA | 18990 GGCTGGGCAGAGCCAGATAATA | 29974 GAGAACAGGTTGATGCAGGTTTTG | 40958 |
| 7333 CCACTCCCAACACACTTTTCTTCAT | 18991 AGGTTCTGGCAAGTGGAAATAAAAG | 29975 TGCCCCACTCCCAACACACT | 40959 |
| 7334 GACCTAAGCTCTTCCTGACTTTGACT | 18992 GCCAGGGTCGGTAACTGATGTATG | 29976 CGCCCAGTCAGACCTAAGCTCTTC | 40960 |
| 7335 CGCATCCATAAAGAGGGATCCAGAGT | 18993 GGCCCCATGCTGAACAGAAAA | 29977 GGCTCCCCGCATCCATAAAGA | 40961 |
| 7336 TGTTGGTTGGTAGAGCTTATTGCTA | 18994 AGGACCAGCTTTAGTGTCTGATG | 29978 CCCTGGAAACATAGATTGTTGGTTGGTA | 40962 |
| 7337 TCAGGGCCTCAAAATTCCCTAGA | 18995 GCTGGTCAAAAGCATCTTGCAAAACA | 29979 GTCCAGGATTCAGGGCCTCAAAA | 40963 |
| 7338 CTCTTAGCTATATCCCCTCCCCTCTT | 18996 GAGGAAATTAGTCTGGCTGAGGTT | 29980 CCAGGTTGCCACACATTCTCT | 40964 |
| 7339 GACAGACAAAACTCCTGCGAGATAC | 18997 GCTGTAAGAGCCTGGATACGAGTT | 29981 GGGCTTTCCCTCAGACAGACAA | 40965 |
| 7340 GAGGCTCCTCATGTGCTTGAA | 18998 CATGTTCCTACATGTCTCAGACGAA | 29982 GCAAAGTCAGCACAGGGAAGA | 40966 |
| 7341 GCAATAAGCCAGGTAGGATTGTTCA | 18999 CCCAGACCAAAGTCTTAACATTCCCTTTA | 29983 GCACATGTTGCAATAAGCCAGGTA | 40967 |
| 7342 CCATTTCTGGTAGGTCCTGAGCAA | 19000 CTGCAAAGGGGACCTTCCAAGT | 29984 GCACCCTGTCTTTTCTCACCATT | 40968 |

FIG. 36L3

| | | | |
|---|---|---|---|
| 7343 GGGCAGCAACTTACACTCTTAATC | 19001 GCCCAGGTGGATAGTCAAGACA | 29985 GGGATGGGCAGCAACTTACA | 40969 |
| 7344 GGTGTGACAAGCACACCTTCA | 19002 GACTGAAAAAGTTTGGAAAGCATGGCTCTA | 29986 CCTGCAGAACTGGTGTGACAAG | 40970 |
| 7345 GGAGGAAACCTTTGGTAGGGAAA | 19003 GGGCATCTGTGTATATAGTTCCCAAGTCTA | 29987 GAAAAGTCCAGGAGGAAACCTTTG | 40971 |
| 7346 GTCACCTTTTGTCCACTTGATTGATG | 19004 TCTCACGGGAATCACCATCATTTT | 29988 GCTGGTGAAGGACGTCACCTTT | 40972 |
| 7347 CCACCTCTGTAAACATGCAAGGAA | 19005 GGGCTGAAGCAAAGACCATGT | 29989 GTAAAATCCTGCCACCTCTGTAAAC | 40973 |
| 7348 CTCAGTCACATGTAGTTGCTGTTG | 19006 CCTGGCTTAGCAAGAATTTGTTTGT | 29990 GGTGTAGAGTAGGTGCTCAGTCACA | 40974 |
| 7349 TGTCTCTGCCTGACCCACAATC | 19007 TGGGTGGGAGTGCCTGTAAAC | 29991 TGGCCTCAGAGCTCTTGTCTCT | 40975 |
| 7350 GGCACTTGGCAACATTCCACTT | 19008 ACTAATGATGTGACCCACCCAATC | 29992 TCCTCCCTTTTGGGCACTTG | 40976 |
| 7351 TCAAGACATCTGTGCCCGATAC | 19009 GACCCCGTTGCCTACTAACAGA | 29993 GGGCTCACCTAACCTGGTATCAAGA | 40977 |
| 7352 GTGAGGAAGACTACTGCCAGAAA | 19010 CTGTCCACCACTACCTCGTATCTCA | 29994 CCACTTGGTGCAGTGAGGAAGA | 40978 |
| 7353 CTGGGAGTCTTCAGACCTGTCTTTG | 19011 CAGTTACGGCTCACTGGATGGAT | 29995 TTCGCAGGGTCTGGGAGTCTT | 40979 |
| 7354 CACTGTGCCTTTGCTGTGAAAC | 19012 AAAAATGAGGGCTCTGGGAAGTCA | 29996 CCGAGTCCAACTACACTGTGCCTTT | 40980 |
| 7355 GGCTAGTAGGTTTTGCTGGTTCAGA | 19013 CCACCCTTTCTGAACTTAGGCATGT | 29997 GGTTGTGAATCAGAAGGCTAGTAGGTT | 40981 |
| 7356 GGAGTAGGACTCCAGCTCAGGTA | 19014 CATAGGAATTGCCGGAGACATGA | 29998 CCAGGCAAGTGGGAGGAGTAG | 40982 |
| 7357 GTGGAGGCTAAAACCTGGCTGTT | 19015 GCATTTGTGGCTCTAGGGTAAAAC | 29999 GTGTTAGAACTCAGTGGAGGCTAAA | 40983 |
| 7358 CTCAGGTCCACAGTGGCATTCT | 19016 TCCCTGGCAATTCCCCTTCA | 30000 ACCCCTTGCTGTCAGTGAAC | 40984 |
| 7359 CGGTTCTTCCCAGAGCCCATAG | 19017 GGCCACAGGTTTCTCTGCTTCA | 30001 GGATGAGCTTGGATGCGGTTCT | 40985 |
| 7360 TGTCTCGCTTCTCTCTGGATGT | 19018 GAGTGGGAGCATGGATGGTGAT | 30002 CAGTGGTTAGATTGTCTCGCTTCT | 40986 |
| 7361 GTGAGAACAGGTGTCTAGGAGAGCTA | 19019 AGAATCCTGCTACATTTCGCTAGTTA | 30003 TGAGGAAAGTGAGAACAGGTGTCTA | 40987 |
| 7362 GCTCACTTTGCCCACGGTTTG | 19020 GCAGGGACTTAATGAGGGCAATTT | 30004 CGCGAGACAGATCTATGCTCACTTTG | 40988 |
| 7363 GCTGGGATTGAACCTAGCTCTGAGT | 19021 ACTCCTAGTCACTTGCACAGTCT | 30005 AGGAATAATCGGGCTGGGATTG | 40989 |
| 7364 GGCAGCCTTCTTCTCCTTGACTT | 19022 GACTAGTGTGTCTGCTTTGCGTTT | 30006 CCATCTGGCAGCCTTTCTTCT | 40990 |
| 7365 CCTTCACTTCCAAGGGTATGCTAAG | 19023 GTTTTAGCCAGAGGCTCTATATCCAT | 30007 GTTTCTCCAGCCTTCACTTCCAA | 40991 |
| 7366 GATGGGGTTTTATGGTTGGGCTTT | 19024 CTGCTACCTACAGCCAGACTTCA | 30008 CTGGCCAGGATGGGGTTTTT | 40992 |
| 7367 ACATACAGCCTTGCACATTTCTGA | 19025 GCTGTTATTTTAGCTCTTGCTGGTT | 30009 GGGCGGCCAGAGAAAACATAC | 40993 |
| 7368 GGGGAGAACAGATGCCAACA | 19026 GGTGAAGCTTGTGTTAAGGGTTCAA | 30010 GAGAAGAAGGAATGAGGGGAGAACA | 40994 |
| 7369 CCTGGTCAAGGATCTTATCCCAGAAGT | 19027 AGGGGCCTCCTGAGGAAATACT | 30011 TTCACCCCTGGTCAAGGATCT | 40995 |
| 7370 GGGCCTGAAGATACAGGCTTCCTT | 19028 GGAACACCCGAGCCATTCTGA | 30012 TGCCAAAGAGGGCCTGAAGA | 40996 |
| 7371 CGAGCTGATCTGAGTACAATCACAGA | 19029 GCTACCTGGGCTGTGGTATCTTC | 30013 GCCTAGACGAGCTGATCTGAGTA | 40997 |
| 7372 GGCCAGATTGGACAAGGACTGT | 19030 TCTCCATGACTTCCCTCTGTTATTTC | 30014 TTCCAGCATGGGCCAGATTG | 40998 |
| 7373 GCTTGCCTCTATCCTCCTCTTC | 19031 CCTCTGCTTTGACTTGCTTCAAAT | 30015 CCCTGTCACAGGTTGCCTCTATC | 40999 |
| 7374 GCCATGAAAGCCAGCATCTGT | 19032 GCTTCTCTACCACATAGTGTAATGGTT | 30016 ACCAGGATTTGAAGATATGCCATGA | 41000 |
| 7375 AGTGTGCTTCCCACATCAAAGAT | 19033 AGGAACCTGGCCCCTTCTCT | 30017 GCCAGAATCCTGGTAGTGTGCTT | 41001 |
| 7376 GGACAGACACTGATTAAGGGCAACT | 19034 TGAAGCCCCAGTCCTACTTGA | 30018 AGGTATTTTGGGACAGACACTGATT | 41002 |
| 7377 CGCAAACATTCACAGCTTAACACA | 19035 AAGCTGAGAAAAACAGCCATCTTC | 30019 GAGGGTCACCAGAATCGCAAAC | 41003 |
| 7378 CAGGTATCACTAGATTGTTCTCCCAAT | 19036 GGCGTGAGACTATGGGAAGGTAAGTC | 30020 GAACCACTTCAGGTATCACTAGATTGT | 41004 |
| 7379 ACTTGGCCAGCTCTCTCACTTC | 19037 CAGGGTGGACCTCTCTGAGATATT | 30021 TTTCCTGGAGCATATCCACTTG | 41005 |
| 7380 GCTGTCCCAAATGATTCCTGCTT | 19038 GCTGCTGCTAATTCACCCTGTA | 30022 GGCAAAACATATGCTGTCCCAAATG | 41006 |
| 7381 GGATCAGCGGAGTTTTGGTCAT | 19039 CTCATGAAAATTGTGCCGATTGCTAAG | 30023 GCAGGTGGAGGAGTACTAGGATCA | 41007 |
| 7382 GGTTTCTTGGTTTCAAGGGAAGGAATG | 19040 CAGTGGTCAGGGACAGCTCTA | 30024 GCCTGCTGCTAAGGTTTCTTGGTT | 41008 |
| 7383 CGGCTTGTGAAAAACACAAGGAA | 19041 GGCCTGGCCACTTTAGTACTCT | 30025 GATGCTGTCTACGGCTTGTGA | 41009 |
| 7384 GGATGTGCTGCATCCCAAACA | 19042 CCTGAGATGAGGATGGGAGCAT | 30026 AGGGAGCAGGCCATGGATGT | 41010 |
| 7385 GGCATGTACAAAACAAGCCCTTGAA | 19043 GCAGACTGACCCTGTGACTTTC | 30027 AGGCTGGACAAGGGGCATGTA | 41011 |
| 7386 CCCAAGAGTTCAGGTAAGAGTTTGT | 19044 TGAAGAAAGCCATCGGCATGTGAA | 30028 GGCAGTATCAGAAACCAAGAGT | 41012 |
| 7387 GCCAGTTCTGAAAACTTCCACTAACA | 19045 GGGGAGAGTGAGTCTAGGTTCTGT | 30029 GGGAAGTTTTTCAAAAGGCCAGTTC | 41013 |
| 7388 GCGTGGTAAGTACGATGGGAAGT | 19046 GCGATAGACACTTTTATCCAGCTTTACACA | 30030 TGCCAAGGGCTGGTAAGTA | 41014 |
| 7389 CAGCTTCATTCAGTACATTCCCTTTG | 19047 GGGGTTGAGCTGGTTTGATATGT | 30031 GCCCATGACAGCTTCATTCAGT | 41015 |
| 7390 CAAACTGCAGGGGAAATTATGATCGA | 19048 GCTGTGTCTAGGCTTTTTCGTGATA | 30032 GTAGCTCAAACTGCAGGGGAAA | 41016 |
| 7391 TGACTCCTGCCTGGGTCAAA | 19049 AGACGGACTCCCGGCGTTT | 30033 AACCAAGCCCGCCTGACT | 41017 |
| 7392 AACAGTGGAGAGTGTGCTAAAGTT | 19050 CAGTTCACCTGTCTGCTGAGGAA | 30034 GCCCAGCAAAGGTTGATAACAGT | 41018 |
| 7393 TCCCTGGAGTTGTCCTCCAA | 19051 CCAGAAGTCTCAGAAAAGGAACCATAC | 30035 AGGCTACATGCTCCCTGGAGTT | 41019 |
| 7394 AGCCAGACTTGGGCAGAAGA | 19052 CACACAGTGGGCAGCTATTCTCCAT | 30036 CCCGGACTCAGCCAGACTTG | 41020 |
| 7395 GGCGGAATCAGCATCTAGGATAG | 19053 TCCATAAGGTGGTCCCTTGATTAAC | 30037 GGGTGGCGGAATCAGCAT | 41021 |
| 7396 GCAGGAAGTTAAAACAAACTGAGCACTACA | 19054 CAGCCAACTGTCTAGGTTCAAACAATG | 30038 CTGTCAATGTCTACAGCAGGAAGT | 41022 |
| 7397 CACACCCAAATTATCCATTCGCTGAT | 19055 CCTCCTGAAGCTCAGAATACACCAA | 30039 ACCCCAGCCATCACACCCAAA | 41023 |
| 7398 GTCCTCACACCTACTGTTCCTTAAGTTG | 19056 TTCGGAAGCTGTGCATGATGA | 30040 GTCTGTCCTCACACCTACTGTTC | 41024 |
| 7399 AAGATGTTTCCCTGGCCTTCTT | 19057 CCCCTCAGTAATTTTACCTGGGATTAG | 30041 CAGTCTGCTGGCTTCAAGATGTTT | 41025 |
| 7400 GAGAGGTTCCTTCTCGGTCTTAC | 19058 CGGGGCGCAGGCTAGAAAA | 30042 GCTGGGTGGTAAAGAGAGGTTCCTT | 41026 |
| 7401 GCAATGGAATCCCAAGGAAACATAGT | 19059 TCCACGGAATCAGAGGATAGTAAGG | 30043 CACCGAGTTGAAAAGCAATGGAATC | 41027 |
| 7402 TGATCGTGGAAATGGATCTCAAGT | 19060 CTGCAATGTGTTGGCTGGGAAT | 30044 CAACCACGTAAGTGATCGTGGAA | 41028 |
| 7403 GAGTCAGCCAATAAAGAGAGACTTGT | 19061 CAGAGCCTTGATTGGACAACCCTTA | 30045 CAAAGGACTTGAGCAGCCACCTAGAGTCA | 41029 |
| 7404 GCCACGTTCTTCCCATTGTCA | 19062 CAGAACCCACTGCTCTATGAGTGT | 30046 GGAGTTCTACAGCCACGTTCTTC | 41030 |
| 7405 TGCCACCTAAATGAAGACCCTTT | 19063 AGTCCACCATCAGGAACAGTAGA | 30047 TCTGAATAGTAAACGTTGCCACCTA | 41031 |
| 7406 CACCCTTTGGTCCTCCTGTATC | 19064 CTATCGAGATATTGGGGAAGAGCTTA | 30048 GGCTGGCTTCTCATCACCCTTT | 41032 |
| 7407 CCCAGTATGTCCCAGGCAATCTGT | 19065 GCAGCTCTGGTAGATAAGGCCATACATTA | 30049 TGGAGGCTGTCCCAGTATGT | 41033 |

FIG. 36L4

| | | | |
|---|---|---|---|
| 7408 GTCCTTGCTCATGACTCAGAACT | 19066 GGAGGGAATGGGCGTTTTCAAC | 30050 GAAAAAGGCAAAAGTCCTTGCTCAT | 41034 |
| 7409 GCTGGTGACTGCACATTTTTCA | 19067 ACTTCTCAAGGACAAGTGTTCTCTTC | 30051 CCTGTAATTCCATTTGCTGGTGACT | 41035 |
| 7410 GCTGAGTATCTGCGTGTCTGT | 19068 CTCTTGACCACATCTGGAAGTAGAAAC | 30052 GTGGTGTCTCCTGAAGCTGAGTATC | 41036 |
| 7411 GCTTGGCCTTACTGTACTTCTCT | 19069 GACCAAGGAAAAGGTTGGCTAATAGT | 30053 CCTCTCACAACTTGCTTGGCCTTAC | 41037 |
| 7412 GGAGCAAGTGGGTATGTTGAGAAG | 19070 GCCTCCATTTCTTGCTGGTTGTT | 30054 GGCCTCTGAGGGAGCAAGT | 41038 |
| 7413 GGAGGACCGGTTTACATTCCTGATG | 19071 AGCTTCTCCCAGATGCCCTACT | 30055 CTGTGTTTTTGGAGGACCGGTTTAC | 41039 |
| 7414 GCATTAGCCTCTTAGTGGTTCCTT | 19072 TGTGGCAGGGACAGAGGTTCT | 30056 GGCCGAGTCTGTCATTGCAT | 41040 |
| 7415 ACAACACTTACCTCCCATGCATTT | 19073 GGCTCCTAGGGGTGGTAGATTGT | 30057 AAGCCCCTACCAAACAACACTT | 41041 |
| 7416 CACTGTGACTGGCCTGTTCGTT | 19074 CCTCATCCTTAGTGGGGAGTAACAGAT | 30058 ACAGGTGTGAGCCACTGTGA | 41042 |
| 7417 AGCCGTTTGGGAAAAGTGGAA | 19075 TCTCATCTCGAGACACCCAGAA | 30059 AGGAGGGACCAGAGCCGTTT | 41043 |
| 7418 GTCCCTAAGGTAAGGATGGAAAATCT | 19076 GCATGTATACTTGAAGCCCACACAGA | 30060 GCCAGTGTTTGTCCCTAAGGTAAG | 41044 |
| 7419 GCTTTCGAAGGGGTGTTCTTTTC | 19077 AGGCCATGGCTCTTCTCCTT | 30061 GCCTGGCCTTTGCTTTTGCTT | 41045 |
| 7420 CAGCTTGTTGGAGAAGCATCTTTAC | 19078 GTGAGATGGTATCTAGGTCACTGCTT | 30062 CCAGCCCTTTCATCAGCTTGT | 41046 |
| 7421 CTGTTTGACACCGAAACACTGCAT | 19079 CCAATTGCTATAGCCAAAAGCCATACA | 30063 GCTCGAGGCTGTACAGATGTTTCT | 41047 |
| 7422 GTGCCTCTGTTGTCCAGAGTT | 19080 GCTCTGTTCTTCAGGTGGGAAAG | 30064 AGCCTGTGGAGTGCCTCTGTT | 41048 |
| 7423 GGGCAAAAGAAGTGCAAATGCAACA | 19081 CCGTGATGCTGGATCAGCCAAT | 30065 GGTGGAAGCCAGATTGGGCAAA | 41049 |
| 7424 TGCAGCAGAGACTGTCCACTA | 19082 TCTCAGGGCCAGCCCCACTT | 30066 GCCAGAGCTGCAGCAGAGA | 41050 |
| 7425 TGGACATCACATCTGCATGGAA | 19083 GACTGACGAGAACTGCAATGTGT | 30067 GGCTTATACTTAAGCGCATCTGGACATC | 41051 |
| 7426 GCTATCCCTGGACTTCTCGGTTA | 19084 CTGGCTTAAGCAAAAGGGAATTT | 30068 AGTTCTACCTGAAGCCAATGCTATC | 41052 |
| 7427 GGCAGCCTTAATTCCCACCACAA | 19085 AGCTCCCTCCTCATGCTACA | 30069 AGGCCCTTGGCAGCCTTAATTC | 41053 |
| 7428 CGTAAGAGGTTGACAGGTGCTAT | 19086 TCTCGAAGTAGGAAGATCCCATTCT | 30070 AGGTTAAAACACCGTAAGAGGTTGA | 41054 |
| 7429 TGGCTCCTACCACACCTTGT | 19087 CCGCTATGCCTGGCTTAACTTC | 30071 CCTGAGTCTCACTCTGGCTCCTA | 41055 |
| 7430 CACACAGATGCTACTGGAGTGAAC | 19088 CGTGTCATTTAGACAGCCCTGTTTTC | 30072 GCCGGGGAAATCTTTCTTCACA | 41056 |
| 7431 AGGTCGGTCTTCCCAGCTAGA | 19089 AGGTGACCCTATCTTCAGTGCTA | 30073 GCCTATCTCTCAGGTCGGTCTT | 41057 |
| 7432 CGGGAGAGTTCCTTCCTGTTCA | 19090 CCGGTCAGCCAAAGGTCTTCTA | 30074 AAGGCCATGGGCGGGAGAGTT | 41058 |
| 7433 GAGGGAACACCATGTCCTCACA | 19091 GGGTTTGAGGGTGTGGGTTTGT | 30075 CCTCAGAAGGGAGGGAACACCAT | 41059 |
| 7434 CCACAGTGAGGTCAAATGGATCA | 19092 CCGCGTCGGATGAACAAGAAAC | 30076 AAACTGGCCTAAACCACAGTGA | 41060 |
| 7435 CATGAACGAGACTCCAAGTAATTCT | 19093 CCTCCCTCCCTATGGCTACTT | 30077 GGCCACCATGACATGAACAGACT | 41061 |
| 7436 CTGTAAGTAAGCTTGACTCCCTGTAT | 19094 GGTGCATGATTTGAGAGGAACGAA | 30078 GTGACTTCCTGCAGTTACCAATCTGT | 41062 |
| 7437 CTGGAAAGATAGAGCTGCCACGAT | 19095 CACCTTTTAGCTCAGAAGATGCAGAT | 30079 CCCACACCTTTTCTGGAAAGATAGA | 41063 |
| 7438 GTGGTTTACCAACTGCACTACCAA | 19096 CAAGGATATGGAGGACCAGGATTC | 30080 CCAAAGACCTCACCATAGTGGTTTAC | 41064 |
| 7439 TGAGGCCCTGCACTTACTGA | 19097 GGTCCATGGTGTTGAGGGAATTG | 30081 CCCCACTAAACCTCCCAGTGA | 41065 |
| 7440 CAGCTTCCTGGTTACTGTGTGA | 19098 CAGCTAAGGGAAAGTCAATTCAGGTTA | 30082 GCCATCACAGCTTCCTGGTT | 41066 |
| 7441 GTGTGCCCAAGACCCTCTTC | 19099 TGCACGGGGAAACTCACATTC | 30083 GGCTGCTGTGTCCAGTGTGT | 41067 |
| 7442 GGCAGCATGGTCTCAGGAGGATA | 19100 TGAAACGATACCGCCCTTAAAAGT | 30084 CTGCTCATAAACCAGGCAGCAT | 41068 |
| 7443 CCCCAAATGGTAGTGAACTCTGCAATA | 19101 TGTCACCAAACTTTCTGTGCATCT | 30085 GACTTTCTCCCCAAATGGTAGTGAAC | 41069 |
| 7444 TCTGCTCCAGCTGTCTAGACTTT | 19102 CCAAAAGGAGCATGGCTGTCT | 30086 TCCCCTGGCTCTTCCCTTT | 41070 |
| 7445 CTGTACAGCATCACAGCTACCTAAAC | 19103 AACGCCTACTTTCCCTGTCTTC | 30087 GCGGAAGGTACTGTACAGCATCACA | 41071 |
| 7446 GATGTGTCTCCAGTATTGTGTCTGT | 19104 GACAACACGGCTGTCCACAA | 30088 CGAACCAAAGATGTGTCTCCAGTAT | 41072 |
| 7447 GGAGGAGAGAGGCAGAACTGTA | 19105 CGAATAGTGCTGGGAATCTCTGA | 30089 CCGGGAGCTAGGAGGAGAGA | 41073 |
| 7448 GCGGTTAGCGCTAGACAACA | 19106 GCTTCTGATCCTTGGAACATTTGGTTCAT | 30090 ATGGGACCAGTTGCGGTTAG | 41074 |
| 7449 CCCAGAGGTTCTGCATGTTTTG | 19107 CCAGTAAACCTTTTCCATGAAAGCCTGAA | 30091 TCGCGGAGCCCAGAGGTTCT | 41075 |
| 7450 CCCCAGACAGGTAGTCCTGAGATT | 19108 TGATTGGCTCCCAGAAGTTGTAAT | 30092 CCCTTTGACCCCAGACAGGTAGT | 41076 |
| 7451 GCTGGAAAGATAATCGTTGAGGCCAAA | 19109 CTCTGAAAGATCGTGTCTTCCTTTGT | 30093 GCCCAATTTGGCTGGAAAGATAAT | 41077 |
| 7452 GGCCGGTTGAGAGAAATGGTAGA | 19110 TGTCAGCACTGCCTTCAAAATG | 30094 TGACAGTGGCGGTTGAGAGA | 41078 |
| 7453 AAGTATCTCAAAACAGCGGGGTTA | 19111 CCCTAAAACATGCAACCTTTCCTTATC | 30095 GCAACTGAGGGTGTGGAAGT | 41079 |
| 7454 GCCGTAAAGTCCTGCCACTTAC | 19112 AACAAAGGATACCTCCGGGTAATATG | 30096 CATGGAGGTACACTGCCGTAAAG | 41080 |
| 7455 GCCGGGGTTTTGCATAGCTTCA | 19113 GCTCAAAGAGGATTAGGCTGCTTCA | 30097 TTCCAGGAAGGCCGGGGTTTT | 41081 |
| 7456 AGTGACTATCAGTGCCCACAAAC | 19114 CACCTGCAGACTAGCACAAGA | 30098 GCCATCTCAGGGTCAGTGACTATC | 41082 |
| 7457 TGTCCTTGGTTGAGTCACTCTTTG | 19115 CTTGCTTCAGGCCAAGCAAAA | 30099 CCATCTCCTATGTCCTTGGTTGAGT | 41083 |
| 7458 TGGATCAACTCTCCCCTTGACT | 19116 GTCCATAAGGGCATATGGGTGTTTC | 30100 TCTGGTACCCTTCAGTAATGGATCA | 41084 |
| 7459 AGGACACAGGCTGACCACACA | 19117 AACCGAGGGGAGTCCCAGTT | 30101 GGGAACTGGATTTCAGGACACA | 41085 |
| 7460 GTCTTGTTGTTCACAATCCAAGGAGAT | 19118 GCCACCCTGGTTCCTCATCATT | 30102 CACTCCACCTCCAGTCTCTTGTTC | 41086 |
| 7461 GAGGATCTATCGGAATCCTCTGTCT | 19119 GCAGGGTCCTTAAGTGAGTGACTGT | 30103 CAGCCGAACAAGGATGAGGATCT | 41087 |
| 7462 TCCAGCAAAGCTACTTCTGTGAAA | 19120 CAGCTCCTCTCCTGTCCCATTT | 30104 GCGGGCTCTAACACTTCCAGCAA | 41088 |
| 7463 CTCTCCAGCCGTTACCCGATTTC | 19121 GGCGACTCGACACCTGAAAACT | 30105 GTGTCGGTTCTCTCCAGCGTTA | 41089 |
| 7464 CGTTCCCTCTCTTCTTCCCCTTT | 19122 TGGGGAACCTTAGAGAGCTTGT | 30106 CCTGTTTGAGTCTAATCGTTCCCTCTCT | 41090 |
| 7465 GGGAAAGCAAGTAGAGGTACTAACATGA | 19123 GCAGGTAGACGTGATTCAGCTT | 30107 GGGGAGAGAAAATGGGAAAGCAAGTAG | 41091 |
| 7466 AGCACCGTTTCTGGATGTGAT | 19124 CAGGATAGCTCCCTAAGGCTCAAATG | 30108 CCTTCAACAGGATAGCACCGTTTC | 41092 |
| 7467 GAGGAGACAGGCAATTAGCACAT | 19125 CTCCAGTGCCATACCCAGTTGT | 30109 GCAGATCTTTCACTGGAGGAGACA | 41093 |
| 7468 CCAGGTGGGACTGTCTTATCTCT | 19126 GCTAAACAATGGTGTAGTCTTGGGATCT | 30110 TTGCCTCCAGGTGGGACTGT | 41094 |
| 7469 TCACACCTGGAACCCTGCTT | 19127 GACGCAGACACAGACATCCATCA | 30111 AGCACCATCCATGCGCTCACA | 41095 |
| 7470 CCCTACTCACTCCCTTCTCAGT | 19128 TCGGATTCCTTGTTCTAGACCTTTC | 30112 TCCCTGGGAGACCCTACTCA | 41096 |
| 7471 CCCGCAAGGTGGAAGGTAATAGTAG | 19129 AGGCTCTGTCCCCATGACCTAA | 30113 TCTCACCCGCAAGGTGGAA | 41097 |
| 7472 GCTAGCAGTTGATGAGAGTGGATTTC | 19130 ATCCGTGACAGGCCACACAAC | 30114 CATAAGCACCCAAGTGCTGCTA | 41098 |

FIG. 36L5

| | | | |
|---|---|---|---|
| 7473 GGGGCCACAAATGGGGAAT | 19131 CCCCAGCAGAGAGGAGACCATATT | 30115 AGCTGGGATGTGGCTGTTTG | 41099 |
| 7474 GGGTGGTTTGCGCTTCTTATCACA | 19132 GAGATCAGGACAGAACAGGTCTAAAG | 30116 GAGACAAATGTAACAGGGTGGTTTG | 41100 |
| 7475 CTAGCAGCTCTTAACAGATGATGTT | 19133 GAGTACAGTCAGCCTCTTGTTTCCTT | 30117 AACCATGCCAGCCTGCTCTA | 41101 |
| 7476 GGTGGTGTGAGGGCTGGATATT | 19134 CCTTCCTCATCATGGTAGCATCTCA | 30118 GGGGATTGTTGAAGGTGGTGTGA | 41102 |
| 7477 CTGGTTGGCATTATTTGCTCCAA | 19135 GCAGAGCAGCATTGACGAACA | 30119 AGAAAGGGCTGGTTGGCATT | 41103 |
| 7478 GTGTCTGTCCTCTCCACATGTCTTG | 19136 TAGCGGCACCCTGTGCTT | 30120 GGGACCTCCCCTGTGTCTGT | 41104 |
| 7479 CACACCCTGAAGTCACTATCCTTTC | 19137 AGCCATGGTCCCAGGATACA | 30121 GGTCCAGCACACCCTGAAGT | 41105 |
| 7480 GCTCGAATTCACTACTGGGCTAAA | 19138 CGTGCAATCCGTGGTGAGGAA | 30122 CTGGCATCGCTCGAATTCACT | 41106 |
| 7481 CCATCTTCTTTGCCATGCAGCAAT | 19139 AGCTGGCCGCATTCCAGTTT | 30123 TCGCTGGCCCTTCATCCAT | 41107 |
| 7482 CTCAGAAATCACCTCCTCCCTGAAG | 19140 ACTGAGATTCTCGCCCTGAAAATG | 30124 CGAGGAAGACCTGACTCAGAAATC | 41108 |
| 7483 GCTGTTCACCGCACATTCAGT | 19141 GCAGAGAGGTTAGTTCACTAATAGAAGCAT | 30125 ACGCAGACCTGGCTGTTCA | 41109 |
| 7484 CTCTGTCTCCTGTCCCTGGAATAC | 19142 GGCCTTCAAAAGGCAGGACTGT | 30126 CAGTTTCTTGTATCTGGCTTCTCTGT | 41110 |
| 7485 GGCTCTTGCACTGCTCCTATTTG | 19143 CCTTGGACCAGAGACTATGTGGAA | 30127 AGGGTTTGGCTTGGCTCTTG | 41111 |
| 7486 TGACCCCATGTTCCAGCTACT | 19144 TCCCTGTCTACATGAAGCAGATAAAG | 30128 CCCAGTTACACTCTTGACCCCATGT | 41112 |
| 7487 CATCTGTGAGACAACTGGTGAACT | 19145 GCCAGAAATCTGCCCTCTAGGTT | 30129 GCAGAGTGCATCTGTGAGACAAC | 41113 |
| 7488 GTGCAGTGAGAGGCGAAGTACA | 19146 GGACAGGCTCCAGATGCTAACAA | 30130 GCAGGATTTGCCTGTGCAGTGA | 41114 |
| 7489 GAAGTACATAGGGGTGACCATGAAA | 19147 CTCCCCAGACAGAGAGAACTGA | 30131 AGGTGCTTCGACAGAAGTACATAG | 41115 |
| 7490 AGCGCTCTGCGATTTCCTT | 19148 GTCACACACAGGCATGGCTACA | 30132 ACAGCGTGGCATGCTTTCT | 41116 |
| 7491 TCACACCACCCATCTGGAGTCA | 19149 AGGGAGGGGCATCTGCGTAT | 30133 TCTAGAAGCCTCCCTCCTCACA | 41117 |
| 7492 GGAGGCAAGGAAACATAGTCTTTAAC | 19150 CCTTTGCTTTTAGCAGGACACTTG | 30134 TCTCTGAAAAGGAGGCAAGGAAAC | 41118 |
| 7493 CAGTTTTCAGGCCACGTTCTAAACAAG | 19151 CTGGGACACCAGGGAATGATGTTC | 30135 CTCATTATCAGTTTTCAGGCCACGTT | 41119 |
| 7494 GCAGGCATGGTATAAAACCCATTCCATT | 19152 GACCATGTGGCTTGTGCAAAGTT | 30136 GGGTGAATGTTGCAGGCATGGTATAAAAC | 41120 |
| 7495 CCCTCTGTGGGGTACTTGGTAGA | 19153 GGTCCTGATAGGAAGGCAAAAGT | 30137 TGGAAACCTCCTTACCCTCTGT | 41121 |
| 7496 GGTGAGAAATGCTGTTATCCACCTTTAG | 19154 AGTGCCCCTCAGCACATGAAG | 30138 CTGGAAAGAGGTGAGAAATGCTGTT | 41122 |
| 7497 GCGCAGATCACCTTGTTCTCCAT | 19155 GGTCGCCTTTGGAGCAGAGA | 30139 ACCAGGGCGCAGATCACCTT | 41123 |
| 7498 GGAAGGGGCTGTCCTTCTTCTA | 19156 CAGACACGGCATCTTCCTGGAT | 30140 TCAGGCGGTTGAAGGAGGAA | 41124 |
| 7499 CCACACCAAACGGGTGTGAAAC | 19157 GCTGCGTCTTTCCTGGATGT | 30141 GGCAACCACCACACCCAAAC | 41125 |
| 7500 TGGATCGTGATATGGCGTTTTTAAG | 19158 GCCCCAGTTATCACCTAATGAACACA | 30142 GCAGTTGGCTTGATTGGATCGTGATA | 41126 |
| 7501 GGGTTTTGGCTTAAAGCAGTCTGAGT | 19159 AGTTTGTCTCCCATAAGCTCTGTAG | 30143 GTAGCCCTTGGGTTTTGGCTTA | 41127 |
| 7502 GGGAAGAGGACAAAGTGGGACTGT | 19160 CCACCCTTAAAAACTCCTCTCATCAAC | 30144 ACAAGTTTGGTGACAAGGGAAGA | 41128 |
| 7503 CCTCCCAATCCCTGACCTGTAA | 19161 CCACACTTCAAGGCTTCAAATCATCCTT | 30145 TCTGTGCCTGTCCTCCCAAT | 41129 |
| 7504 ACACCTCCATCTCGGCCACAA | 19162 CCCGGCCACAAACTGCTTTCTA | 30146 TGGCTCCCACACCTCCATCT | 41130 |
| 7505 GGAGTTTTACCCACTCCACCTGATTC | 19163 GATGGAGACCCCTCTCTCCACTA | 30147 GGCTCTGTGAATACCAGGAGTTT | 41131 |
| 7506 GGCAGCATGTGTGTGTTTCCATCT | 19164 CCCATTTCCCACCCACAGGAA | 30148 GGGAAAGGCAGCATGTGTGT | 41132 |
| 7507 CCTGAATGCCAACTGGAGGGAAT | 19165 CTCACAGCCTTTCTCAGCCTTTC | 30149 CAGACGCCTGAATGCCAACT | 41133 |
| 7508 TCTCCATTTCTGACGGGACATTT | 19166 GCTAGGCTTGGTCTCTGCAACT | 30150 AGGGTGTATTGCTTTCTCCATTTCT | 41134 |
| 7509 CCAGGACCCAGACATAGGTGGAT | 19167 CACGGTTCATGTAAAAGAGCGAAT | 30151 AGGTCCCAGGACCCAGACA | 41135 |
| 7510 GCTCAGACACACTCCTGGAACA | 19168 TGTGGCGGACGCCATTATCA | 30152 ATGCTGGGCTCAGACACACT | 41136 |
| 7511 CAGTTTCACCTCTGAGCATTGATTTC | 19169 GTTTGGTGCTGGCTTTGGTT | 30153 GGTGAGTGCTCAGTTTCACCTCTGA | 41137 |
| 7512 GGTTTCTACAGTTGCCTGTTATAGAGAAG | 19170 CAGCTCCAGGCTGAGACATTCA | 30154 CACATGGTTTCTACAGTTGCCTGTT | 41138 |
| 7513 AGGACAACCAGAGAGGAACAATG | 19171 CCAGGCCAACCTTAGCCATATT | 30155 GGGCTGTGTGAGAAGGACAA | 41139 |
| 7514 GAGAGGCCACTTTCAGCCACTA | 19172 GGAGATGGAGGGAGCTTTGTGA | 30156 GGCTGTTAGTGAGAGGCCACTTT | 41140 |
| 7515 GGTAGCTGGGAGAAAAGAAGGTTAG | 19173 GTCCTGCTTTAGGACTTTTGCACTTAC | 30157 CCAAGCAGGTAGCTGGGAGAAA | 41141 |
| 7516 GGGATGAAGATCGAAAATAGGACCAA | 19174 GAATGGGGTTGTCCACAATTAGTATG | 30158 TGGAACAATGGGATGAAGATCGAA | 41142 |
| 7517 GCCAACGGGAAACACATTGAA | 19175 CCACCAACCCGATCAGTCAAA | 30159 CCTCAATGTATGCCAACGGGAAA | 41143 |
| 7518 GTGACTTCCTCACACTCCTGATTC | 19176 ACTTTTTCACGACATTCCTCTTCATCT | 30160 CTGGGAGTGACTTCCTCACACT | 41144 |
| 7519 GTGGAGCCAAACCAAGCCAAT | 19177 TCTTCCATTCTCCCCTTCCAAAATG | 30161 CACACTGTACAATAGTGGAGCCAAAC | 41145 |
| 7520 CAGGCTCAGTTGAGGTGAGGTT | 19178 GCTGACAGACTTGCTTTCCCAGTA | 30162 AGACAGCAGCAGGCTCAGTTG | 41146 |
| 7521 GCAAAATGGCCAGGTACGATGT | 19179 GCACCAGGTTGGATGTGCTA | 30163 GAAGACATGGGCAGAGAAGCAA | 41147 |
| 7522 GTTTCCAGTCTCTGCTCATTAGGAA | 19180 TCTGTGGGTGTAAGGAATACACAATG | 30164 ACTTCCAAATGTGTTTCCAGTCTCT | 41148 |
| 7523 AGATGGGCTCTTCCTGCTCATC | 19181 CTGAGGCTAAAGATCACCCATGGTA | 30165 ACCCACACAGATGGGCTCTT | 41149 |
| 7524 CCAGCCTTGATTCTTTGGAATCCTGTTAC | 19182 GCTCCTCACGGATGGTCTGAAA | 30166 CTGTCCAGCCTTGATTCTTTGGAA | 41150 |
| 7525 TCCATCCCCTGGCCTCAAATCT | 19183 CTCACCAGCCTGAGAAAAGGAAAC | 30167 TGTCGTGTTTCTCCATGTTCCAT | 41151 |
| 7526 GTGTGCCAGTGTACTTCATTCATCTGT | 19184 CAGGGAGTCTGTCCCTTGCATAC | 30168 GAGTATCTGTGTGCCAGTGTACTTC | 41152 |
| 7527 CCTTGCGAGTGGACTTCAGTGTTG | 19185 GCATCTTAGTCACAGGGAACCAGAAAC | 30169 GCCTTGAGACCTTGCGAGTGA | 41153 |
| 7528 ACGTCCTGGAAGTCAGTGTAAC | 19186 TGGGAAGTGGCGTGTGTTCA | 30170 CCAAGATGACCACGTCCTGGAA | 41154 |
| 7529 GACCACCCAAAAAGAGAACTGTTG | 19187 CCAGTCCAGGCCCCTGGTTA | 30171 GCAGAACTGTCTGACCACCCAAA | 41155 |
| 7530 GGGAACCAAAACAAGCACTAAAGTGTGAT | 19188 GTGGAGGGAATAGCCCTTTGAGA | 30172 TCTGGGAACCAAAACAAGCACTA | 41156 |
| 7531 GGGGATCTTGCACTCACTTGT | 19189 GGCCAGTCCCCACTCTTTCTTA | 30173 GGTCCCATACGAAGGGGATCTTG | 41157 |
| 7532 GTCCTGTAGCATCAGACCTTTAAGACA | 19190 GACAGCAGAATGCAAGTGACCTT | 30174 GCTGAAACCAAGTCCTGTAGCATCA | 41158 |
| 7533 CCCTGCATCTTTCAAAGGCATCTTTC | 19191 CTGTTTCTTCGCTGGCTACAGTTTG | 30175 GCTGTTGACACAGTCCCTGCAT | 41159 |
| 7534 CCAGTTCAAGGGCAAAGGTACT | 19192 CTCCCCTGGAAACAATAAGTCGATGA | 30176 AGTTTCAGTCTCACCCAGTTCAAG | 41160 |
| 7535 GTGACTCCTAATGAAGGCAGACTCCTA | 19193 TGTGCCCAAGAAGTAAATTGGGATA | 30177 ACGCTATGTGCTGTGACTCCTA | 41161 |
| 7536 GTGGGCTTTGCAGTCAGGACAT | 19194 GGTGTGGCCTTCACAGGTAAGA | 30178 CGGTTTAGAGCATGTGGGCTTTG | 41162 |
| 7537 GAAGAGGGGATTGAATAGTCAGGTTAC | 19195 CCTCAAGAGCATGCTACACACT | 30179 CTTCCCATTTGAAGAGGGGATTGA | 41163 |

FIG. 36L6

| | | | |
|---|---|---|---|
| 7538 TGCCTCTAGAATGGCACTGTTTAG | 19196 TGCTGGACACCACAGAACTTT | 30180 GTGCTGGTACCTGTTGCCTCTA | 41164 |
| 7539 GTGTCAGGGGTAGTGAGTTTGGTTT | 19197 GTCAACATTCACACTCAGGACCTT | 30181 GCTCATGGTGTCAGGGGTAGTGA | 41165 |
| 7540 TCCTGTGGACATACCCAGTTGA | 19198 TGTCTTCCATTAGCTCCAGACTCA | 30182 GCCCCTTGAATATTCCTGTGGACAT | 41166 |
| 7541 GCCAGCAGATGAGTCATGGAGTAT | 19199 CCATCCTCTTCACGCCCATCAGATA | 30183 GGTCAATGCCAGCAGATGAGT | 41167 |
| 7542 GTGGGATGCCAAGAACTTGACTTTG | 19200 TGCTCCCTTGCTATTGAGACTTG | 30184 GGCTAAGTGTGGGATGCCAAGA | 41168 |
| 7543 GAGCAATGAGAGAGCAATGCGTTAT | 19201 CCCACACTCACTCCTCTAGTCTGT | 30185 GTGCAGCATCACAGAGCAATG | 41169 |
| 7544 GCCACAGGGAATCTGTGTTTGAAG | 19202 GGAGAAAGGTTGAGTCTGGGGAATG | 30186 GAGGAAAAACAGCCACAGGGAATC | 41170 |
| 7545 CGTGCTGACTTAGGCAGATTTTG | 19203 CCACATACCAAGGAGAGTTGACAGAT | 30187 CTTTCAAGACCTACGTGCTGACT | 41171 |
| 7546 GCCAACAAAAGTCCTCGCTTTG | 19204 GACGTCATTTAGCTCGGGTGAA | 30188 CCAGGCAGGTGCCAACAAAA | 41172 |
| 7547 CCAGGAAAAGAGGTGACTGCAT | 19205 GCAAAAGATCCTGCTCTGTAGGGAAA | 30189 GTGCAATTCAGATGGCCTCTTC | 41173 |
| 7548 CTCAGCATGTTCTAAGGGCAGAGA | 19206 CCCTCGATAAGGCAATGTATACTCACA | 30190 TGCAGAATCACTCAGCATGTTCTA | 41174 |
| 7549 GTCCTCTGCCCATGAGTGAAC | 19207 GCCCCAGAATATGAAATTGGAACAGAAG | 30191 GGGGCCTCGTTTTGGAGTTG | 41175 |
| 7550 CCCTGGAAATGCATCCACGAT | 19208 CAGAATGGATGCGTCCGCTAA | 30192 GCCTGCGAACCCTGGAAATG | 41176 |
| 7551 GGCTTGAGTGAAATGGTAGTACTCAAA | 19209 GTTCAGGGTTCTTCTTCTCTCCAA | 30193 AGTCTTGGCTTGAGTGAAATGGTA | 41177 |
| 7552 GCCTAGTGTAGGCAAAGGAAGTCT | 19210 GATTTCTTAAAGCCGGTTTGTGGAT | 30194 AGGGGCAGAGAAGCCTAGTGTA | 41178 |
| 7553 TGGGCCCTGTAGAGTGCATTTC | 19211 CCCTATGGAAAGACAGCACCCAAA | 30195 TCTTTCAGGATGGGCCCTGTAG | 41179 |
| 7554 GTGTCCTGGGTGTGTGTTCA | 19212 CCTCCTAGTTCCTACTCAGCCTCTAAC | 30196 TTGCAAAGCCCGGGAGTGT | 41180 |
| 7555 CTCCTACTTGGGTGGAGGAAGTCT | 19213 CATGCCTGAGGTAACACCTACTCT | 30197 GACCATAGATCCCCTCTCCTACTTG | 41181 |
| 7556 GTAGCAGTACAGATGAGTGACATAGAT | 19214 GTCTTGTCATTCCTACCCTTCAAATG | 30198 GGACGAAGGTGGTAGCAGTACAGA | 41182 |
| 7557 GGGTTTCCTGCAAAAATGGAGAGCTTTTT | 19215 GCTTCATGCCTGCCATCCTT | 30199 CCTTCACTCGGGTTTCCTGCAA | 41183 |
| 7558 CAAACCAAGCACTTCTCCAAAACT | 19216 ACTGGAGCTTCATCCTTTCATACAA | 30200 TGTGAAGTACAAACCAAGCACTTC | 41184 |
| 7559 GCCCCTCTTTCTCTGCATCTGGTA | 19217 CAGAAAGTAACAGGTCAGCTCAGAACTA | 30201 TCACCCTGCCCCTCTTTCTCT | 41185 |
| 7560 CCTTTCAGCCACACCTGTCTTTG | 19218 CAGGCTCATGGCAGAACTGT | 30202 GCACTGCCTCAGCTCCTTTCA | 41186 |
| 7561 GGGAGACTGTATCCAGGCAGTGTGT | 19219 CTCAAATAGGCCCTTGGCAGAAAAG | 30203 CATCTCCTAGAGCTGGAGACTGTAT | 41187 |
| 7562 GCCCCTCTCTTGCTGGCATT | 19220 GGTTTGCCATCTAGATCAATGCAGACTT | 30204 TGACACCAGATGCCCCTCTCTT | 41188 |
| 7563 GCAGCCCTTTTTGCGAGGAT | 19221 CAATCCCTGTTAAATTACCCCATCCAT | 30205 CATGTCTGTACAGCAGCCCTTT | 41189 |
| 7564 GAGCTTTGGGAAAGGGAAAGAGA | 19222 CTGAGGACCCTGTGGTTGAGTT | 30206 CCACATCCAAAGAGCAGAGCTT | 41190 |
| 7565 TGGCCTCGGGTTTTAGATGAAC | 19223 GGCTGCTTGCTAATTCCAGAGA | 30207 GCAAAATATAGGATGGCCTCGGGTTT | 41191 |
| 7566 GCACCTTACAGTGCCAACTGTTTC | 19224 GCCTCTGTAGAGAGCAGCATTC | 30208 TTGGGGACCAAGCACCTTAC | 41192 |
| 7567 CCACTTCTCTGTGACCATTTGTTTGGTA | 19225 GTCCTGGATTGTACTTAGAGGAAGAAC | 30209 CACACCACTTCTCTGTGACCAT | 41193 |
| 7568 TGGGCAGGTCACACCCTGAAT | 19226 ACCTCGAGTCGGAACCTCTT | 30210 TAGGTCGGGAGCTGAGACA | 41194 |
| 7569 CACTTGTCCACGCTGCGTTT | 19227 ACCTTTCGGGCCCTGCATT | 30211 AAACCAGCCCGTCACACTTG | 41195 |
| 7570 CCATCTTCAGCTCTTGCTTTGCTT | 19228 GCAACAGGTCTGTGGCAAATG | 30212 CCCCAAACCATCTTCAGCTCTT | 41196 |
| 7571 GGGGTCTCCTTAGTATCATCCCTTT | 19229 GTTTAGGACCCCTTTCTGGTAACAT | 30213 TTTGGGTCAGGGGTCTCCTT | 41197 |
| 7572 CCTTCCTGGATGTGCCTTGAAGT | 19230 ACCTTCTCTGGCTGACTGCTT | 30214 CAGGTGACAAACCTTCCTGGATGT | 41198 |
| 7573 CCGGGTCACACCAACCATCT | 19231 ACCATGGTAACATTGGAAGGTGAA | 30215 CAATAAAACCTTTTCCGGGTCACA | 41199 |
| 7574 GGGTCCCACTGTTACCAACTCTTG | 19232 GGCTTGTTCATGTAAGGTTGTCAGAA | 30216 ACTGAATGGGTCCCACTGTTAC | 41200 |
| 7575 GTGTGGAGTCAAACACTCCTGGTT | 19233 CCCCAAATCACCACTTAAATGGAATCAGA | 30217 GCTCAGGGTGTGGAGTCAAACA | 41201 |
| 7576 GGATGAAAAGAAACCCAGACAGAGACTTT | 19234 CGAGGTTCCATCCTAGTCCCAAGT | 30218 CGTGTCCTTTAGAGGATGAAAAGAAAC | 41202 |
| 7577 TGGGGTTGTCTCAGTGGTGCTA | 19235 TGCCCAGTGGATGACGGAAT | 30219 TCCAATGAATGTCAATGGGGTTGT | 41203 |
| 7578 GGGGTCTGCTGTAGAATTCCTGTTG | 19236 CGAAGCACTGGGAACTGCAGTAAA | 30220 CTGGATTTCAGGGGTCTGCTGTA | 41204 |
| 7579 GTTTCTGAAGACAAATCGGCATTAC | 19237 TGTGTATGAACACACAGACAGGTT | 30221 GCTGTTCACAGTTTCTGGAAGACA | 41205 |
| 7580 CCCTGCATCATATTCTGTGAAACACTTTG | 19238 ACAGCATGGTGTAAGCAAGAAACT | 30222 TCCAGCCATTCCCTGCATCA | 41206 |
| 7581 GGGCAGGCAATTTCCCCTAAGA | 19239 GCGGAGAAGAGAGTTCAGTTTTCATC | 30223 TGTCAGTGTGGGCAGGCAAT | 41207 |
| 7582 CTCTCTGATAAGGCCCCGGTTT | 19240 CCATGCCTGAAATGCGGCTAA | 30224 GTGGGGCCCTTCTCTTCTCT | 41208 |
| 7583 CCACCAAGGACCCTATGAGCAGTT | 19241 CCCTAGGGTTGTCCCTTCTCAGT | 30225 TGGTAAGGGCTAGGCCACCAA | 41209 |
| 7584 TCCCATCCAGAGTCCGACCAT | 19242 GTCAACGACAACCAGCAGACA | 30226 GCAGCTGTTCCCGTGACTGT | 41210 |
| 7585 GAACCAGCAGATTTGGGGCTAT | 19243 GCACACCTTTGGAATCAGCTACT | 30227 TGCCTGAAGCCCCATGAAC | 41211 |
| 7586 GGGCCCGCTTTTTAACACTTTG | 19244 GGGGTAAGGAATGTGATGTAGTTTCATTG | 30228 TTGCATAAGGGCCCGCTTT | 41212 |
| 7587 GAGAGTAGTTGTGGATACCCGAGAAA | 19245 GGGGAAACCTTGAGAACTGAGAA | 30229 GGAACAGAACAAGAGAGTAGTTGTGGAT | 41213 |
| 7588 TGCTCAAAACCAGTAGCACTTTCA | 19246 AAGCTCCCTAAAAGTCAGCAAAGA | 30230 GCAACGCAGCAATATATGCTCAA | 41214 |
| 7589 CCAACCTAGACTTCCAGCGTTAAG | 19247 CCTGGGCTTCGGAGAGAGA | 30231 CACCAACCCCAACCTAGACTTC | 41215 |
| 7590 GCAAAGGGCCCCAGTTTTGCTT | 19248 CAGTCACCAGAGTGAGCAGTCA | 30232 TACCCTTGGGGCATGCAAAG | 41216 |
| 7591 GCCTTGCAGAGAAACACATTTTTGGAT | 19249 GCCATGGGGAATAAGCACTCA | 30233 GCCAGCCTTGCAGAGAAACA | 41217 |
| 7592 GGGGAGTATCATTTTCCCAGCTCCAA | 19250 CACGCCACTCAAGCTCGAAGGAA | 30234 CCACAGTCCCTAAATGGGGAGTATCA | 41218 |
| 7593 GTGTGTCCGTTGTGTGCAACT | 19251 CCTGTGGCCAAGGAGGAAAG | 30235 GGTGGCTCTGTGCTGTGT | 41219 |
| 7594 AGCGGTGTAGCCGTCTGA | 19252 TGCCAGGCTGCTCCTGCAT | 30236 CCAGGTGCAGAGCGGTGTA | 41220 |
| 7595 CGCTGAAGGACCCTCCTCAAAG | 19253 CCCAGGTCCTCCCCTAAGCAT | 30237 AAGCCTGGCTGGCGCTGAA | 41221 |
| 7596 AGAGAGGCCCTGAGGACTTG | 19254 GACACTGTCCTTGCCAACCATTTC | 30238 AGGAGCCGGGCATTCAGAGA | 41222 |
| 7597 TGTAACTAAAGTGTAGGCTGCGTAT | 19255 GACCTTGAAGCCAGGTCCTATG | 30239 GAGGATCCCTTTCCTGTAACTAAAGTGT | 41223 |
| 7598 GACCAACGATGTGTTGTGCTCTT | 19256 GACTCCCAGGCCAAAGATCTGAGAA | 30240 GTGTATAAAGCCAGACCAACGATGT | 41224 |
| 7599 GGTGTCCATGCGGGCTTTAGTA | 19257 CCACAACAGAAGCATGGTGCATAC | 30241 TGGCAGGACGTGGTGTCCAT | 41225 |
| 7600 CTCGGGGATTTGGGAAATCACTCT | 19258 CTGGAGCTGAAGTTGATGGAGAT | 30242 CCGCAACCTCTCGGGGATTT | 41226 |
| 7601 CACGATGGGAGAGGTCATCTTG | 19259 CGCCTCCGTTGGCAAATCAA | 30243 GGAGGCCACCATTCCACGAT | 41227 |
| 7602 GCCTTTGGCGACATCGTCTTC | 19260 GATGGAAACCAACCTTTTTCACCTTCT | 30244 GATGCCAACCGATGCCTTTG | 41228 |

FIG. 36L7

| | | | |
|---|---|---|---|
| 7603 GCAAGACCCCATGAAAATCAATGGAACA | 19261 AGAGTAGGGCTCCCCATTCTTTT | 30245 GTTATGAATTGCAAGACCCCATGAA | 41229 |
| 7604 GCAGCTGCACCATTTACAGCCTAA | 19262 GTGAACTTTGGGCATCCTGTGA | 30246 CAGAGGCAGCTGCACCATTT | 41230 |
| 7605 TGGCCAGGCAGCTCTGTCA | 19263 GAACAGGCTGCTTCCGATCA | 30247 TCAGCTGACAGGGCCAAAAC | 41231 |
| 7606 CCAAACTCATTGTTTCTCCTGGTTT | 19264 GGGCTTGAGCATGGATTAAAGGGAAAG | 30248 CTCTCAGAGCCCAAACTCATTGT | 41232 |
| 7607 GCTGTGGAAAGGTCATCTGAGACATC | 19265 GATGAGTGCAGACTGGAAACCATT | 30249 TGGGCTGTGGAAAGGTCATC | 41233 |
| 7608 TCACATCCACTGGCCGCATTC | 19266 GCCTGAAGAAACTCGGCTCTGT | 30250 AGCAACGGAAGGAACTCACATC | 41234 |
| 7609 TGGCCCTGCTGAAACTTTAGAAC | 19267 CTGTGTGAAGGAAGGAGGATGAAAGT | 30251 CCAGTTGGCCCTGCTGAAA | 41235 |
| 7610 CGTCCACTTCCAGGACCAGAA | 19268 GGCACATACAGTTCAGCCTGTT | 30252 TGGCCGTCAGCGTCCACTT | 41236 |
| 7611 AGGTAGTCGGTGAGCAGGAA | 19269 ACGCCGGTGCTGTCGTACT | 30253 GCGTGTAGCGCAGGTAGT | 41237 |
| 7612 GGAAGTTTCCCTTGTGTGAAAGTCAA | 19270 CTGACTGGTTCCTGTCTCCAAGAAG | 30254 CTCCAGGAAGTTTCCCTTGTGT | 41238 |
| 7613 GGTTGGCTTGTCACCCTAGAGA | 19271 GGAGCAGGGAAGGATGCAACTA | 30255 CCTCCTGTCTTGGTTGGCTTGT | 41239 |
| 7614 GTGATGCTTTTGGGAATTCACTTCT | 19272 CAGGATCTAGCCCTATGAGCATGTTA | 30256 CCACCAGTGCACTTAGTGATGCTT | 41240 |
| 7615 CCGAATTTTCCGAGGACCAAGT | 19273 GGAGCCGCGCAGGTTTACA | 30257 GCTGGGACACACCTTCCGAAT | 41241 |
| 7616 GCTCTGCTAGATGCTGAGGATGA | 19274 GTGAGCTCTGTGAGGATGGAGAT | 30258 TGCCGGGTGCTCTGCTAGAT | 41242 |
| 7617 CTGGGAAGAGGTGGATAAATGTTCA | 19275 GTGATAACAGGAAGGGGATGTTTCTCT | 30259 CAGTTATTTGTCTGGGAAGAGGTGGAT | 41243 |
| 7618 AGGGAGGGAATGTGAAGAGAAAGT | 19276 CACTCAGCTGGCACTAGTCTTT | 30260 GAGGGAGGGAGGGAATGTGA | 41244 |
| 7619 GCTTCCCAGTGCTTAGGACCACAT | 19277 TGGGTGGTTTTGCTGTCTAAGTT | 30261 ACCCGGCTTCCCAGTGCTTA | 41245 |
| 7620 GAGGCTTTGACTGGATGATGTTCA | 19278 GGGGCAATGACACTCTCTGTT | 30262 GTGAAAGAAATCTCAGAGGCTTTGACT | 41246 |
| 7621 GCCCATGTCAACCCCATCCAAA | 19279 CTCTGTCTTAGTTGCTCTGCTTGAT | 30263 TCTTCTTGAGGCCCATGTCAAC | 41247 |
| 7622 GTTGGATCCTTTCTAGCTCCAAGA | 19280 AGCTCCAGAGCCTAGCACTT | 30264 GCCAACTTCCTTTTGTTGGATCCTTTC | 41248 |
| 7623 GCCTCAGACCCTATTTGACACAAG | 19281 GAGACCATTTCCTGACAGCTGGTT | 30265 ACCACCTTGCCTCAGACCCTAT | 41249 |
| 7624 AGAGGGGTATTGCCCTGTCTAA | 19282 GGGAAGAATCCTGGACCTCACCAT | 30266 GGTGAAGCAGCATCTTAGAGGGGTAT | 41250 |
| 7625 CGAACTCTCCATCCCTGCTTCT | 19283 CTTGCCTTTACTTTGTGGAGTCATTCT | 30267 GGTGGCCCGAACTCTCCAT | 41251 |
| 7626 GTGGGCTAGTTTATCCTTCCAAAATC | 19284 GGAAGTAACACCCTACAGAACTGGAA | 30268 CCGTGGATGTGGGCTAGTTT | 41252 |
| 7627 GCGCTGGAGTATGGTGGTGTAA | 19285 ACCTGAGCCCGGGAGGTTGA | 30269 TCCACCTGCGCTGGAGTATG | 41253 |
| 7628 GTGCCGACTGTTTTTGCTCACA | 19286 CCACTCATGACTGAAAACCCATCTT | 30270 TGTACCCAGTGCCGACTGTT | 41254 |
| 7629 CACTGGAGGTTGGTGGAAGCAA | 19287 GGACAAGCTTCAAGAGTTAGGTTAGGTA | 30271 CCATGGAGACCACTGGAGGTT | 41255 |
| 7630 GCCACAGTTGGCTCTATCTGCTA | 19288 GGAAAATAGCCTTCCTTCACAGCCTAT | 30272 TCTAAAACTACCTGAGCCACAGTTG | 41256 |
| 7631 GACTCCCAATTAGCGCTCTTTTTCA | 19289 GCTGGCAGGGGTCAGGATTTTA | 30273 GCCAGGCTCTTGACTCCCAAT | 41257 |
| 7632 GACTTTTCACCCACACATGGGATT | 19290 CAGTTATGTCCTAAAGACCCGTATCAT | 30274 GTCGTCTGCCTCGATGACTTTTC | 41258 |
| 7633 GCATGGGCATCATTAGTCACACA | 19291 GTGAACCAGGGTGAGCAAATTC | 30275 GGTTGTGGCATGGGCATCATT | 41259 |
| 7634 CCCTGCAGAACCACTTCCGTTA | 19292 CAGCATCGGGGAGTAGTTTAGGTTTC | 30276 ACCTGCGTCCCTGCAGAA | 41260 |
| 7635 GCCACCTGAGACCATGCTTCTA | 19293 GGAGGCAGAGAAATCCAGTTTGT | 30277 TGTCTTGCTGCCACCTGAGA | 41261 |
| 7636 GGCTTATCCTGGCACCGATTCT | 19294 GCACCCAAGCCTGCGAGTAA | 30278 AGCCTCTCCAGCTGGGCTTAT | 41262 |
| 7637 GGGAGACAAACTCATTGGAGTCA | 19295 CCGTCTGTCTAGGAAAGGAAGCTCTA | 30279 TGGTGAGGAATAAAGGGAGACAAAC | 41263 |
| 7638 GGAAAGCACATTGTCCAGATGGTT | 19296 CTCACAGAGCTATAAGCAGGCAAA | 30280 AAGAAGTCACTGGAAAGCACATTG | 41264 |
| 7639 GGCCCACACATGCATGAAGA | 19297 CCTGGCAGGGCGTCTTTTC | 30281 TGGTCCCAGGCCCACACAT | 41265 |
| 7640 GGCTTGATCTGCTGTTACTGGAGAAG | 19298 GCGATCCTCCATTGCACCAT | 30282 ACAGTAATGGCTTGATCTGCTGTT | 41266 |
| 7641 CCCAAAGCTCCCTCATTACCTTCTT | 19299 GCTCAGCAAATGCCTACTAACTTG | 30283 ACCTTCACAGGATCATCCCAAAG | 41267 |
| 7642 CCAGTGGGGCATTACTGGGTTA | 19300 CATGTCTGGAAACTGCTTCCTGTT | 30284 TACGGTGTCCAGTGGGGCATT | 41268 |
| 7643 GGAGGCCTTTCAGGGATCTTGCTA | 19301 TGGGTGAGTTGGTGAGGTCTAC | 30285 GCCTATCACTTGGAGGCCTTTC | 41269 |
| 7644 GGTGTGTGAGGCTAATCCTTGA | 19302 GCCTGGCTCTGCTCCATTTCA | 30286 GGCACGAGACTTGGTGTGTGA | 41270 |
| 7645 CCTCCAGAAGTCGGCAATGTT | 19303 AATGAGGTATAAGGCCACTT | 30287 CTTTGCAACCCCTCCAGAAG | 41271 |
| 7646 GAGCGAAAGTGCGAGGTCATAG | 19304 GCATCATTACAGGCAGACTTTACAAAC | 30288 TGCGCACAGAGCGAAAGT | 41272 |
| 7647 ACAGTGAACCAGCCCCATCTTC | 19305 GAAGATCATCTGAAATTTGCCGGATTG | 30289 AGCCTCTGGGCACAGTGAAC | 41273 |
| 7648 GACCAGCTTCCTTATGACTTTTGGTT | 19306 GAGAAGCCAAGGTGGCTACAAG | 30290 GCCATCTCTTTACTGACCAGCTT | 41274 |
| 7649 CCCATACACGTCACTGTCTCTCACA | 19307 GGCAGGCTTATGTACCCACTGAAA | 30291 GCTGTTCTTTCCCATACACGTCACT | 41275 |
| 7650 CAAGAACCCCAGGTCAGAGAAC | 19308 GGGGTCCTTGCTCATAGAGCTT | 30292 TGGAATCCGTGAGGCCAAGA | 41276 |
| 7651 GTGGTAGCAGCAAAGACTGTAATC | 19309 GCACTCTAGGTTGAATAGGTGCCTAGA | 30293 CTGAAACTGTGTGGTAGCAGCAA | 41277 |
| 7652 GCACACACAAGGACTTGCTCACA | 19310 CTGCCAGGAAGTAGGATTCATTCATT | 30294 ACAGGGCTGGCACACACAA | 41278 |
| 7653 GCGAACAGGCAGGAAAGACTCA | 19311 GTCCTCTGCCACTTGAAGTCTCTAT | 30295 GGGCTCTTAGCCTTGGAGGAT | 41279 |
| 7654 GTTACATGAGTAGAAGGGTTGGGTTA | 19312 GAGCTGGTGTAGACAGAGGTGTTTC | 30296 CCTTGGAGCTGCTGGGAAAGTT | 41280 |
| 7655 GTACAGCCCAGCAATTCTACCTT | 19313 CCTGCAAGAGAGGAATGCAAAAC | 30297 AGCCCCACCGTTGTCTGTA | 41281 |
| 7656 GGTGTCATCTCTGTGGCAATATTGTGATG | 19314 GCAGTTAACTACTTCTCTTAGCAGTGA | 30298 CAGGTGTCATCTCTGTGGCAAT | 41282 |
| 7657 GCTGCCGGGAAAACCATGTAGA | 19315 TGCCGGTTCCTCTCTCTTCT | 30299 GAGACAATGCTGCCGGGAAA | 41283 |
| 7658 CGGCAGTGATCTCAATGACAGGAT | 19316 GAACATTTGGGTTGCAGAAGTACTGA | 30300 GCTTTGCTCCGGCAGTGATCT | 41284 |
| 7659 GCCAAGGAAGCTCGAGGGATT | 19317 GGAAAAACCGAAGGACCAAAAGATGA | 30301 TCCAAGCGCGCAGACTGTAT | 41285 |
| 7660 CTCTCCCTGCTATGTCCCTGAAC | 19318 CGCTGAAGTGGTATTTACAGTCATGAGA | 30302 CCCATTGAAAACTCTCCCTGCTATG | 41286 |
| 7661 GACTTCAAACAATGAAGAGGGGACTA | 19319 CCTCTTAGGTGTTGGTTGGCAGAA | 30303 CACCTGCTGGTGATATATGACTTCAAAC | 41287 |
| 7662 GGTGTTGTACGTGGGAAATTTGGGATA | 19320 CCTCCCTGGAAGGCTGTAAAATC | 30304 CCAGGAAGGAGTCTGGTGTTGT | 41288 |
| 7663 GGAGAGATGAGAAGGGAACAGATGATTTT | 19321 AAACCGTGCTAGACAACCTGAAC | 30305 GCGACTGTCACGGACACTTCT | 41289 |
| 7664 GCACATCGTTTCTGCGTCTTG | 19322 TGGGCCTTCCCCATGTCT | 30306 CTCACCAGAGGCACATCGTTTC | 41290 |
| 7665 TCCCTCCTGTTGGTCTCTCCTT | 19323 GCAACATTTGGAGGTCAGGGAAGT | 30307 CCTGGTTCTTTCTCTCCCTCCTGTT | 41291 |
| 7666 GACAGCCCAAATCCCAGAGAGT | 19324 TGCGTGCTGGGAGAGCTAAG | 30308 AGCTCAAGGGACAGCCCAAATC | 41292 |
| 7667 GCAAGCGGGAAGATGGAAGA | 19325 GTGTGTGACGCTGAGAGATCCAA | 30309 GGCAAAGGCAGGCAGAAAGCAA | 41293 |

FIG. 36L8

| | | | |
|---|---|---|---|
| 7668 CCGCCTCAATACCAGGACTCTTAG | 19326 TGGAGGCTGAACGTGCCTTT | 30310 TCCCTGACAGCCGCCTCAAT | 41294 |
| 7669 GCTATTGTTCTCACCTATGTTGTTG | 19327 CACCCTAGGATGATGGGATGACTGAA | 30311 GGGACTCACAAACTGCTATTGTTC | 41295 |
| 7670 GCTGGCTTTAGAGCTGGGCATA | 19328 TGAAGAGGAAGTGGCAGAGTTG | 30312 GCTCTGCCAAGAGCTGGCTTTA | 41296 |
| 7671 GGATTTTCCTCTACAGAGTGGTTTCT | 19329 CAGGAGGCTCACAGAAGCTTTA | 30313 TCCAACCTCTAGGATTTTCCTCTACA | 41297 |
| 7672 CTGCTTGTGAGAAGGAGACCAA | 19330 GGGAGAGGCCAGGTGGAAGT | 30314 GCTGGCAACTGCTTGTGAGA | 41298 |
| 7673 GCTTGGCCATGTTCTTGGAAGCTA | 19331 GGGCTGGAATGTTGTGTGGGAAA | 30315 AGGCTGCTTGGCCATGTTCT | 41299 |
| 7674 GGTTGCTTCTGCACAAATCCAAGT | 19332 CACCAATATGGAAGAGGGTTCAGCAT | 30316 CCCTTGAAAATACCTGGTTGCTTCT | 41300 |
| 7675 CCCGCTCTGTTTGACTCAGTGT | 19333 GTTGCAGAGGGATTTAAAGAAGCTGTT | 30317 GAGAAGAATGCCCGCTCTGT | 41301 |
| 7676 AGAGGAATTGCGAAACCATGACT | 19334 TTCAGCGAGACCTGCCCTTTC | 30318 CCCAGATGGAGCTGAAAAGAGGAATTG | 41302 |
| 7677 TGAGCGTGGAGATGGTGATG | 19335 GGGAAAAATCCTGGGTAACTACTTCTTC | 30319 GGGGTCCAGCACTATTCTCTTG | 41303 |
| 7678 TCGGAAGGGACTTTCTAGTCTGT | 19336 GCACAAAGACAGACGTAAGATGAAAC | 30320 CGAGGTTGTCGGAAGGGACTTT | 41304 |
| 7679 CTCCCAGCACCTTCTGACAAAC | 19337 CCAAGCAAACAGTGTACTTCAGACAA | 30321 CCAAGGACTCCCAGCACCTT | 41305 |
| 7680 TGACCCGCACAGCATCTTG | 19338 GCCTCCCTGCTTCCTTCTGAT | 30322 AATGTCAGGCAGCCCAGAGA | 41306 |
| 7681 GGATCCTGCTTTCCAGTCTGTCA | 19339 GACCCTCCTTCAACTCGTGGTA | 30323 AACCGGTGGATCCTGCTTTC | 41307 |
| 7682 GGAGTTCTTTGCTCCGTGTCTGT | 19340 GAGTAACCACAGCTCATCCTCATAG | 30324 AGTCCCTCCCTGGAGTTCTTTG | 41308 |
| 7683 GTGGTGGTGTTATGGCTAGGTTAG | 19341 GATCAAGCAGAAAGGTCCCTTGTTTA | 30325 TGGAGAATTTGTTGTGGTGGTGTT | 41309 |
| 7684 CTTCCAAACCCCAGATTCTTTAGTCT | 19342 CCTGGTATAGCATAAAGGTTGAGAGTGAT | 30326 AAGTTACATCTTCCAAACCCCAGAT | 41310 |
| 7685 TCCTGCCCTTAGAGTCAGAAAGA | 19343 TCTTCAATCCCTTGTGTGCCAATA | 30327 GACAGAATCCAAATCCTGCCCTTAG | 41311 |
| 7686 CCCCTGATTGACAGCCAGCAA | 19344 GCAATTCCATGGGCTGTAGCATAG | 30328 CGAGGGTGACCCCTGATTGA | 41312 |
| 7687 GTCTTCTGTCTACTTGGACCTTTAAGTCA | 19345 GAAGGAAGGGATGGCCATTAGGAA | 30329 CCAACTGGTGTCTTCTGTCTACTTG | 41313 |
| 7688 CCTCAGGACCTTTGAGCAGTCCAA | 19346 CACCACCCCAACCAATCCCTTT | 30330 GCTTCTGTCCCTCAGGACCTTTGA | 41314 |
| 7689 CCAGCTGCTGTTTCAAGAGTGCAT | 19347 CACAGCCAAACCATATCAATAGGTGAA | 30331 TCCTTCTCCAGCTGCTGTTTC | 41315 |
| 7690 CCCAGGTGTGTGTAACAAAAGTTC | 19348 TGCTTGAACTCCAGATCAGCAAA | 30332 CTCTCTTTTCCCAGGTGTGTGT | 41316 |
| 7691 GGGAGACAAACAAGACAGAGGAGAT | 19349 CTGCACTGCGTTTCCAGCTA | 30333 GGGTAGAGGCCATGGAGACAAAC | 41317 |
| 7692 GGACCTGTGTGATAGCAAGCAT | 19350 GTGCAATACACTGGGTTTGCTGTAG | 30334 CCATAAGAAAGAAGGACCTGTGTGA | 41318 |
| 7693 GGACTGGTCTAAGTGGGTGTCACT | 19351 ACTGTGTGTAGAGAGACCTTGTGA | 30335 GCCCAGCTTTGGACTGGTCTAAGT | 41319 |
| 7694 CAGAGCAGGACAATGGCTCTAC | 19352 CTAGCACATTGACTGAAGGAGATAGAA | 30336 TCTGGGTCAGAGCAGGACAA | 41320 |
| 7695 GCTTCGGACTGATTTCTGCTGTGTT | 19353 GACAGAATGGAGCAGGTGCTAAGA | 30337 CCTGCTGCTTCGGACTGATTTC | 41321 |
| 7696 GCAGTAGCAGGTTGACTCCATCA | 19354 CTCAGAGTCAATATAACCATCGCTAACCAA | 30338 CGTTACACGCAGTAGCAGGTTG | 41322 |
| 7697 CCACAGTGCAAGGTGAATTTAGACT | 19355 CCGCCATGCAGTTTCTCTCTTG | 30339 GCCCAGGAACCACAGTGCAA | 41323 |
| 7698 GGCTGGTCTTCCTTGCTGTAA | 19356 GCTCAGTGGAATTGATTTGTCGGTAA | 30340 CCTACAAGGGTGGCTGGTCTT | 41324 |
| 7699 GCACTGGCATTTCCCTTTGTT | 19357 AGCTGAAGGGGTTTCCACAATG | 30341 TGCTGTGGCACTGGCATTT | 41325 |
| 7700 GTCCAGAACCACTAGGGCATGA | 19358 ACTCCGGCAGAGACTCGAA | 30342 GCTCTAGGCCTCATGTCCAGAA | 41326 |
| 7701 GAAGGAAAGAGGAGTATGTGTCTTCATC | 19359 GACCAACACATAGGTTAGGGTCTTG | 30343 TCTCAGAAGAAGGAAAGAGGAGTATGT | 41327 |
| 7702 CTGCTTCTCTTCGCTTTTGCATTTC | 19360 CAGGAACGGCAGGAAATAAGAGATTT | 30344 TCCTGTGCGACTCTGCTTCTCT | 41328 |
| 7703 GCTCCCCGGTCATTCTCTCTTCT | 19361 GAATAGGGAATTGAGGAGGAATGTTGA | 30345 ATCGATGCTCCCCGGTCATT | 41329 |
| 7704 CCGGGGCTATGCAATGTATCA | 19362 GAGAAACCTGCCTAATACAAAATCCCTTTC | 30346 ACTGTCACATCCGGGGCTAT | 41330 |
| 7705 CTGCCTCTTGGAACACTAACAGT | 19363 CGTCTGCTTTTGGAGGATCTGAAC | 30347 GATCACACTACTGCCTCTTGGAA | 41331 |
| 7706 GCTTCACCCCGAAATCAGAGACA | 19364 GGACTCCGACCAGTTCCTCTCT | 30348 ACAGAGAGCTTCACCCCGAAA | 41332 |
| 7707 GTCAGACTCCATAAGTACCGTTTACA | 19365 TGTCAGGTAGGATTGGGATGGTT | 30349 TCCCAGATTGTCAGACTCCATAAGT | 41333 |
| 7708 CCAGAGCATGCTGACGCGTATTT | 19366 GGGAGGCAGGACACCTTTTCTT | 30350 GCGCCAACACCAGAGCAT | 41334 |
| 7709 GGTTTGTGGTGAATTGTCAAGCATGT | 19367 AGGGAGGCATCCCCTGAAG | 30351 GGGTCACCTGTACTTGGGTTTG | 41335 |
| 7710 GCAGCCCAAGATCACTGGAGTT | 19368 CAGCCATTAGAGAACCACAGACT | 30352 GGTGGGTGCAGCCCAAGAT | 41336 |
| 7711 TCAGCTGTGGCGGGTACTGAA | 19369 TGAGAAAGCGCCCTGTTCTAATG | 30353 GGGTCTCAGCTGGTTCGTTTCA | 41337 |
| 7712 CGTACTACCACGTATCCAACTCTTTG | 19370 TCAGGGAGTGGTAAATAAGGCTAGA | 30354 GGCCCTTTCGTACTACCACGTATC | 41338 |
| 7713 AACTTGGAGTGGAGATGCAGAAA | 19371 TGGGGTGCAGGGACTCCTTAAA | 30355 CACCCTGCCTGCCTCTAAAA | 41339 |
| 7714 AACCAGGCCAAGACCTTTCTTT | 19372 CCTCTGATCTCACTCCCTGATTCACT | 30356 TTCTGCTTAAACCAGGCCAAGA | 41340 |
| 7715 GCTTGACTGCCAGTGTCCAA | 19373 TCCCGGCCTTTTGCTGGAT | 30357 GGCCACGAAATGCATGCTTGA | 41341 |
| 7716 CGCTGTCCAGTTTTCCCTGTGT | 19374 GAATTACTCTGGCTCACGCTCTT | 30358 GTTCCATCCGCTGTCCAGTT | 41342 |
| 7717 AGCCTTGAGAGAGGTGTGATGAT | 19375 GCAGGTACAGGTTTAGGCTTCTCT | 30359 GTCACCAGTACCTTCTATAAGCCTTGA | 41343 |
| 7718 CAGGTAACATGCGTTCCCTTTG | 19376 GTCTCTTATCCATCCACAGCAAGAA | 30360 GGATGAACCCCTTCTACAGGTAACA | 41344 |
| 7719 CAACAGCGCACTACAAAGGCTAT | 19377 TCCATTCTAGGGACCAATCGTACT | 30361 ACCAAATTCAACAGCGCACTAC | 41345 |
| 7720 GACTGCAGAATACAGAGGACGACTT | 19378 CAGCCAAGAGCTCGCATTCA | 30362 CCACACCTCAGTCCCTGTGA | 41346 |
| 7721 CTTCCTTAGAAAGGTGGCATCAAGT | 19379 AGCAAGCAGCAAGCCATTTTAC | 30363 GCTCTGCACTTCATCCTTCCTTAG | 41347 |
| 7722 CATTGTGGGCAAAAGAGCAAAAC | 19380 GGGTCAGTTATTGCCAAGAGTGATTT | 30364 GGGCCTTCATGCTGTGTCATTG | 41348 |
| 7723 CCTGGGACAAAACCTCTTTCTCTGAAT | 19381 GGACTTTCAAGGAGATGAATCCCAAAGA | 30365 TCTGGAGTTCCTGGGACAAAAC | 41349 |
| 7724 GGAAGACAGAGTGTTGGGAGGTA | 19382 CCTGTTTCTTTTCAAGGGAGGCTAT | 30366 GGCAGCTGGAAGACAGAGTGT | 41350 |
| 7725 GGGACAAAGGTAGGGGTGTGATAC | 19383 CTCAATAGTATTTGACACGCTCTCTCT | 30367 GCACAATCAGCAACTGGGACAA | 41351 |
| 7726 GCGGAATTCCTCAAGGCACAGA | 19384 TCTGGGTGGGCTGTGAGTAAA | 30368 TCCTCCACTGGACTGCGGAAT | 41352 |
| 7727 CCACTGGTTTATCCCACTGGCATTT | 19385 GCTCATCTGGGGAAAGATGTCACTA | 30369 CCTGCTCTGCATTTCCACTGGTT | 41353 |
| 7728 GGGCTATTGGTCTGGCACACAT | 19386 GTCTCATGGAAAGCAAGTGACATTGTTC | 30370 TTTCAGGGAGTCATGGGCTATTG | 41354 |
| 7729 GGTGGGTGCTTCCACTCATCAT | 19387 GGTGATTTAAGAGCAAGGGTTAGCTT | 30371 ATCCTGTCGGGGTGGGTGCTT | 41355 |
| 7730 CTGGCTGTTAGACTGTGATGAAGA | 19388 TTAAGCCCCAGGCTGCTGAATC | 30372 TGACCTCATCTATTCTGGCTGTTAGA | 41356 |
| 7731 GCAGCTTGGCCTTAGAACCTTTC | 19389 TGTGTGCCATCTGCTTTCACAA | 30373 CAACACTGCAGCTTGGCCTTA | 41357 |
| 7732 GGGAAGGCTATTTTACTGACCCAAA | 19390 CTCTTTGCTTCCAAGGCTGAAATC | 30374 TGATCTAGAGAAAGGGGAAGGCTAT | 41358 |

FIG. 36L9

| | | | |
|---|---|---|---|
| 7733 CACCCATACTTGCTGGGTTCAACA | 19391 CTGGTCACAGGGCTTTCTCCTT | 30375 AGCCTGCCTATCACCCATACT | 41359 |
| 7734 GAAACCAACCTCTCAATCCATCAAG | 19392 CCTGCCCGCCTTTTAGATAATGT | 30376 CTCCATGGAAACCAACCTCTCAA | 41360 |
| 7735 GGGCTCAAGCTGTTCTATGCCTAAC | 19393 GGCCATGCCCTCTCCATGTAT | 30377 TCTGGGGCTCAAGCTGTTCT | 41361 |
| 7736 GACCTTACCCAGCAGTTCAAGCAT | 19394 AAGGGCTGACCCTCTTCAGT | 30378 GAGAGTGAGGAAAAACCAAGACCTTA | 41362 |
| 7737 GCCATAATTTCAGGGAGGACGTA | 19395 AGAGCCTCAGGCGGACCTTT | 30379 GGGCTGTGCTTCCATCTTGCCATA | 41363 |
| 7738 ACCTGGCCTCAAGTGGTCCAT | 19396 CGATTCTTGTTCGAATGGAAGGTAATG | 30380 TCTCACACACCTGGCCTCAA | 41364 |
| 7739 GGTCTGTCTTGCTTTTAACTGGATTG | 19397 CAGGTGTTAGTAAACATAGTCCTCTCCAAA | 30381 CCAGCCTTGGTCTGTCTTGCTT | 41365 |
| 7740 TCCTGGCTCTGTGAGCAACTAC | 19398 CTGAGGTGGGTTTGCTCTCTGT | 30382 AGCACCTCCAGGTCACAAATC | 41366 |
| 7741 GGGCAAAGCACAGTCAGTCATC | 19399 GGAGAAACTGATCAGGTCCCTATTTCT | 30383 TCCGGGACTGTGGGCAAA | 41367 |
| 7742 GCTGACAATGTCCTGTTGCTGACA | 19400 GCGAATCACCAAAAGGAAAACACACTTG | 30384 GGTGTTTCTGGAGGGCTGACAA | 41368 |
| 7743 GCTGAGTGTCCCAGAAGCTAAG | 19401 CAGGTGAAGTTTCCCGGCATGA | 30385 CTTCATACACCTCCATTTGCTGAGT | 41369 |
| 7744 GCCTGACTTTGTATGCCTGGAT | 19402 CCAGACCTGGGACCAAGAACA | 30386 CCAAGTTGCCAAAGAATGCCTGACT | 41370 |
| 7745 GCTGCTTGGTTCACATGCTTAC | 19403 CAGGGGCTAATTGGATGCAGAA | 30387 CCTGCTAGTGCTGCTTGGTT | 41371 |
| 7746 GCAGGGAGTCTGCTCCTTCA | 19404 GGCTGAGAGTAAATGGTGACTTTCACA | 30388 CATGTGCTTTGCAGGGAGTCT | 41372 |
| 7747 CTAGCCTCTGTTTCCAGCTTTACA | 19405 AGTCCTGGATCCCGTTCAGT | 30389 TCACGGGTCTAGCCTCTGTTTC | 41373 |
| 7748 GGGCGTCAATTGCAACTCTTC | 19406 CCAAATCTGATGGGGTAGGCAACA | 30390 TGGCCTTTGGGCGTCAAT | 41374 |
| 7749 GGGATTGGGGACCTGCTTCAAA | 19407 GCACAGCACAGATGCTCCACTA | 30391 CCTAGTAAGGAGGAACGGGATTG | 41375 |
| 7750 ACTCCCAGATGCATAGGACACT | 19408 TGGGCACGTTTGTCCAAGAT | 30392 CAGCTCAGAAGTAAGACTCCCAGAT | 41376 |
| 7751 AAGGTTTGGGGACGGTCTCA | 19409 AGGAGGGACCCAGGCAAA | 30393 GAGGACAGCACTCCAAGGTTT | 41377 |
| 7752 CACTGCAACAGTCACAGTCTAACA | 19410 GGACCAGGATTCGAGGAGTTAAG | 30394 TGTAGCACACTGCAACAGTTAAG | 41378 |
| 7753 CATCCACAGTCCAGGAATAGGATTTT | 19411 CCAGGTTTGTCTTTAAAGGGATGGAATG | 30395 CTCACTACATCCACAGTCCAGGAA | 41379 |
| 7754 GCTTTGTTCTAGGACATTGGCTGTTC | 19412 GTAAGTGACTTTCAGGGAGATTGAATG | 30396 TCCTTCAGAGATCAGAGAAGCTTTG | 41380 |
| 7755 GAGCCAGTGTTAAAATGGCATGAGA | 19413 GCAAAGACAATGAAAGCACCATCATC | 30397 GGTGCCTGAAAGAGCCAGTGTT | 41381 |
| 7756 GGCACCAAAATTCCAACAGCAA | 19414 GCAACTGCCTAGAGAGCTGATT | 30398 GACATCTGAGTTAACTGGCACCAAA | 41382 |
| 7757 CATGAACTTGGGGCTTGTGTCA | 19415 TGCCCGGGACAGACCCAGAT | 30399 CACACGACACACACATGAACTTG | 41383 |
| 7758 CTTTGGGCAAAACACACAGACAAG | 19416 TGCAGCAGCTGGTGGTTGT | 30400 GGCCCACATCACTTTGGGCAAAAC | 41384 |
| 7759 CCCATCTCCAGCCCCACAAA | 19417 ACGGTGACACTTGTGTTGTGA | 30401 ATGCAGGCTGACCTCCCATCT | 41385 |
| 7760 TGCAGCCAAGTAACTGACTCTTC | 19418 TGAAGGAATAACCATACCTTCCTCATC | 30402 GAACAAATGCATGCAGCCAAGT | 41386 |
| 7761 GCAGACCTCTTACATGAAGTGAATG | 19419 GCTGTCAGAATGGGGTATGTGTGT | 30403 CCACCCTGCAATTTCTTACAT | 41387 |
| 7762 CTGTCTCAGGCAAAGCTGGAT | 19420 GGACACCCCTGCCGTAGACAT | 30404 AGGGACTGGAAGAGCACTGT | 41388 |
| 7763 GGCAAGAATCAGATAGCACCCACAAA | 19421 GACATGGGCCTTTCATTGAACTCTC | 30405 ATCAAAGACCTGGCAAGAATCAGA | 41389 |
| 7764 GGCCTAAGGCATCCTGTATCCCAAA | 19422 CTCTTACTGGAAATGATGGCTTGTCT | 30406 TGCTGGCACCAGGGCCTAA | 41390 |
| 7765 AGATGCGGGACCCACTGA | 19423 GGTTTCACGGGATGCCTTTG | 30407 CCCTCCTGTCTGTGAGGGAGAT | 41391 |
| 7766 GCCCCATGACTATCGTGTGAGGTT | 19424 AGGGGCTTTGCTGAAATGATATGAA | 30408 AGCCACAGCCCCATGACTA | 41392 |
| 7767 GTTACCGCAGCAGCATGTTTAC | 19425 GTTGATGCCACTGTCAGCAGTT | 30409 CGCACGTCTCAGGTTGTGAA | 41393 |
| 7768 CCCTACAAATGCCAGCAGCTTTC | 19426 TCCTTGCGAGACTTTGTGGTT | 30410 GTCAGTCCCTCTCCCTACAAATG | 41394 |
| 7769 CCCGGATATTATTAGCCAGTTAGCAA | 19427 GGGACTGCAGCAATGTGGTA | 30411 CGCCCCACAACCCGGATATTA | 41395 |
| 7770 GCATGGAAAGAGAAATCTGGTGTGGAT | 19428 CTCCATTGATTTAGAGCTGATCCACTGA | 30412 GGGTTTGTGTGCATGGAAAGAGAAATC | 41396 |
| 7771 CCTGGCAGTGTATGAAGAGGCATT | 19429 CCAATGTACAGGCATGGCTTCT | 30413 GCAGCATTTCCTGGCAGTGTA | 41397 |
| 7772 GGGGAGTGTGACTGAAGGAAAAAC | 19430 CCAAGCAGGGTGCTATTTCTCA | 30414 AGCAAGGGGAGTGTGACTGA | 41398 |
| 7773 GCCCAAAATGGACCAGTTCAAAAC | 19431 GGGGATAGGACTGGGTTTCAGA | 30415 CAGAACCAAATCCATAGCCCAAAATG | 41399 |
| 7774 TCCAGGCTTGCCCCTTCTCA | 19432 GCCTTAAGGAGCAGCGTTTTG | 30416 CTGATGCCTCCCCTAAATGTTCT | 41400 |
| 7775 GGGTAATGCCGAGTAGAGAATTGA | 19433 GCCCCTTCATTGCTATCCTGTGGTT | 30417 GGTACTAAGGGGTAATGCCGAGTA | 41401 |
| 7776 TGTCCTTTTTCATTGGAGGGTACA | 19434 GTATGTTGCCATCTGTAGCCAATG | 30418 CCTCACACCAGAGCTGTCCTTT | 41402 |
| 7777 TGCCCTCTCCTCCCTGCAAATA | 19435 CAGGCACACCACCAATCGTT | 30419 TCGGGTCCTGCCTTTCTCTTG | 41403 |
| 7778 CAGCTCCCAGTCACAGTGTTTC | 19436 GCTGAAATTAGTCACCGACCACCAA | 30420 GCAAACATCAGCTCCCAGTCA | 41404 |
| 7779 GTCATGTCCCGCTGTTCTGATGT | 19437 GCTCTTCCAAGAAAGGCAAGTGAAAG | 30421 GCATCTCTGGTTCTTCCCAAGTCA | 41405 |
| 7780 ACCTGGAAGTTACCAGTCTTTGAAC | 19438 CAGCTTTCACGGCTCAGTGT | 30422 GACGCTGATGTAACCTGGAAGT | 41406 |
| 7781 CTGGAGGTAGAGCCTTGGACTTTC | 19439 CCATTACCACAATCTGGGCTGTTTC | 30423 TGGTGTCATTCTAATCTCTGGAGGTA | 41407 |
| 7782 TCCCCAAGAGATGTTAGCTTTCTAC | 19440 TGCCTGGTACAGGTGAGGCTTA | 30424 CAAGGGTATCCCCAAGAGATGTTAG | 41408 |
| 7783 CGGACAGGTTTCATGCGGAGTA | 19441 GAGACCCAGGAGTCTTCCTTGTTAC | 30425 GACTTACTAGCGGACAGGTTTCA | 41409 |
| 7784 GGTGTCTTTCCAGAGGCTTTCTCTTC | 19442 GTCACAAAGAAGGGAGAGGTTCACA | 30426 GCTGTAGACATGCTCTTGGTGTCT | 41410 |
| 7785 CGATCCAGAGAGATGCTGGCAAAA | 19443 CCTCCCTTTAAGGTCCTTTCCAGAAGT | 30427 GGCCAGCGATCCAGAGAGAT | 41411 |
| 7786 GAAGCTGTGTATCCTAAGAGCACTTTC | 19444 ACGTGCAGCAGTGGATGCTA | 30428 CTCAACAGTGAAGCTGTGTATCCTAAG | 41412 |
| 7787 GGCCCTGAAATCCAGCAAGATG | 19445 GCCAGGTGATCTTAGACCTGCACTA | 30429 AATCCCAGGAGGCCCTGAAATC | 41413 |
| 7788 GGAGCAGATAACGGGTCCAATG | 19446 GCATTACTTACCTTGACTCTTAGCTTGTTG | 30430 GGCTAAAGCGACAGGAGCAGAT | 41414 |
| 7789 TGTGGAAGCGGGGAAACTGA | 19447 GTGGAGGGCTTATAATGAGGCTTGTATAG | 30431 CTCAAATCCTCCTGTCTGTGGAA | 41415 |
| 7790 GGCCTATGGTAGCAACCACTGCTAAA | 19448 CCTAGCAGCTGTTGGCAGAAG | 30432 GGAAATACAGGGCCTATGGTAGCAA | 41416 |
| 7791 CTCTCCGGCGATGTAATTTCTGGAT | 19449 GCCTGATGTGATGCTGGAAAC | 30433 CGAGCTCTCCGGCGATGTAA | 41417 |
| 7792 TGCTATAGAGAGAGGCAACTTGAGAT | 19450 GCATGACAGCACAGGCTCAT | 30434 GAGGAGGGACTATGAAGGATGCTA | 41418 |
| 7793 CCACACTCAGCCTAGCATTCAGA | 19451 CTGAAGAGGACTTCTTGACTTTGGTAAG | 30435 CTGGAATTACATGCCACCACACT | 41419 |
| 7794 CGTTAAATCCTCACACAGTTGCTT | 19452 GACATTGGTGCATGTGATGTCTGT | 30436 GGCTGCAGAAGTTCATAGCGTTAAATC | 41420 |
| 7795 GGCGAACTCGCTGTGGTATTGT | 19453 TAACGCGCCTGGGCTCTCCTTT | 30437 TTTCGGGTCCAGGCGAACT | 41421 |
| 7796 CACCTTGGCCATGCCAACATTC | 19454 GCCGATGAACTGGGTTTGGAAATG | 30438 GGAGCCAGTTGGCATGCACCTT | 41422 |
| 7797 AAGCAGGAGGAATAAGTGTGAATGA | 19455 TGATCTTCTTTCGTGGCAACAGATT | 30439 ACTAGGAAGGTAAGCAGGAGGAA | 41423 |

FIG. 36L10

| | | | |
|---|---|---|---|
| 7798 CCTGCCAATCTCAGCACTTTCTCT | 19456 GGAAGGATAACTCCACCCAGTCA | 30440 GCTCTCTCTGTACCTGCCAATC | 41424 |
| 7799 GGCTTTGCAGGTCATACAGCTTCT | 19457 GCTGCTTTTGCGCTACAGTGA | 30441 AATACGTAGGCTTTGCAGGTCAT | 41425 |
| 7800 GGGTTGTTGCCTGCTTGCTT | 19458 GCCCTGCACCTCCATATGTTCT | 30442 GCTTGTCAGTGATGGGTTGTTG | 41426 |
| 7801 GCAGGGGTAAGAAGCAGAGAAG | 19459 TGGTATGGAGGAGTGTTGTGGAT | 30443 GATGTTGTTTTGCAGGGGTAAGAA | 41427 |
| 7802 GGCTCACAACGGAAAAGAGTATTTCT | 19460 ACTACGTGGAACAGAGCTGATAGAT | 30444 ACTTTAGTGGCTCACAACGGAAA | 41428 |
| 7803 GCAAGAGTGCTGGAGGAACAGA | 19461 GCTGGAAGGGGAGTCTGGTATTCT | 30445 ACAGACAGGGATAAGTCAGCAAGA | 41429 |
| 7804 GGGCATTAGGACAAAGTAGGAGGTACT | 19462 CCCATCCTTGTCAGCTCCAGAT | 30446 GCAGCAGGGCATTAGGACAAAG | 41430 |
| 7805 CCCTGTAGGCCTTGGCATTTCT | 19463 GATGGTGCCAACATGCTCAAC | 30447 GCTACCAGGTTAATCCCTCCCTGTAG | 41431 |
| 7806 GCTGGCTTTTGGTTTCAAGAACA | 19464 GGCCCCAAGGAAATGATGGATTC | 30448 GCATATCATGCTGGCTTTTGGTT | 41432 |
| 7807 GGAAGGCTGTGATTTCATTTTGGTT | 19465 ACATATGCCTCAGTAGCAAGTTGT | 30449 GGATCAATCTGGGAAGGCTGTGA | 41433 |
| 7808 CTGGTAAGACTAAATAACCCTCACTCACT | 19466 GATTCCCACGTCCGTGATTTACT | 30450 GCAACAGCAATGGCCTGGTAAG | 41434 |
| 7809 CAGGATGGTTGTATGGGTATACTTGA | 19467 GGTGTGAAAGCAATACACATTCGGTAGA | 30451 CCTGAAAGTGAAAAACAGGATGGTTGTATG | 41435 |
| 7810 AGTTTGTCTAGGGCCATGCTAAG | 19468 TGTTATCTGTCGTGCTTGTCT | 30452 ACAGCTGAGCACAGTTTGTCT | 41436 |
| 7811 GCAGGGTCCCGATTCAATGT | 19469 GCACACTGACAAAGTAGGGGAGTTG | 30453 TTGTCAGTCCCCACCCACCTT | 41437 |
| 7812 ACTTGCCTCTGCTCTCATTGAA | 19470 TGGAGTGAGCAAAGTGTTGCAT | 30454 ACCGAGCAACAGGGCTTACTTG | 41438 |
| 7813 TCTGGAAGCCCCAGTGTTGT | 19471 CACAGGGAGAGAAAAGCAGGGAAA | 30455 TCACTGCGATGAGTTGGTTTCT | 41439 |
| 7814 AGAAAAGGGCAAGTCCCCATAAA | 19472 AGTTCTCACTTTGAGCTGTGGTT | 30456 ATTCTAGGCAGAAAAGGGCAAGT | 41440 |
| 7815 GCCTAGTGGTAAAGCCCCATT | 19473 GAACAGTTGCTGATCCTTCTGATTC | 30457 TCATGGGATCTTGCCTAGTGGTA | 41441 |
| 7816 CTCTCTACCCTCTGTCAGCACATC | 19474 GTTGGAGTCACCTATTCAGGTAAAGA | 30458 CGTCTTGTGTTCTCTCTACCCTCTGT | 41442 |
| 7817 CCCACTTGCCCATATCCAAGTTT | 19475 GTTTTATGTCCTGGTGTCCTTACTTGT | 30459 CCATCTCTTTCCCACTTGCCCATA | 41443 |
| 7818 GGGAAACGAGTGACCTCTATTATTACTCA | 19476 GACAAACAGTCCTACTTGGGGAGTTTT | 30460 GAAATGGGAAACGAGTGACCTCTAT | 41444 |
| 7819 GGTGGTTTGAGATGCCACCTTT | 19477 GCCCAGAAAGAGACCTAAGTGCAT | 30461 CTTTGGCCTGGTGGTTTGAGA | 41445 |
| 7820 GGTATGACCAGGATGGTGTGGTT | 19478 CCTAATTTAGCTCCTTGAGACTCAGAT | 30462 CCCCAAAATGGTATGACCAGGAT | 41446 |
| 7821 GGGAGAATACGGAAGAACTATTGGATTG | 19479 AGGGACTGGTAACCTGAGTCAA | 30463 TGACTCCAGTTGTTTGGGAGAATAC | 41447 |
| 7822 CCATGGTGAGCATTAAAACACTCTCA | 19480 GGAGTAGGGGTCAGTATAGGGATTG | 30464 CTCAGCCCATGGTGAGCATT | 41448 |
| 7823 ACAAGACCCAGTTTCTGCCATTC | 19481 GCACAGCAAGCAAGGAGTAAATGAT | 30465 CAAGGTCCTACAAGACCCAGTTT | 41449 |
| 7824 ACTCAGCCGTTGTTTGTGGAA | 19482 GCACAGACATCCATCTAGAAAAACAAG | 30466 GGGACTTTGGGCTGGACTCA | 41450 |
| 7825 TCTAGGAGCTGATACTCTTCTAGTGAA | 19483 GATTCTGGGAGGACAGATGCTTT | 30467 GCCCATCTAGGAGCTGATACTCT | 41451 |
| 7826 TCCATGCACCTTGGTGGAGAG | 19484 CCCAAGTGAGGCCTCTGAAATC | 30468 CCACCCCGCATTAGTGTCAT | 41452 |
| 7827 GATCCTTGTTGGCTTCTCACCTA | 19485 GCAGCTTAACCAGCACAATTGGATT | 30469 TTGCGCTCAGCCAAGTGAGA | 41453 |
| 7828 ACAGACCAACTGGATCTTTCACATAC | 19486 TCCAGAGAGGTCACACCATTCTT | 30470 CCTGGTGTTAGGATACAGACCAACT | 41454 |
| 7829 GAGCAGACTGCCATTGTGCCTAT | 19487 AGCAGCTGGGAAGAAGTACAGA | 30471 CAGGGTACGTGTAGAGCAGACT | 41455 |
| 7830 GAAAGAAGGCCAGATGTGTGACTA | 19488 CCTCTTGCTAATTGCTATCTCCAAGTGTTT | 30472 GCGGAATCTGAAAGAAGGCCAGAT | 41456 |
| 7831 GCAGCCAAGATTCTAAGTCTGTCTGAA | 19489 GGAGGTGTTTCCTGGGAGAAAG | 30473 CCAGACCGCAGCCAAGATTCTA | 41457 |
| 7832 GTGGTATAGGGCTCAGATACAAGAAG | 19490 TTCAGGGACAGAGTCTGAGATGT | 30474 CATTGTGCAATGCTGTGGTATAG | 41458 |
| 7833 CCTGTTTCATGCCAGCCAATGTTC | 19491 GGGGTAATAGGCTTTGCTGTGAAG | 30475 TCTCGGTGTCCTCCTGTTTCA | 41459 |
| 7834 CAGGTGACATCCAGGGACAAATAAAG | 19492 CCTCCTTGATTCACCGCTCAGT | 30476 GTGTTCATGGACGGGTGTCA | 41460 |
| 7835 CCCTGGGGAGCTATGGAACTGA | 19493 CTCACTGTTGCTGTCGGTATTCA | 30477 AGGGGATCCCTGGGGAGCTA | 41461 |
| 7836 GAACCCCAATTTGCTCAGGTGTT | 19494 GCAGAGAATCAAACTTACCCTTGTGT | 30478 CTCCCTTACACAGAACCCCAATTT | 41462 |
| 7837 GAATGACCCCATACTGTGGTTTGT | 19495 CAGAAAAGAAACGCTTTCCTGCAAATG | 30479 GCCCCTTAATTGAATGACCCCATACT | 41463 |
| 7838 CTGATGCAGCTGGGCTTCAAC | 19496 CCTTATCCGCATCCAGTTCAGT | 30480 GGAAGGAAAATGCCCAGTCTTCTGA | 41464 |
| 7839 GGGAATCTGAAGTCCAAAACATGGTAAG | 19497 CACCTTTTTCCCCTGCTCCAA | 30481 GGGTCTATCACGTGTTACTTGGGAAT | 41465 |
| 7840 CCTCCTAACGGCCAAATAGAACATGTAG | 19498 CGCTGACCCTCCCATAGTGTT | 30482 CCTGCCTCCTAACGGCCAAATAG | 41466 |
| 7841 GCCTTCTATTGATCCTTCACCCAAA | 19499 GCAAGGGTTGAAAACTACACATCA | 30483 GATGCTGAGGATTGGCCTTCT | 41467 |
| 7842 GTGTTTGAGAAGACCCTTGGAAAAGT | 19500 TCAAGTCCTCATCTTATCCCCAAGT | 30484 GGCACTGGTGTAGTGTTTGAGAAGA | 41468 |
| 7843 ACACCCAGCAAATGAAGCAATCT | 19501 TGCCCTGTGCAGTAAACTTTCA | 30485 GCAACTCTTTCCACACCCAGCAA | 41469 |
| 7844 CAGATCCGTCGTCAGCTCAACACT | 19502 GCCGTCTTGGGTGGTTCACA | 30486 AAGTCGGAGGGCGTTCACA | 41470 |
| 7845 GGAGGTGGGTACAGAGAAAAGCTA | 19503 GCCACACACCACCTCTTGAGT | 30487 TGTGTGGAGGTGGGTACAGA | 41471 |
| 7846 CTGTTGGTTTCGAGCAAACACAT | 19504 TGGCAGTTTTTCACTCTCCTTACT | 30488 GACCTTCCCTTGTCTGTTGGTT | 41472 |
| 7847 GGAAGGCTCCAATAACACCATGAGAT | 19505 TGCCAGGCTGTCCACATCA | 30489 GAGGGTGGAAGGCTCCAATAAC | 41473 |
| 7848 GAGAAGATCACCAAGGGCAACT | 19506 TCACAGTGGCTACATCAAAGTCAT | 30490 AACCTCCATCTGCTCCTGAGA | 41474 |
| 7849 CTCATCACCATTGACGTCCTACA | 19507 GGGGCAGGCATATAATACACAATCAA | 30491 TCCCAGAAGTACTCATCACCATTG | 41475 |
| 7850 GGGCCTGTTTGCCTCTCTGAA | 19508 CCAGACATTGTGTTCAGTTCTGTGTCTA | 30492 TGAAGGCAGGGCCTGTTTG | 41476 |
| 7851 ACTCTCTCCGACCTGCATCT | 19509 TGGCCCCATTGGGAAGTAGGAT | 30493 GCCTGTTTCCACCACACTCTCT | 41477 |
| 7852 CCCTTCACTCTGTGAATTCCTTCT | 19510 TCCACAGCAGGGGCTGTTCTA | 30494 AGCCTCTTCCCTTCACTCTGT | 41478 |
| 7853 CCTGTCAGTAGCAGTCCCTCAAA | 19511 CCCCCAGACACATACTGGAGGATT | 30495 AATGGACCAGCCCTGTCAGTAG | 41479 |
| 7854 GAGCGATTTCAGGGAAACACAGA | 19512 GCTGACTTCCAGCTTGTAGGATTTG | 30496 CGCAACACAGGGAGCGATTT | 41480 |
| 7855 CCTACACCAACACTGTTTCTCCACAA | 19513 CATTTGAGACTTCCAGAGGAGTTGA | 30497 TCCTGACCCTACACCAACACT | 41481 |
| 7856 GCCCAGCCCATCTGTTTTACCAA | 19514 GAAGAAGCAACGCACTGGATCA | 30498 ACCTGGTGCCCAGCCCATCT | 41482 |
| 7857 CTGACTGCATGGACACTTCCTGTT | 19515 CACCCACAGCCTATGTCACATTT | 30499 TGACATGCTTGCTGACTGCAT | 41483 |
| 7858 CTGGGTATGATGTTTATGGGTGAGTA | 19516 GAAGGCAGATATAGGAATTCAGACGTT | 30500 AGCCCACTCTCTGGGTATGATG | 41484 |
| 7859 CGAAACATTTAAATCGGCTCTGTGAAC | 19517 CCAGGAGGACTTGCATTTCAGTA | 30501 GAGGCAATTGATGGCATAACGAAAC | 41485 |
| 7860 AAGTCCCAGTGATCGTTAGAGAAAG | 19518 CCTGCCCTGATTACCCTAAGCAATA | 30502 GTGCCTTAAGTCCCAGTGATCTGT | 41486 |
| 7861 ACCTGATGTTTCAAGAGCTGGTTA | 19519 AGGGGATTCATGCAGTTTGGATAA | 30503 GCTTCCTCAACCTGATGTTTCAAG | 41487 |
| 7862 GAGTTCTGGCAGTCTGTGTTTTCA | 19520 TCACCACCAATCACAAGGAAGAA | 30504 GGGGATGAGTTCTGGCAGTCT | 41488 |

FIG. 36M1

| | | | |
|---|---|---|---|
| 7863 GCCTGTTACTCTTGGAGACAGAGTT | 19521 GTTCCATATAGGCCTTGTTCTTCTACAAAG | 30505 AGGGTGTGGAGCCTGTTACTCT | 41489 |
| 7864 CACCCAGGCTTTCTGGCAGATT | 19522 GCGTATTCCTAGGGCCTGAAGT | 30506 ACTCCACTCACCCAGGCTTT | 41490 |
| 7865 CGTGCCACAATAGTTTTTAGAGGGTTT | 19523 GACCAAATGGAATGCTCAGCTACA | 30507 CTTTGCATTCGTGCCACAATAGTT | 41491 |
| 7866 TTACCGCGTCCGGAACTTCA | 19524 GGAATGTGTAAGAGGTTAAGATCCCATTTC | 30508 ACACTTGCCGTCTTCCTGTTAC | 41492 |
| 7867 GGCATGCAAGTCAAGAGTCAAG | 19525 AGGATGTTATGTGGCAAGGATGAT | 30509 CAAGACCTAAGGCATGCAAGTCA | 41493 |
| 7868 AGTAAGAGAGGGAAGGGATATTGCAT | 19526 ACCACTTGAAAGCAGGGATAGTTG | 30510 CCCTTACAACTCCATCAAGTAAGAGA | 41494 |
| 7869 GCCCTCTACCCCTCTCTGCAA | 19527 GGCAGAACTCAAGGGGCAAAAC | 30511 CAGTCGGAAGGCGAGAGAGA | 41495 |
| 7870 GGAATTCAGTCTGTACAAGGGATCA | 19528 CCTGGCAACCTTCATTTAACCCAAA | 30512 CGGTTGATCCCATGGAATTCAGTCTGT | 41496 |
| 7871 GCACGTCCAAATCTTGCTCAATC | 19529 GCTTTGTGAAGGGGTGTCCTA | 30513 CCACATCCTTGCACGTCCAAATC | 41497 |
| 7872 CCACACTGCATTTGGAATTTGGTATTG | 19530 GGAAAAAGAAGTGGACTGACATCGGAAT | 30514 CCAACTTTGCTCCACACTGCAT | 41498 |
| 7873 GACACCTGACTCCCTAAAAGAAACTTGA | 19531 AATCCCAACCCTCTGTGCTTTT | 30515 GGAGAGACACCTGACTCCCTAA | 41499 |
| 7874 GGCCCTCCAGAATAAGTGTGAAGA | 19532 CTGCATCTGCTGTATCTCTAGTGTCT | 30516 ATCCACTTGGCCCTCCAGAA | 41500 |
| 7875 CCACTTCTACCTGGCCGATTTC | 19533 GAAAAGGAAGGGAATGTACCCAGTA | 30517 GCCATGTCCCGTACCACTTCTAC | 41501 |
| 7876 AGAGGGCTAGAGGGCTGAAAT | 19534 CCCCAGGCCTTTGGCTGTTATAC | 30518 AATGAACTAGGAGAAGAGGGCTAGA | 41502 |
| 7877 AGTGTCCATCCAGTCCACGTA | 19535 CCTAAGAATGCACAAGGCTATTGAAGATG | 30519 GCGTAGGCCACCAACAGT | 41503 |
| 7878 TCTTCCCACACGTTTATGGACAAT | 19536 GCCCTGCATCAGTGCTACTAAG | 30520 TGGTGTTTCTTCCCACACGTT | 41504 |
| 7879 GCAAAACAGACAGGCAGCCAATAG | 19537 GCCCGGCCAAGATCATGACTTTTAT | 30521 GGCACATCTGGGGCAAAACA | 41505 |
| 7880 CCTGTGCTGCTAGACTCACCAGTAA | 19538 GGAAGGCCGCTATCATCCTTATTCA | 30522 CAAGCCTGTGCTGCTAGACT | 41506 |
| 7881 CCCTATACGGCTTCACCAAAAGT | 19539 GTGGACAGTGCCTTTCTGAGTA | 30523 GCATCTCCTTACCCTATACGGCTTCA | 41507 |
| 7882 GGCAGTTCTCAACTTGCAGTAATAG | 19540 GGCATTGCCAACTTTACAGACCTATC | 30524 ACCCAATTGGCAGTTCTCAACTT | 41508 |
| 7883 GCATGAAAGGGGCTAAGGTCCTAGT | 19541 CCCTGGAGTCAACATCAGAGTTTTGT | 30525 CCTGGCATGAAAGGGGCTAA | 41509 |
| 7884 GGCATTGCACCATCCCCTAAGA | 19542 GTGGAGTCACTAGGCTGACCAA | 30526 AGTGCTGCAGATGGGCATT | 41510 |
| 7885 CAGAGGCAGCTTGGAGTACTGA | 19543 CTCCTTTATTCCCCAGATTGTTGA | 30527 TACCTCCACAGAGGCAGCTT | 41511 |
| 7886 CTGGGTTTCTGGGTTCCCTTTC | 19544 GCAGAGTCATCAAAAGCCACTTTC | 30528 TTTGCTGGCATACTGGGTTTCT | 41512 |
| 7887 GGGTTTAGGGACAGAATTCAACTTTC | 19545 GGCCCTCCAAACATCATTAGTCCAAA | 30529 GTCGGTGGGTTTAGGGACAGAA | 41513 |
| 7888 GGGAGGCTAAGTGATACACACACA | 19546 GGCCTCCCTTGAAGAATCGTTGT | 30530 GCTGGAGGGAGGCTAAGTGA | 41514 |
| 7889 CTCCACCAAAGCGATTAGGAGACT | 19547 GGCTCACCAGAATCCTAGCAAAA | 30531 CCACTTCTGTACCGTCTCCACCAA | 41515 |
| 7890 GGGTGACCAAAGACGGAAAGTAGA | 19548 TTGCTATAACCACTCAGTCCTTTGT | 30532 CCCTCAAAACTAGGGTGACCAAA | 41516 |
| 7891 CTCCAAGAGGTTTCCCTAGTTGTGA | 19549 GGGAATGTCTTCACAGGGGATGTT | 30533 CCCACTAGACTCCAAGAGGTTTC | 41517 |
| 7892 GTCCTGCCTGGATTGGGCTTTT | 19550 GCATTACCATGCCCTGTGATTAAG | 30534 CCATTCGTAGTCCTGCCTGGAT | 41518 |
| 7893 GGTGGGCTTCATGCTAGGGTTTT | 19551 GGGGACTACTACCAGTGTTAAGTGAGA | 30535 ACCTACTGATGGTGGGCTTCA | 41519 |
| 7894 TGATAGTGAGGAGCCAAGATCACT | 19552 TCCAGGCTGCTATCATCTCTTCT | 30536 ACAAAGGACCACATAAGGGAGTATG | 41520 |
| 7895 GCAAAAGATGCCTGTGGACAAAGA | 19553 CCCTTCAGTGTCAACCTTATGGATCTTC | 30537 GGCAGCAGGTCTCTGCAAAA | 41521 |
| 7896 TGCATTCTTCCCAGTGGAGAAAC | 19554 GCTCATCTTCCATCGGAGCAACT | 30538 CCCCACACCCCTTGCATTCTT | 41522 |
| 7897 CTCGTACAGTACTCTTGGGTGTAAAAATTG | 19555 ACCAAAACGCCTCCAGAAAAGT | 30539 GGACACAGATAAGTTGCCATTCTCGTA | 41523 |
| 7898 TGGGTGTTTAGTCCCTGAGAGT | 19556 TCACAGGCAGAGTAGGGCATA | 30540 TCAGCAGAGTCTGGCACTCA | 41524 |
| 7899 GCTGGGAGAAGGGTTTGTGTCA | 19557 AGAGAGGACATCAGGGGAACAA | 30541 AGGCTCTGGGCTGGGAGAAG | 41525 |
| 7900 GGCCTAATCAGGAAATGGCTTCTTC | 19558 GGCCATGCCAAATAGGAAAAGGTTTG | 30542 GTGGAAGACACATGGCCTAATCA | 41526 |
| 7901 GCCAGTCACTCACACTTGGGCTAT | 19559 GCCCAGAAACCAGGAGATGATG | 30543 TGGACAGGGCCAGTCACTCA | 41527 |
| 7902 AGGGGAAGTCCTTGCCTTGA | 19560 CATGTACCCACGCCTGAATCT | 30544 CTCTTTGTTGAGAAACAGGGGAAGT | 41528 |
| 7903 GGTGAAAGGTGACTTGTGGTCTGA | 19561 GCAAAGATTCAGGCATCGGAATAA | 30545 ACCAACAGGTGAAAGGTGACTT | 41529 |
| 7904 CAGCATTTCTAACCTTGTTTCCCAATC | 19562 TGGAATTGGCAGGGTCTTCTCT | 30546 CATGCTAAGGGCAACAGCATTTC | 41530 |
| 7905 AGCCTGTGAGCTGGGTTTTG | 19563 CAGACGCACCTAGAGTTGTCCTA | 30547 AGGAGCCACGAAGCCTGTGA | 41531 |
| 7906 CTGCCATGACAGCCCATTTCTCA | 19564 CCAGAGTCGGTATTTTCAATCACCAAA | 30548 AGGAGGGTGGCTGCCATGA | 41532 |
| 7907 GGACGCGCAAAGGTGTTTC | 19565 GTGTGTCATATTCTCCCCTAGGACTT | 30549 TTCGGTGAAGGACGCGCAAA | 41533 |
| 7908 CGGCAGCCAAAATATAGCAGAGA | 19566 CCCAGACATGCCCTTGACCTTT | 30550 CAGAAGATAAGTTAAACGGCAGCCAAA | 41534 |
| 7909 GCCAGAAGATGCTGGCAAAGA | 19567 GGCTAGAACTGCAAAAACAGAGGCTGTA | 30551 GGAAAGGACAACAATTGCCAGAAGA | 41535 |
| 7910 TGAGCTGGTACTGGTGTCTCT | 19568 TGACCAGGGTTCACACCTCAGA | 30552 AGGAGGTCCTGTTGAGCTGGTA | 41536 |
| 7911 ACAATTGCCCTGAAGTGTGTCA | 19569 GGGCTATCACCAGTTTGACTATTCTGT | 30553 GTCCCCTCACAATTGCCCTGAA | 41537 |
| 7912 CCCGCTGATTCAGGGACTCT | 19570 CCATGTTAGAGGGTTAAGTCATGGAGTTC | 30554 CACACTCAAGACCCGCTGATTC | 41538 |
| 7913 GCGTGTTTGAACCAACATCTGA | 19571 GTAGGTAAATTGGTAACAGGCAGTTG | 30555 CCGTTAAAATGGCCTTATGCGTGTTTG | 41539 |
| 7914 GCCCTAACACCTACAAACCCCTTTT | 19572 TCCAGTGGCGAAATGTTTCTGT | 30556 TCTGTGGCCCTAACACCTACA | 41540 |
| 7915 CCTGTGGTTTAGCTTCTGTGTTCCAT | 19573 CCAGACTAAGATGTCAAGGAGACTTGGTT | 30557 TCTACTCTCCTGTGGTTTAGCTTCT | 41541 |
| 7916 GCAAACCAGAAACTAGAGAAAGGTATC | 19574 TGATTGCCACTTCCATGCCATT | 30558 GGACTGGAAGCAAACCAGAAACTA | 41542 |
| 7917 GTCATTGCTCTTCTGTAATCCTCAGTTTC | 19575 CCACGTTGTAGGCGTGTTATTC | 30559 TGCCAAGTCATTGCTCTTCTGT | 41543 |
| 7918 CCACCATCAGGGAGAAGGGATA | 19576 GCCCAAAACCTCTCTCTGCAGAA | 30560 TCAAAGCCTGGCCACCATCA | 41544 |
| 7919 CGTCCCTAAAACCATCTTCCTTCTTCA | 19577 TCAGGATTTTGTGAGTGTTCGGTTA | 30561 GTCCCGTCCCTAAAACCATCTT | 41545 |
| 7920 CCCTCTGCATGCGTGTCTATC | 19578 AGGCATGGAGCCTCTTCTTGA | 30562 TGCCCAACGATCCCTCTGCAT | 41546 |
| 7921 GCCAACAGTGTAGTGGACACAAGT | 19579 CCTTGTGTGAGATCCTTAGGCCAAAC | 30563 GAAGGCAGCCAACAGTGTAGT | 41547 |
| 7922 CTTTGCTAATCAACCCTCAGCAACT | 19580 GCCCTAGATAGTCACCCCTTATCTGTCT | 30564 CGGTTGCACTTTCCCTCCTT | 41548 |
| 7923 CCAGACTCCCTCCCAGCTAGA | 19581 CTGTCCTAGCTCCTGGTAAAAGTTC | 30565 ACCCTCCCTTCCCCAGACT | 41549 |
| 7924 CTCAGTCCTGAACAGGTCACCATT | 19582 TTTCCCTGAAATGATGGCACTACA | 30566 CCAGCCTCTCAGTCCTGAACA | 41550 |
| 7925 GACCACCACACTGATGTCAAGAGA | 19583 AAGGCTGGCTTCGGGTAGAGA | 30567 GCTTGTGACCACCACACTGA | 41551 |
| 7926 CCTAATGGACCTAACTCAAGAGTCATAG | 19584 GGTACTGCTACCGTGCTGTT | 30568 GCCCATGGAGTTACCTAATGGACCTA | 41552 |
| 7927 TCAGCCATGACAGAAGCAAATCTA | 19585 AGCACACTTGGCATGAAAAGAAAG | 30569 GAGCGGGTCACTTCACCTTTT | 41553 |

FIG. 36M2

| | | | |
|---|---|---|---|
| 7928 CCAGTGATAAGCAGCTGGGATTTG | 19586 GGAGCATTGCTTGAGGAGACA | 30570 CAGCTTCCTGCCCAGTGATAAG | 41554 |
| 7929 GGCTTGTATGTGGACTGCAAGGTT | 19587 GGAATGAAGAGGGCTTCTCACA | 30571 GCTCAGTAGCTGGGGCTTGTATG | 41555 |
| 7930 GTCTCCAGCTCAATGCAAAGGAT | 19588 GGGCAGCATGAATGACATTGTATCTCT | 30572 CAGCTAGATTTGTCTCCAGCTCAA | 41556 |
| 7931 GGTCAGAGAAGGGGAGTTGGAAAAC | 19589 GGATGCCATGGCTGCCAAAC | 30573 GCCTCCTGTTGGGTCAGAGAA | 41557 |
| 7932 TGGGCTCCAAGAGGCAACAA | 19590 GGAGGAGAAGCAGAGAGCATGAGA | 30574 CAAAAGAAACACTCTGGGCTCCAA | 41558 |
| 7933 CCCATTCTCAGTATAGGGTTTCCACTCA | 19591 CCTCCTTGCTGGCTGAATTGTGA | 30575 CTGCTGCTTTACCCATTCTCAGT | 41559 |
| 7934 CCCTTTGCATCAAATCTATCAGGAAGT | 19592 CCTGGAAACAGCTTGCTTGTGAAG | 30576 CCTGTCTTTTTAACCCTTTGCATCA | 41560 |
| 7935 CCCTCAAAACAATGGAGCTGGAA | 19593 TGCCTTTTATTCAGTCCTGAGGTT | 30577 CTGAGATGGTCACTGTCCCTCAA | 41561 |
| 7936 CATTCCTGCTGGTCTTGGTTAGT | 19594 GTAAAGCCCGGGTCCTAACATT | 30578 GCCTCACTTCCCTTTTCTTTCATTC | 41562 |
| 7937 GTTCTGGGCCACGACATAGAGA | 19595 CCTGTAAGATGTCTGAGTGGACAATG | 30579 GGAACGATGTCACCTCTCTGGTT | 41563 |
| 7938 GGCTGGTTGTCTTGAGGAAATGT | 19596 GGCCAGCAATCTGGCTTTCA | 30580 TTCCTTAAATTGGCTGGTTGTCTTG | 41564 |
| 7939 GGCCCTTGAGAAGGTGAAGGAT | 19597 ACCCACCTTCCTCTGTAACTATCT | 30581 TTCATTCAATCAGGCCCTTGAGAA | 41565 |
| 7940 GCATCAGTTTCCCTTTCTCTGGTTGA | 19598 AAAGCAGTTTCTTACCCTGTGAGAT | 30582 CAGCCAATGGGCATCAGTTTC | 41566 |
| 7941 GCCCTGTGGAAAGATTCTAACAGTTC | 19599 TGTGCAAAAGGGCTTGCTTATC | 30583 CAGAACTGCCCTGTGGAAAGA | 41567 |
| 7942 GCACCACACTTTCCCGAGTGTA | 19600 ATGTGGTCTCAAATAGCTCCAACA | 30584 TCCTACCGCACCACACTTTC | 41568 |
| 7943 CCCCACAACTACTCCCCTTTCT | 19601 GGCCACATGCAGGAACAAATG | 30585 CAGGTCTCACCCCACAACTACT | 41569 |
| 7944 GCCTTGACAAACTGAATTCCAGAGA | 19602 CCTCTTCATCTCCTGGCTCACA | 30586 GCAGAGGATTCTAAGCCTTGACAAACT | 41570 |
| 7945 GGCAGTAGCATCACCAGAGAAG | 19603 CTTGCTGGAGGGTCACTGTAG | 30587 TCTGGAGGGGCAGTAGCATCA | 41571 |
| 7946 TGCTTAGTGGTCATCTTTTCCTTGA | 19604 GAGAATGCATCTCCCTTGGAAATAGT | 30588 CGTAGCAGATGCTTAGTGGTCATC | 41572 |
| 7947 CCAAAGTCAGACCAGGGAAGTTCA | 19605 CCGTGTGGTTTACCATCCTTCAAC | 30589 CACATGGTCAAGTCCAAAGTCAGA | 41573 |
| 7948 GGCTACACAGAACCTATATAACCATCTTG | 19606 CACTAAAAGGTGTGACAGGAGTATAGA | 30590 CACTGTGGGCTACACAGAACCTA | 41574 |
| 7949 GTGAGGTCAAATCATGACAGGTGGAA | 19607 TCCCACCCACCATGAGAACTAC | 30591 GCTAGCTATGGGGTGAGGTCAA | 41575 |
| 7950 CGGTAGATCTGAACAACCAAAAGATGCAAA | 19608 GCAGCTACCTCTCCGTCTCA | 30592 CCCACTTAACTGAGTATCGGTAGATCTGAA | 41576 |
| 7951 CCTTGTTAGGCAAATGATGCAGTCTTC | 19609 GCTGTTCTTGTCTACACAGTTTTCTAC | 30593 GTGATGGGGCAGAGTTAATCCTTGT | 41577 |
| 7952 GGAGACTGAATGAGAATCAAGGTTGT | 19610 GCGGGGAAAAGAGAACCATTTG | 30594 GCTTGCCAAAGGTCATAATGGAGACT | 41578 |
| 7953 CTGACACTTGCCTCCTCCATGAAA | 19611 TGCTCTATTCAAAGTGTGACTGTCT | 30595 GCCAACTGGCAGCATCTGA | 41579 |
| 7954 ACCTGTCACGTAGGGCTGCTT | 19612 GCCCACCTCACTGGAGCAAAA | 30596 GGCAAAAGGGAAACCTGTCACGTA | 41580 |
| 7955 CGTGTGCTTTAGGCTCCTCTGAAA | 19613 CCAGACAGGCTGTTCAAAGAGGATAC | 30597 CGAACATGGCCGTGTGCTTTAG | 41581 |
| 7956 GAAGATGAGCTGAATAGCAGTCAAACA | 19614 ACCCTTGTCAGGGTACGGTCAA | 30598 GACCTTGCAAGAAGATGAGCTGAA | 41582 |
| 7957 CGCTCAGATTAGGTGATCAGAAGCATT | 19615 ATAAGAGCCGGCCCAGAACT | 30599 GACTTGAGATCAGCCGCTCAGAT | 41583 |
| 7958 CTGTGGCTGTACACAAGGACTCA | 19616 ACATGTGCGCTTCTGGAGTTC | 30600 AGGGAAAGGCTGTGGCTGTA | 41584 |
| 7959 GACCTTTATACGAAGTCCCTTCCCTTTG | 19617 GGACTGGACCTCAGTGTTGCTCTA | 30601 CCACCTAGTAGGCGTTGACCTT | 41585 |
| 7960 GTGTACTAAATCCCAACTCTCCTTACA | 19618 GCGAGAGGGGAATTGCTGAATG | 30602 CTCCACTTGTGTACTAAATCCCAACT | 41586 |
| 7961 GGTAGCGATTCTCAAATCACATGGAAAG | 19619 TTGGGAGGTGGGTCGGCTAA | 30603 CACTCTGTATGGTAGCGATTCTCAA | 41587 |
| 7962 GGTCAACTGAGCGGAGCAT | 19620 CCAGAGGACACCAACGATCAGA | 30604 TGGAGTCACCTGTGAGGTCAAC | 41588 |
| 7963 GTTCTCCCACCAAAAATTCCACTTC | 19621 TGTATATTTGTGCGCTCCACGTA | 30605 GCTCCTTTGTTCTCCCACCAA | 41589 |
| 7964 AGCAAGCCAATCCGGGAAGAAG | 19622 GCAATCAGGTGTTTCTCACTCTAAC | 30606 GTCAGCCACAGCAAGCCAAT | 41590 |
| 7965 CCAAGAGCATAACCACGAGGTCCTT | 19623 GCCGTGGGGTTGTCCAGCAA | 30607 CCCCATTGGTGCCAAGAGCATA | 41591 |
| 7966 GCAGTTCATGGCAGGATTTTGAAC | 19624 TCTCTCTAGACCAACCCACATTCT | 30608 TGCTTGGGAATTACAGCAGTTCA | 41592 |
| 7967 GCCATAGCTGGAGATTGGACTTAC | 19625 GGACTACTGTTTCTCTTCACCAACTA | 30609 GGTTAGGGTGTCCCAGCCATA | 41593 |
| 7968 GGTTGCTCGCAGAGAGATGGAA | 19626 CCCAGAGATAAGATCACGCCATCAA | 30610 GTCCCAGTTTGTGAGCAGGTT | 41594 |
| 7969 CCACCTGAACCGTCTGTTCCAT | 19627 TGGCCGTGGGGTTATATAAGTTTAG | 30611 CCCAAAGCATTTCATTACCACCTGAA | 41595 |
| 7970 CAGAGGAGAAATGTGTGGAACCCAAT | 19628 TCACCCCTTGCAGGACCCTTA | 30612 AAGGTGTTCAGAGGAGAAATGTGT | 41596 |
| 7971 GGGCTGTGAAAGGCTTCTCT | 19629 CACTCCTGTTTAGTCTCCAGGTTT | 30613 CCCATCCTTATGGGCTGTGAAA | 41597 |
| 7972 CCTTGACGGTTGAACGGGAGTT | 19630 CCTCCATTCTCTCTGACTGGGATGAAC | 30614 TGGATATAGGCCTTGACGGTTGA | 41598 |
| 7973 CTTGGTCCACATTTAAGGCACTTTTC | 19631 TGGGTCAAAGATTACCAAACACTGA | 30615 GAGAACCCTTATTTCTTGGTCCACAT | 41599 |
| 7974 GGCCCTGAACACACATGCTA | 19632 CTCCTTACTCACTTGTCTGACTGAAG | 30616 AAAGGAGGAAGGGCCCTGAAC | 41600 |
| 7975 CATCTACATGGCAGGGAAGTGT | 19633 GCTGAGGCATTTTGGGACAGA | 30617 ATGGGAGTGATCTCCCTCATCTACA | 41601 |
| 7976 GCATCTTAAGTGCCACAGGTTGT | 19634 GGTGACCCAGAGACCCAAGAAA | 30618 CAGGATGGCTCTGGGCATCTTA | 41602 |
| 7977 GGTGAGGATGCTACCCCAACTT | 19635 GACTGAGAGCAAGACAGGATAGATGATACT | 30619 CCTCAGATGGGTGAGGATGCTA | 41603 |
| 7978 CTGGCCACATTCCGGAAATATAAAC | 19636 GGGGCATTGCCTCCTTGAA | 30620 CCATTTGGTCCTGGCCACATTC | 41604 |
| 7979 GAGACTAGGTCTCCCTTACATTTGTT | 19637 CACAGAAAGGCATGGTCAGAAAAATC | 30621 TTCTTTGATCCGGGGAGAGACT | 41605 |
| 7980 GGCTAATTGGCTGGATCCCTCACT | 19638 GCCCCTGGTTTCATGACAGTGTTC | 30622 CCTGGATAACTATCGGTTGGCTAATTG | 41606 |
| 7981 GTGACCTGCTAAAGAAATACAGCCTACA | 19639 CGAAGTATCATTTTCCCCAGTAGTCA | 30623 GTTCAGGCATGTGACCTGCTA | 41607 |
| 7982 CAGATCGGCAGCCAACAGA | 19640 CTCTTCATCGCACCAGCAACT | 30624 GGTGGGAAACGGGTGCAGAT | 41608 |
| 7983 CTGTGGTTGTGAGAAGGGCTATAC | 19641 CATGCAGTAATCAGGAAACCATTTG | 30625 GGCTGGAGTCTGTGGTTGTGAGA | 41609 |
| 7984 GCAGACCTTTGGGCCTAGAGAA | 19642 AGCCTTTTGGGGTCCACTTTG | 30626 ACCACCCTCGCAGACCTTTG | 41610 |
| 7985 GGGATCCAAACTTACTCTTTTGCATGTGA | 19643 TCAGCAAATGGACTCAGACAACT | 30627 TGAGGTAGGGATCCAAACTTACTCT | 41611 |
| 7986 GGCAAAGGATGATATAGAGGAGTCCAA | 19644 CTAATCCCTCCAGCCTCTCCTT | 30628 GTGGCTGGCAAAGGATGATATAGA | 41612 |
| 7987 GCCTGGAATGAGGCTTGTGGAA | 19645 GGGGAGCTGCTTTGCATGAGT | 30629 GAGGCAGCAAAGCCTGGAAT | 41613 |
| 7988 CTCCTGTGGAGCCTCCTTTTCA | 19646 GGCAAACTTCTGGAGGGACAA | 30630 CAGCCATTCAATCACCCTGTTTC | 41614 |
| 7989 GCCAGTTGGGAGCCAGAACAA | 19647 TCCTGTTACAGTAGCCAAAAGCAT | 30631 TGGAATGGTGGTGCCAGTTG | 41615 |
| 7990 GGAGGGTTGCTGTTGCTCTGA | 19648 GAGCTACCAACCTTCTCCACCTT | 30632 TCCAGTTTCTGAGGCCAGAGT | 41616 |
| 7991 CACCCAGGGGTATAGAAGTGTTTCTTC | 19649 GAAATCAGCTCACCCATTGCTACT | 30633 ACCTTCACCCAGGGGTATAGAAG | 41617 |
| 7992 TCTTACTAGCAAAACAAGGGGTTCA | 19650 GAACTTAAGGAGTCGATGGTCGTT | 30634 CATCTCCGGATCTCCATTTTCTTACT | 41618 |

FIG. 36M3

| | | | |
|---|---|---|---|
| 7993 GCTGTATAAGCTCCACCTCCCAAT | 19651 GCCACAGACATCACTAATGAACACA | 30635 CCACAGTCCCAAAAGGGCTGTAT | 41619 |
| 7994 GCACCCTTAGCACAGGGTTCAA | 19652 GAGGAGCTTGCATAATGGGGAGTAG | 30636 CCATCGTGTCCTTGCACCCTTAG | 41620 |
| 7995 AGGCCCTATACGCCCCTGTTT | 19653 GGTCACTGTTAGGCAAGAAGCCATAC | 30637 CCTGTGCACTCAGGCCCTATAC | 41621 |
| 7996 GGAGGACATGACCCGAACCTT | 19654 CCTATACATGCAGCTTAACATGTGACT | 30638 CACACACAAGTGGAGGACATGA | 41622 |
| 7997 GGAAAAGCCTAACTAAGCTCTCGAT | 19655 GGTGGCATAGTTTTACTAGGTTCAACA | 30639 GAGGCTTAAGGGAAAAGCCTAACTA | 41623 |
| 7998 GACTGTGACTGGATCTGGATTTTAGACA | 19656 CACTCCCCTGTCCATGCTACTTT | 30640 GATGTTAGTGACTGTGACTGGATCT | 41624 |
| 7999 GAGAGCCTGTGATGAGGAAGACA | 19657 GGAGACCGTCCTGTGATACTGT | 30641 TCGAGGTTGAGAGCCTGTGATG | 41625 |
| 8000 TCAGCAGCTTCCCAGAGATAAAC | 19658 GGTCAGCAACAGGAGCTCAAGA | 30642 TGTGGGCCATCAGCAGCTT | 41626 |
| 8001 CTCCTTTGCTCGAAGTCGACAGT | 19659 TGAATGGAAACCCGTGCTGTA | 30643 GGTTCAGGAATCTCCTTTGCTCGAA | 41627 |
| 8002 GCAGGCTGTAGCTCATCCTATG | 19660 AATGCAGGAGACCTCACATTTTCT | 30644 CACATGATTCCCTGTTGCAGTTTG | 41628 |
| 8003 GTGAGTGACTCCATGTCCACAGA | 19661 GGTTTCTTCCAGCCTGCAATGT | 30645 CCTGTGGCCCAGTGAGTGA | 41629 |
| 8004 GCCACACACGTCCCTGATGAAA | 19662 AGGGCACTGACGGCTGCTT | 30646 TTGCACGGAGGCCACACA | 41630 |
| 8005 TCAACGCAAAGGGCACTAACT | 19663 AGCACTGCACACAAGACAAGT | 30647 CCATGGACTCTATTATCAACGCAAAG | 41631 |
| 8006 GGCAACCCAGTCACAGATAATCTTC | 19664 AAGTGAATTTCCTGGCACCTTTTC | 30648 GGCTTATAGGCAACCCAGTCACA | 41632 |
| 8007 CCAGTACCAAAGAAGCCGCTAT | 19665 CTTCCCATGTTTAGGATGGGTTGT | 30649 GGCTGGTCCAGTAGTTCCAGTA | 41633 |
| 8008 TGCAGCGATTTTGGGGAATGA | 19666 CCCCACAGGGTCAGCTTCT | 30650 GGTCCTGTGGATGCAGCGATTT | 41634 |
| 8009 TGAAACAGCCTCTGCTCCTTATC | 19667 GGAAGGGGCAGTGGTTCAGATG | 30651 AGGGCAAGGCCTCAACATGA | 41635 |
| 8010 CCAGCTGTTCTCTCAGCTCTTC | 19668 AGGTAAGTGACAGTTTGCTCTTTGA | 30652 GAGTGCATATCCAGCTGTTCTCT | 41636 |
| 8011 TGGGTTGGAAGGAGAAGATGTTAGA | 19669 CAGAGCCATTTCCTCAGCGTAA | 30653 GTGGGAACTGGATGGGTTGGAA | 41637 |
| 8012 CCGGGTGTTCACAGCTTTAGTTTC | 19670 TGCTCTGAGACAATGCAAAGTGA | 30654 TTCCGTGGTACCGGGTGTTCA | 41638 |
| 8013 GGCTCTGAGAGTCTTCCTTATGTGA | 19671 GGGCAGTGAGGAGGAGACTTATCT | 30655 AGGTACTTGGCTCTGAGAGTCTT | 41639 |
| 8014 CCCTCCAATGGCTTTCCATCA | 19672 GGCCTCACACAATGACAGGAACT | 30656 CACCTTCTTCCTAAATCCCTCCAATG | 41640 |
| 8015 AGAGAGCATGTGTGAGCTTGTT | 19673 CGCCCACAAGTCATGAAGCAAAC | 30657 CTGCCCACATAAAGAGAGCATGT | 41641 |
| 8016 GCTAGGAGAAAGCAGGTGGAAGA | 19674 GCCGGAAGACTCAGCAAGTCTAGT | 30658 AACCAGGTGCCAGTGCTGCTA | 41642 |
| 8017 GCCAAGGAACACACAGCAAGTT | 19675 GACTCCTTTCTGAAGGACTGTGAA | 30659 AGATGACTTGCCAAGGAACACA | 41643 |
| 8018 CCTCATTCTCACTGTTGGACGTTCT | 19676 CCAGGAGGCAAGCAGGTAGTTT | 30660 GCCCATGAAATTGCACCTCATTC | 41644 |
| 8019 CTCTGCCTACTTTCTTGTGGCAAA | 19677 CTCCCAGGCTCTGAGAATGACA | 30661 CGATGAGCCTCTGCCTACTTTC | 41645 |
| 8020 CCTCATACCTAGGTGCAGAGACA | 19678 GGGGTAGAATCCAGGCATTGGGAAT | 30662 CACCACACAGGTCCTCATACCTA | 41646 |
| 8021 GCTCTGTCAATACCCCTGCAA | 19679 ACGGTGTCTAAGAATGAGCTTGT | 30663 GCAGATGCTCAGGCTCTGTCAATA | 41647 |
| 8022 GTGCTGCATCAAGGAGTCTGAAG | 19680 GGGGCAGATTCCGTTCCATTCA | 30664 CCAGGGCTGAGTGCTGCAT | 41648 |
| 8023 AGCCTGAGTTCCAGCCTTTG | 19681 CCCTTCTCTACTCAGAATGGAACAGT | 30665 TGGGATCAGAAAGCCTGAGTTC | 41649 |
| 8024 CCCACCTCTCCAAATAAAGGAGATTC | 19682 CTAGGCATGGCATGGTAAACAAG | 30666 GCCCTTCCCACCTCTCCAAATA | 41650 |
| 8025 GGCCATCCTCTTCATTTCAGATCAGTT | 19683 GCAAACAGTAAGCAGCTTTGAGA | 30667 TCCTTGAGGCCATCCTCTTCAT | 41651 |
| 8026 CAGAGAGTCCTCGAATTTGGTGAA | 19684 CTTGAGATTTTCTCAGGCTCTTGAATC | 30668 GGGAATAATGGACAGAGTCCTCGAA | 41652 |
| 8027 GAAGCAACTGGAGCAGGCTTA | 19685 CTCCCTAAGTGTTTTTATGGGTCTCTGAA | 30669 CCTGTGGGGAGTAGAAGCAACT | 41653 |
| 8028 TGGCCAATGAGATAAAAGGAGTTGA | 19686 CTTGAAAGCTTTATGACCAGGCTTAG | 30670 GATTGGGTTCTGGCCAATGAGAT | 41654 |
| 8029 GAGAGGATGAGCAATAGTTAAAGAGACTGA | 19687 GGGACACTCACTGCCTTTGGTT | 30671 CGGTGTCTTGGAGAGAGGATGA | 41655 |
| 8030 CGATGAGACAAATACCGGCTGAA | 19688 ACCTGCTTCAGATCCTACAGGAAA | 30672 AGGTGCAGCCTTCGATGAGA | 41656 |
| 8031 CCAACTCTGAAAGGTGCTGTGGAA | 19689 TTGGGGCACCGAGGGATTTGT | 30673 GAAACAGGCATCATACCAACTCTGA | 41657 |
| 8032 CGTGTTGCTAGGTACTGGGATTCAT | 19690 TTGTAAACCGTGAGGGAGAGATG | 30674 GCCAGGCGTGTTGCTAGGTA | 41658 |
| 8033 GGAGCCTTTGATGGACTGGCATT | 19691 GTTCATGCTGATGCCCGTTTG | 30675 GCTGCTAACAAAATCAGGAGCCTTTG | 41659 |
| 8034 AGAGCTGGTGAGAGAGGAGTCA | 19692 AGGTGGAGGCCAGGACCAT | 30676 GGACATTTGGGGATGTGAGTGTTA | 41660 |
| 8035 CCACTCTCGGGTGAACCAGTACATA | 19693 TGGTAGGTACCAAATAGGAAAGTCTTG | 30677 ATCCTCCCACTCTCGGGTGAA | 41661 |
| 8036 GTGTTCCTTCTGGACCCTGAATTCTAA | 19694 GCCATGTGAAGTCAGTCCTGTGA | 30678 GCAACCCTGTGTGTTCCTTCT | 41662 |
| 8037 GAGTCCTACTTCTGCTAGGACATTG | 19695 TTCCACGGACTGCTCGGAGAT | 30679 GTATCTCCCGTGAAGAGTCCTACT | 41663 |
| 8038 ACCACAACCATCCCAGCCATTC | 19696 GGTCTCAGGCACCTAAACCTCTTC | 30680 TTGCTAGCCAACCACAACCAT | 41664 |
| 8039 CTGTTATCTGCTTCACACCTCCTTCT | 19697 TGCAGAGACTGGCACCTGTAAC | 30681 AACACCCTGTTATCTGCTTCACA | 41665 |
| 8040 CAGCAAGAGAAATAGCCCGATCCAT | 19698 GGTCTACATCTTGGTTGCCACTTC | 30682 GGAGGATTCTAGGTCAGCAGCAAGA | 41666 |
| 8041 CAGTTATAGAGGGACAAACTGCTCACA | 19699 CTGGATCACTGAAGTCAGGAGGAAA | 30683 ACACCTCTCAGTTATAGAGGGACAA | 41667 |
| 8042 GCAGTGGTTGGTTTCATCTTTCACT | 19700 CAGCTATATGCTGAGGGTTGACAGT | 30684 GGGGTTGCAGTGGTTGGTTTCA | 41668 |
| 8043 CTGGAGTTCCTTGGATTTCTACAGTGTT | 19701 GCAGCTATTTTCAAAGACCCCTTTTCAAG | 30685 TGAACTGCTTGTCTCTGGAGTTC | 41669 |
| 8044 CCTACACTCTGCCCTCCTTATCT | 19702 GAGGATCACATCAGACTGTGTTAGTT | 30686 CCAAGGGCTCCCTACCTACACT | 41670 |
| 8045 CAAGTAAGTCTGGTGTCAGCAGTAAC | 19703 GCCTTTGAGCTGCAGATTTCACA | 30687 GGCCAGAGTGACTCCTTTCAAGT | 41671 |
| 8046 CGTGTTGGTGCCATGTGCTT | 19704 TCATGACCCAGGCTCTCTCCTA | 30688 GACTTAGAGTTGGCACCGTGTTG | 41672 |
| 8047 CCACATTGCCAATAAAGGTCCCTGAA | 19705 GGCATTTGGTACCTCACGTGCTT | 30689 GGAGGGAGGACCACATTGCCAATAA | 41673 |
| 8048 GGAGACAGCAGGGTCTGAGGA | 19706 AGGGCTAGGAGTGGGTGTCATT | 30690 TGTTGGGGAGCCAGGAGACA | 41674 |
| 8049 CCCTGGCTCCAACCCTAAACT | 19707 GGTGTCACCCTCCTCCCAAGA | 30691 TGACTTCTCCCCTGGCTCCAA | 41675 |
| 8050 CCCTTGGTAATGCTTGCCCTAGA | 19708 TGAGAATACTACCCACAAGGGTCTT | 30692 GCCATCTGGCTCCCTTGGTAATG | 41676 |
| 8051 GTTAGCCAGACTGGAGGCTAAG | 19709 GTCTTGGGAAGACCCGATCATCT | 30693 CCCATTGTGCATTACCCAAAGTTAG | 41677 |
| 8052 GAATTACAGCCTGCTGTGCATTAAA | 19710 GAACTGGGAGCTCCTACAAATACAT | 30694 TGGCCCGTGAGGGTGAATTA | 41678 |
| 8053 GGGGAGGGAGTACTCACAGCAAT | 19711 AGGGATACCTGGGAGCTGTCATC | 30695 AAGGAGCAGGGGAGGGAGTA | 41679 |
| 8054 GCATTGGGTCTTTTACCAGTGACCAA | 19712 GCCAAGTCTGCATTCCACTGTGT | 30696 TGGCCGGCATTGGGTCTTTT | 41680 |
| 8055 CACTGCACACAATCAGGTTTATGCTT | 19713 CCTGTGTCTCGGTCTCACCTATCA | 30697 CGGGTATAAACACTGCACACAATC | 41681 |
| 8056 GGGAGCTGAGACTTGCCCTAATC | 19714 CCCACACTTCTAGATCCTGCTGTTG | 30698 ACTCCAGGGGAGCTGAGACTT | 41682 |
| 8057 GCTGGGTGAGAGGGGAAGAGA | 19715 GTCCCCTCCCCTAAGGAGTCA | 30699 AAGGCTGGAGCTGGGTGAGA | 41683 |

FIG. 36M4

| | | | |
|---|---|---|---|
| 8058 GCCCCAGGCTGTTATTCCAATG | 19716 GCACGCCAAGTTCTCGGATGT | 30700 TCACTCTGCCCCAGGCTGTT | 41684 |
| 8059 GTGTCCCTGCTACCCTGGATTTAC | 19717 CCATGGGATGGAGCCACTACAGAAA | 30701 AGAGTTCACAGTGTCCCTGCTA | 41685 |
| 8060 CATCCTTTCTCCTAGACTGGCAAAGA | 19718 GAGCCAGGGAGGTGGAAGAAAT | 30702 GGAACCCACCATCCTTTCTCCTAGA | 41686 |
| 8061 TGCATAAAGGGCGGCAGTAG | 19719 GAAGTGAACAGAGAGTTTCATGTCAGA | 30703 GACTCAGACCCTCTCCTGCATA | 41687 |
| 8062 CTGTGTTTGCATCCACTCCCTAA | 19720 GAGGGGAGGAGGCTTTTATTTTCTTG | 30704 AGCTTACCTTCCCATCTGTGTTTG | 41688 |
| 8063 GTTAAAGTGCCGTGAGCGATTAG | 19721 ACCGTTCCCCTTCTCCCTTGT | 30705 CACCTATGTCTGGGCTTAGTAGTTAAAG | 41689 |
| 8064 GGCAACACTGGTAGCACCGTAA | 19722 CCATAGGTAGGTGGGCAAACACA | 30706 GGAGAAACAATGGCAACACTGGTA | 41690 |
| 8065 AGTTGGGCAGATTGAAGTAACCTTAG | 19723 GCAGTGCTGTGGCTGTGAAG | 30707 GCTGCAGCTCTGGGAAGTT | 41691 |
| 8066 AGCTCGATTCCCTGTGCAGTTC | 19724 GGGCTTAGATGACGACATTGTTGGTT | 30708 CCATGTCTAATGACCAGCTCGATTC | 41692 |
| 8067 AGGGCCAATTTTGTTCCACTACT | 19725 CCAGAGCACTGGGTAAATGCTTAG | 30709 GGCAGCCTTCAGTTTAGGGCCAAT | 41693 |
| 8068 AGAAAGGCAAGCATTCCAAGCTA | 19726 TTGGGATGCCTCTCCTTGGTA | 30710 CACACTTCTGAAGAAAGGCAAGCAT | 41694 |
| 8069 AGCGTCGAACACACCACAGA | 19727 CCCTCCCATTAAGCAGAGGTGAACT | 30711 GGACACCCAGCGTCGAACA | 41695 |
| 8070 GGCATCCAGGGAGATGTGGGAAAT | 19728 TGCAGTCTCCAGTAGGCTGTGA | 30712 AACGCAGGCATCCAGGGAGAT | 41696 |
| 8071 CCCAGCCCAATCAGGCTAAACT | 19729 CAGTGCTGAACACACCTGAGA | 30713 CCGACTCCCAGCCCAATCA | 41697 |
| 8072 CCTACAGAACTACTGGCCAAGGAT | 19730 ATCATGCCCCTCCTCTATCACT | 30714 GGACAAACCTACACCTACAGAACTAC | 41698 |
| 8073 TTCTTAATGTGTCAGCAGAGAGTCA | 19731 GCCCCGGTAACGAGGTTTTCT | 30715 TGCATAGGATTGGGCTCTCTTTC | 41699 |
| 8074 GCACTGGAAAGCAGCTTGGTAGA | 19732 GGTCATACGTTAAGGACATGTTTCACT | 30716 GGGAATGCAAAATGATGCACTGGAA | 41700 |
| 8075 GTGTGGAGGGGTAAAGTAGGGATTCT | 19733 CTTCACATTTTCCCAGCTAGACTGAAT | 30717 CCCAGATATGTGTGGAGGGGTAAAG | 41701 |
| 8076 TCCCATTGTGTTTCTCAGGAAAGAT | 19734 GGTGCCTCCAAAAGCCTTGTA | 30718 CTGGCTCCAAATATATTGTCATTCCCATTG | 41702 |
| 8077 CGATAATCCAACCCAAAGCAGAAACT | 19735 GCCCACCTGATCACAACCAT | 30719 GCAGTTTTAGCGATAATCCAACCCAAA | 41703 |
| 8078 TGTAGTGCTCCTGGCTCAGA | 19736 GAGTTGTGTAGCTGACTAGACTTCA | 30720 GGGTGCACATTCTTCACAGGTTGTAG | 41704 |
| 8079 CCCTGAACCCCATCAAGCCAAT | 19737 GCACAATGCCATGTGGGAGGAA | 30721 GGGGTAGCATGCCCTGAAC | 41705 |
| 8080 GGCCTCATGGGAGTTCTTTTGGAT | 19738 AACCAAGCCTGAGTCCTCTCT | 30722 GCATCTATGGCCTCATGGGAGTT | 41706 |
| 8081 TGTGTGACATGTACAGGTGAAAGTT | 19739 AGGCAGACCACTAACTGGAGAA | 30723 GGCCTTGCTCTGTGTGACAT | 41707 |
| 8082 GCCAGATTTGGTTTACCTCTAATCATC | 19740 CTGGGGCTTACTACAGCTTGAAAAC | 30724 TCTCATCTGTGCCAGATTTGGTT | 41708 |
| 8083 AGCTCAGTCATCCCAGTTTCTCT | 19741 CATTGGACACACTCAGGTAGGTT | 30725 CTTGAAGCCCAGCTCAGTCATC | 41709 |
| 8084 GGGGCCCCATTAGGACACATTAC | 19742 AGTGTGGGCCTTCTGTATCACT | 30726 GGAGGGCAGTGGCTGAAGTTA | 41710 |
| 8085 GCCAGCCATTGCTCAGTTTTTC | 19743 GCCCCACTGAGGGAAATGTTTTG | 30727 GATATTTTGAGTCAGCCAGCCATTG | 41711 |
| 8086 GGTGGCTGTAATCCCATCTTCA | 19744 TGTGTTATGGACCTCTGTCATCTCTGA | 30728 CCAAGAGGCAGGTGGCTGTAAT | 41712 |
| 8087 CTGTGTGGGACAAAAAGCACTTG | 19745 GTGGTGTCCTGATTTTCCTATTGGGTTT | 30729 CATAGAACTGATCTGTGTGGGACAA | 41713 |
| 8088 GTGGCGTTGGGAAAAAGAAGTAG | 19746 GGCTGTCTCCAAAGCAAGGTGAAC | 30730 GCTGTAGTGGCGTTGGGAAA | 41714 |
| 8089 GAGGGAGAATGGCACACATCA | 19747 GGACAAGACCCACTGTGCAA | 30731 TTTGCTTTGGCTGAGGGAGAA | 41715 |
| 8090 GGAAGTGAGGAGGGAAGAACAGTCT | 19748 TTGCCCCTCTCCATGCTTTC | 30732 TGTGGACCAGGTGGAAGTGA | 41716 |
| 8091 CCTGTTGTTCCGCATCCATCTCT | 19749 GAGCACCAAGCCCCATTAGT | 30733 GGGTGCAAGCTTTCCTGTTG | 41717 |
| 8092 GTGCCTGCTGTTTGGTGAGTA | 19750 CCTGCTGTGACCAGGAAGTCA | 30734 CACTGTCTGAGTGCCTGCTGTT | 41718 |
| 8093 GACCTACTCTTGGGTGATGACAGTAA | 19751 CCTTTTCCTGTCTCTCAGGCCTATTC | 30735 CCAAGACATAAGGAAATGAAGACCTACTCT | 41719 |
| 8094 CCTACCTCCCAGGTTTGCTGTATG | 19752 AGCAGGCCCTTCTGGACTAT | 30736 TTGCCTCCTACCTCCCAGGTT | 41720 |
| 8095 CCTCTCCACTTTGTCCCCACTTC | 19753 GAGGGGAATGGTTTACCTTCGTCAA | 30737 CCCACACTCTCCTCTCCACTTTGT | 41721 |
| 8096 CACACCGACCTTGAACTCCTCTTC | 19754 CCTGGTGCAGGGAGACATTTAC | 30738 GAGAACTCCACACCGACCTTGA | 41722 |
| 8097 GGTCAGCCCACAGAGAGAGTTTAG | 19755 GGGCTGTGCACATTCCAGTA | 30739 CCCAAGGTCAGCCCACAGA | 41723 |
| 8098 GTCCAAGGAAGATAGTCTGGGTTGATG | 19756 ACACTAAATGGTCTCCCTGATCCTT | 30740 GCCTGACAAACTAGTCCAAGGAAGATA | 41724 |
| 8099 AGGCCTTTCCTGCCCCTCAA | 19757 GCAAGTAAGAATGGGTTTGAGTCAGT | 30741 CCAGAAGATGTGGGAGGCCTTT | 41725 |
| 8100 AGGCCAAGTTTAGCTGTGTGT | 19758 CCCACAGCAATATGTCAGAAACGATAA | 30742 GACCAGTGTTTAAAAGGCCAAGTT | 41726 |
| 8101 TCATCCAGTCCAACCTCTTCCTT | 19759 TGCTGAATCTTGCTAGGATTGACTT | 30743 CCAGAAGGGACCCCTGAAATCAT | 41727 |
| 8102 AGGCAGAGACAGAACCCAGAA | 19760 CACATGAAACACACACAGACTGATTC | 30744 AACCTGGCAGGCAGAGACA | 41728 |
| 8103 CCAAACCAGAGCACACTCAACT | 19761 GGTCTGGGGACAGCCAAGT | 30745 CACAAGTCAAGGTCTCACTTCCAAAC | 41729 |
| 8104 ACCTCTTCCCCTCATCCTTTATGT | 19762 GCACAGAGACATAGGACTTGGTGTT | 30746 CCTGGGGTCATCTTTACCTCTTC | 41730 |
| 8105 CTGTGTTATCTAGGATTGCACCTTCT | 19763 GATGCCCATCTGGACGTGAT | 30747 TCTGGCTAGCTGTGTTATCTAGGATT | 41731 |
| 8106 CGGCCACATTGTGAGTCTGT | 19764 GCCCTGCCTCAGAAAAGTCCATTC | 30748 AGCTCGAGACGGCCACATTG | 41732 |
| 8107 CAAATGTCTGGCCCTTGGATATGA | 19765 GCCAAATGCTTGAGGTTTGCTT | 30749 CGGCTGCCCTACAAATGTCT | 41733 |
| 8108 TGGGGTTTGGAGTCCATGTTAC | 19766 GCCGTTGCAGTGATTGTAATTCT | 30750 AACAAGTTCCTCAACTGGGGTTT | 41734 |
| 8109 GCAGGAAGCATGTAAAGAACAAGAAG | 19767 ACTAGGAGCCCTTCTCTTCCAA | 30751 GGAGGGAGCAGGAAGCATGTAA | 41735 |
| 8110 CCTGTGGAAGGTGGTTGTCAGA | 19768 CCACTAGCGTAGGACAGTCATTCT | 30752 AGCTGGGTGCACCTGTGGAA | 41736 |
| 8111 GAATTGTCAATCCCAGCAGTCAGA | 19769 CTCCTGTGGTGGTGATGCTT | 30753 CCTAGCCAGAGGGGAATTGTCA | 41737 |
| 8112 AATGGGTGGTGTTCTGGAAGATT | 19770 CCCCAAGTCTCGGTCTTTTATTTACA | 30754 ACATGTTTGAAATGGGTGGTGTTC | 41738 |
| 8113 GGGTGTGAAAGGGGCAGATTG | 19771 CCCAGAGAGAGTGAGAGTTACAGA | 30755 TGTGAGTAACTGAGAGGGGTCTGA | 41739 |
| 8114 GGGACACCAATCTGGGACAGAA | 19772 GCATGGGCTTCCCATCCACAT | 30756 GGTGACCATCTGGGACACCAATCT | 41740 |
| 8115 ACGCTGGTAGAGGTTCTTTCATTT | 19773 GGTATTTGCAAGTTCCCGAATCAA | 30757 ATTGGCCCACGCTGGTAGA | 41741 |
| 8116 GCAGAGAGTCAGGCAGGAGACA | 19774 CTGCCTCCCATAGGGCTAGT | 30758 CACTTTGGCCAGCAGAGAGTCA | 41742 |
| 8117 CCAGCATAGTGGTAGCCCTTCA | 19775 CACTTATGTCCCCTACCAAACCCATAC | 30759 AGTGGACCAGCCAGCATAGT | 41743 |
| 8118 CTCTCAAACACTTAGCTGGCAAAA | 19776 GGGTGGGAGCGCCTATTCTTG | 30760 GGACAACTCCTCTCTCAAACACTTAG | 41744 |
| 8119 GCTCCAAAGCCCTCCTTCATC | 19777 GCGTTCGAAGCACTCTACACACT | 30761 TCGTGCTCAGCGCTCCAA | 41745 |
| 8120 CCGTGCCTATCAGTTCTCCATTTG | 19778 CACTGAGTTCCACCAGTTCAAACA | 30762 TGGACCTCCGTGCCTATCAGTT | 41746 |
| 8121 TCCTACAGTCCTCCTCGCTCAAG | 19779 TCCAGCCCAACACCTCATCA | 30763 TGGTACCTCGGGGTCCTACAGT | 41747 |
| 8122 CTGACATGTGCTTTTAAGTCCCTGCTA | 19780 AGTGACAGCCCCATCACTGT | 30764 CAACCTCCCTGACATGTGCTT | 41748 |

FIG. 36M5

| | | | |
|---|---|---|---|
| 8123 GCCCTAACTGATCCCATGAGAGGTT | 19781 CCTGAGGGTACATTTCTCACAGATAC | 30765 GTAAATTAGCCTGTGCCCTAACTGA | 41749 |
| 8124 ACAGCCCCTGTAGCTAGTGAA | 19782 GCAGACATTTGGCATTAGAGGAAGT | 30766 ACATCTGCACAGCCCCTGTA | 41750 |
| 8125 CATTTCAGTCCTTGACGTACCAATC | 19783 CTTTCTGTGATTACTGTGGTGAGATG | 30767 CACACCTTCACATTTCAGTCCTTGA | 41751 |
| 8126 ATGGACCCTTCCGCTGACA | 19784 GCGTGTTCAGGAGCAAGACA | 30768 GTCATTTCTCCCACTACTCCCTATG | 41752 |
| 8127 TGCCCTTGTGCTCCCATTC | 19785 TGCTTTTGGTGTGTCCAGTGA | 30769 TGTGTCCCAGTGCCCTTGT | 41753 |
| 8128 CCATCCTCCAGTATATCCCTCCTGTATG | 19786 CAAAACTGCTCCTGGTGGAGAAC | 30770 GGTGGGACACCATCCTCCAGTATATC | 41754 |
| 8129 GGCTTCCCTGCTTCAGAGATAGA | 19787 CTGTACTGCCCAAGATGAGCTTTC | 30771 CTGTCTCTTGGCTTCCCTGCTT | 41755 |
| 8130 CTGACATAGGATCACTTCTGTAGCAT | 19788 GGTCCTGGGCTGATTTTCTGA | 30772 GCCTAAGCATGGAACTGACATAGGAT | 41756 |
| 8131 CAGAGCTGAATTTCCTGGCTAAGGAT | 19789 GGACAGGCAGAGACAAAGGAAAGAAG | 30773 TGGCTGACTTACAGAGCTGAATTT | 41757 |
| 8132 GCAAATGTATGCCTTGTTGGGCATTG | 19790 CTTTTGCACCCAGGACTCTGAA | 30774 CCTTATCTCTGCAAATGTATGCCTTGT | 41758 |
| 8133 GCCCAGACATATCCTCAGTCATTTG | 19791 TGGGTGGCTCAGACTGTCAA | 30775 CCCTCTTTTGCTACATGCCCAGACA | 41759 |
| 8134 GGGGCTTCTCAGCCATTCAA | 19792 TGCCACAGGGAGAAGGAAGT | 30776 GTTCTTGCCATGGGGCTTCT | 41760 |
| 8135 CTGTGCCTGACAAAGTAGTGACAGA | 19793 CGAAAGTAAATGCTAAGCCTTGCTA | 30777 GCAGCTGTGCCTGACAAAGT | 41761 |
| 8136 GAGGCAAGGAAAGACCGTATCA | 19794 CCCTCTTGCCACAGTGCCTTT | 30778 GCCCACCAAAGAGGCAAGGAAA | 41762 |
| 8137 AGGGGTGCAGTTAGTGCTATGA | 19795 GTGGAGTAGAGCCCTTCTGAATAAC | 30779 CCTACCTCAAAGGGGTGCAGTT | 41763 |
| 8138 GGCTGCTGTTACAAGACAGAGACAT | 19796 GAGAGGGAAGATTTGTGGGTGTT | 30780 GCACAAAGGCTGCTGTTACAAG | 41764 |
| 8139 CCAGGAAGCTGGCAAGAGTTTTT | 19797 GCCTGCAGGATTCAAACCCAAT | 30781 ACCTGTGCAGAGACCAGGAA | 41765 |
| 8140 CACTTCCTGCCACTTGCCTTAAA | 19798 GAGAGCAGGGAACATGGGTTCT | 30782 GACCCATCTAAAGGCAGTCACTT | 41766 |
| 8141 ACTCGCAGCTGCCGCTCA | 19799 GGAACTTAACCCCGCTCCCTTTC | 30783 ACCGGACTGAGCGGCTACT | 41767 |
| 8142 GGATCTGAGCCCATTTGACTATAAAAC | 19800 AAGTGCTACAACGGAAAGGAAGT | 30784 GCCACCTGCAATATAAGGATCTGA | 41768 |
| 8143 GCTAGGTTCAAGTGAGGATAACACT | 19801 GCTCCAAGAGACCCTGACTCACT | 30785 CCTCAGGCTAATGCTAGGTTCAAG | 41769 |
| 8144 GTCTCAGGAATAAAGCTACTGGTTCA | 19802 CTGGGCAGAGCACTGAAAGT | 30786 GTCATTGGAGCTGGTCTCAGGAA | 41770 |
| 8145 CCCCAGTGTCCCCATCTTGGTAA | 19803 GTCGAGGTTGATTTCGAGTCACTA | 30787 CAGCTGTTGTCCCCAGTGT | 41771 |
| 8146 CAAGAACAATGGGTGCTGAGTCT | 19804 GTGACAAGATGTCATTGCCAACCAA | 30788 GTGACCAGCCCTCAACAAGA | 41772 |
| 8147 GGCAGATTCACCATGTATGTTTTGT | 19805 ACAACCAGCCCTTGCATTAACT | 30789 CATAGGGGCAGATTCACCATGT | 41773 |
| 8148 GGAGCAGATCACCTAAATCTAAGGAA | 19806 GATTGAAGCCCAGCCTTGAATAAG | 30790 AAGGGTAGGAGCAGATCACCTAA | 41774 |
| 8149 TGGCTGACAGTTATTGTCCCATT | 19807 AGGGCCAAAGATGAAGAATGTAGTT | 30791 CCGAGACATTTGGCTGACAGT | 41775 |
| 8150 TCCTGAATTCCCAGGTCTTGCT | 19808 GCTTGGGTGGTGGTGGCAA | 30792 ACTTCTCCTGCCAAGGAAAACTTC | 41776 |
| 8151 GACTGGCATGTGTCTAGATATGTTGT | 19809 CAGAGTTGCAAGGTACCCATTCT | 30793 CCTTTTTGGACTGGCATGTGTCTA | 41777 |
| 8152 GGGAGCAAGAATAGAAGAAGGTGACT | 19810 CTGTCACCTGGCGTACAGAAAT | 30794 GGAGAAGAGACCATAGGGAGCAAGA | 41778 |
| 8153 GGTAAGTGTCCATCCAGCCATT | 19811 CCACTACCCCTTACTCCACTTGA | 30795 GGGTCAGCCTTGGTAAGTGTCCAT | 41779 |
| 8154 AGCCCTGCAAGACCTAGAGAT | 19812 CCCCACGGAACACTGCAT | 30796 CATGCTTATTGTAAAAGCCCTGCAA | 41780 |
| 8155 TCAGAGAGAGGGGAAGCCCAAA | 19813 TTCCCTGGGGCTCAGACTGTT | 30797 GGATGAGGGAAGGTGTTCAGAGA | 41781 |
| 8156 CTCTCCCTCTATATTAAACGGTGCAT | 19814 ACAGCTTCCCTGTAGGAAGTTATAAAG | 30798 TGGGGAATCACCTCTCCCTCTA | 41782 |
| 8157 GACAGAAGAAATCCAAGACCCAGAGATATT | 19815 GTGAAGACCAGGTATGGCTTTTCAAG | 30799 GGAGAACCAAGAGACAGAAGAAATCCAA | 41783 |
| 8158 GCACCCAACCACTTTTGTACTCTTG | 19816 CCCCATCAGGCAGGGAAAACA | 30800 CCATGGCACCCAACCACTTT | 41784 |
| 8159 GGGAGTAGCCTAGAAGTGATATAGAGA | 19817 CGGACTGGACTATAAGGGCAACA | 30801 CCTCAGGGAGTAGCCTAGAAGT | 41785 |
| 8160 GGCCATGCTGAGAATTGCAGGAA | 19818 GGAAGACACTGCTGCTTACTTAACTTGTTTG | 30802 CAAAATTAACTTGGCCATGCTGAGA | 41786 |
| 8161 GTTATGCACTCCTCAGCCAGTATC | 19819 TTTCTCCCTCCCCTATTACAAGGAT | 30803 GTGAATGCTTCCAGTGGAGTTATG | 41787 |
| 8162 CCTGAAGTAGAGCCTCCAGCAT | 19820 CCTGAGGGTGGAACCAAATATGTA | 30804 GAGAAGGTATTAGCAACACCTGAAGTAG | 41788 |
| 8163 CCATGGGGATACCTTCAACTGTAA | 19821 CTTATTGGTGCAAGCCATGTTTAGT | 30805 GAATACTGAATCCATGGGGATACCTT | 41789 |
| 8164 GGGGCAAGTTCTCAGCCTTGA | 19822 CCCTCAACAGCACCGAGTCTAT | 30806 TGGTGGCTGGGGCAAGTT | 41790 |
| 8165 ATGCCAGTCTAGCTCAGCTTTT | 19823 ACACACACAAGCCATCCAGAA | 30807 CCTTGAAATCCACATATGCCAGTCTA | 41791 |
| 8166 CCAAGATCTAAGCCACCACCAT | 19824 ACCGTTTGGGAGGCTATTTGAA | 30808 CCCTCTGTCTCTGACTGCTACCAA | 41792 |
| 8167 CCTCCCAAGTGGCATGAGGAAA | 19825 GCTAGGAATCACCAATTTTTGCCCTAA | 30809 AGGGTAGGCCCTCCCAAGT | 41793 |
| 8168 GCCAGAGACGTTACTGACTGGTT | 19826 TCTACTTGCTTGCCATGCACATAA | 30810 GCCTGAAGAAGCCAGAGACGTT | 41794 |
| 8169 CAGTCCTTTGTGTTCCATTGAAGGAT | 19827 CTTTATTCCATCCATCTTGCCCTAAAG | 30811 TGGGGTCCAGTCCTTTGTGT | 41795 |
| 8170 GGATGTGCACCTTGATGAGTAGAAA | 19828 CCCACCAACCCAAGAGTCTTCT | 30812 ACCCTACCCAACCTGGATGT | 41796 |
| 8171 GGCTCTGAAGCAGCTGGAAT | 19829 TGCCCAAAGTCACATAGGAATGAT | 30813 GTCTTTATGGGTGTGGCTCTGAA | 41797 |
| 8172 TGGCATGACTCAATCCTATGCTTT | 19830 ACGAGAGGGGAAGGGAGAAGA | 30814 CCTGATCTCTACATATTGGCATGACT | 41798 |
| 8173 GCTCCCTTGCTACTATAAAGTGATGTTC | 19831 CTGCTGTACAGGTCTGCGACAA | 30815 GAGGGTAATAGTAGCTCCCTTGCTA | 41799 |
| 8174 GCACAGAGACCCATGAGAGTTGAA | 19832 TGCTGATAGCTCAGAATCTGCATT | 30816 GGAAAGGTTACAAGACTTGCACAGA | 41800 |
| 8175 GGGTGTCGAAAGGATCCAGAGATTA | 19833 ACCACCAGGCTGGGGATCT | 30817 GAGAACTGGGTGTCGAAAGGAT | 41801 |
| 8176 GCCTCCAATATTTACGAACTTGCCTTGTA | 19834 AGGCTACAGGGGTCTGCAATG | 30818 GTCTGCAAAGCCTCCAATATTTACGAA | 41802 |
| 8177 GAAGGTACCAAACCCTGCTCAA | 19835 GCTAAATCACGGGGTCAAAC | 30819 GCAAGCAAGCAATTAAGAAGGTACCAAAC | 41803 |
| 8178 GTCAGACCCCTATTCCTCTGGACAA | 19836 TCAGAGATTCTGAGTAATCCCAGTTTG | 30820 CCCCTAGAAATTAGTCAGACCCCTATTC | 41804 |
| 8179 CCCAAGGACGTCAAGTGTTCTGT | 19837 GCTCCCCAGTGTTTTTGAGAGA | 30821 CCACATCCCAAGGACGTCAA | 41805 |
| 8180 GAGACCAAAAAGGTCAGCCATGT | 19838 CCTCAGTCTCCTGAGCCTTTGT | 30822 TGCCTGCCACTGAGACCAAA | 41806 |
| 8181 CGCTGAGACCCAGGGCTTCTA | 19839 GGAGTTGACTCCAATTGTCCTACA | 30823 CCAGGCCATTACCGCTGAGA | 41807 |
| 8182 GCCACCGGGCTAATTTCCATGT | 19840 GCTGGATCACTAACCACCACTCCTT | 30824 TTCCATGCCACCGGGCTAA | 41808 |
| 8183 GCACCAAGTGCATGACAAATGTA | 19841 GACTGCAGTGTCAGAATTTCATAACCCAAA | 30825 CACAGGTATGTTTGAAAGCACCAAGT | 41809 |
| 8184 TGGATGCTTCACCTGTCTTAGTCT | 19842 CAGATTGAATGGAGGTTGCTCTGT | 30826 ATTTGAGATGGGTGGATGCTTCA | 41810 |
| 8185 GTCACAAGTCCTGACCAGTTACA | 19843 GGTTTTCCCCTGGATAGGGAGTCTA | 30827 AAGAGAAAGTCGCTAGTCACAAGT | 41811 |
| 8186 GAGCAGTGGTCCTTTATCATCATCT | 19844 AGGTGGCAGGACGCACTTAG | 30828 GTCCTGCACAGCTGTTCTCT | 41812 |
| 8187 GCTCAACAGGAGGATCAGAGCAT | 19845 CTGTTGCGTACAAGGGAGCTCTA | 30829 GCCATCTAACTCCCTAGCTCAAC | 41813 |

FIG. 36M6

| | | | |
|---|---|---|---|
| 8188 GGGAGATACACAACACTGCTCAGA | 19846 GAATAACCAACGGAGTGGTTTTCAT | 30830 GCCACGTGTATACCAAAGGGAGATA | 41814 |
| 8189 GAGTGGTGGTAGGACAGAGACA | 19847 GCTCCATAAGGGCAGGGACAAA | 30831 CAAGTCAAGGTTTTGAGTGGTGGTA | 41815 |
| 8190 AGAGGCAAGATGGTGGGATGA | 19848 GGGCCAGAATCCAGTCTTCTGACTT | 30832 AGATGCCTAAGCTAGAGGCAAGA | 41816 |
| 8191 GGGTAAGACATTCCCCACTAAATCCATA | 19849 GCACCTTCCCAGTCCACCTGTAT | 30833 CCACCCTGAGAAGGTTGGGTAAGA | 41817 |
| 8192 GGATTGGCATTGTTTGCCTGTATG | 19850 CACCCAGCTTTGGCTCTTATCA | 30834 CATGGTACTGGATTGGCATTGTTT | 41818 |
| 8193 GGGTTTTTGTGAGCCTGATAGGAA | 19851 CAACAAGCTGCAGTCAACTCAA | 30835 GACAAACAGTGGGGTTTTTGTGA | 41819 |
| 8194 CACTCAAAAACATGCTGCTTTCTCT | 19852 AATGCACATGGAGTCTGGGAAA | 30836 CCACTAGGGACAAAACTTCACTCA | 41820 |
| 8195 CACTAGGCACCATACTCACATACTT | 19853 GGAAAGCCCTTGTGCACATACA | 30837 CCCATGCTTTTCACTAGGCACCATA | 41821 |
| 8196 GCTAACCCCAGCCCTCACTTC | 19854 GGGGTTTGCAGCAGGGAGTTTA | 30838 GACTGAGTAAACATTCGGGGCTAA | 41822 |
| 8197 CGAGGCCATTGTAGAACAAGAAATC | 19855 GCTAACCCAGACCTATGAGGAAAC | 30839 GACATGAGCGAGGCCATTGT | 41823 |
| 8198 GCATGCCCTCCTTCATGGTCTA | 19856 CTGAAAGCAAGGAGGCTTCCAA | 30840 GCTAGGCTCAGGGCTGCAT | 41824 |
| 8199 ACCCAGCATGCAAAGTCAGT | 19857 GCCAGGTTGCATCTCTGTGT | 30841 ACTGGAGCACAACCCAGCAT | 41825 |
| 8200 CCGGGGCAAAACTTGGTAAAC | 19858 AGGGAAGTAAGCATCCAGAACTTTG | 30842 TGTTTGTAAAACCGGGCAAAAC | 41826 |
| 8201 TCAGCATTGCTTCACCTGTGT | 19859 GGTTTTCCGCCTAGGAAAAGAGAT | 30843 GCCTCTCTCCAAGGAATCAGCATTG | 41827 |
| 8202 CCCATGGCCTAAAGGATTAAGAGAGTTTC | 19860 CCTCTTTTCTCTACACTGGAGTTTTCA | 30844 CAGCCCATGGCCTAAAGGATT | 41828 |
| 8203 CAAGAGCTCCACTTACGTCAAAG | 19861 CAGCATGGACAGATCATTAAGGGAGAA | 30845 GCTCCATTCAGTCAAGAGCTCCACTT | 41829 |
| 8204 GTCCAGTTTTCCAGGTCCAAGACA | 19862 GCTTCACCCCTGGTGGCTATTA | 30846 GAGTCGCACACATGTCCAGTT | 41830 |
| 8205 CCCTCCACCTTAAATGCTCTTTCCTGTA | 19863 GTGAATGTTGGGTAGGCGTTCA | 30847 GGTGCTCCCTCCACCTTAAATG | 41831 |
| 8206 TTTGGGGTTGGTTTCCTGTACTT | 19864 TGGTCTGGGCAAAGATTTCTTGA | 30848 TTGTGCATTTTGGGGTTGGTTT | 41832 |
| 8207 TGCAGCACCACATCAATAATGT | 19865 GGGCCACACATTTCCTCATTTG | 30849 GTGGAAATGCAGCACCACT | 41833 |
| 8208 AGGTCAGTTATTGGTTGTCAAGAA | 19866 GCTTGAGTTTACACTCCTTTTCTCTTC | 30850 GGCCTCCATCTATAGGTCAGTTACTTG | 41834 |
| 8209 AGTGGGAGAACTGAAGACCTCAT | 19867 GCACATCCTGCCCTTTGCTGAA | 30851 GTGGCTGAAAGTGGGAGAACTGA | 41835 |
| 8210 TTCAGAGGTGTTAGGTTCAGCAAA | 19868 GTCCTACAGGTGGGCTCGAA | 30852 GAGAGCCCAAATTCAGAGGTGTTAG | 41836 |
| 8211 CCGCGAAGAGCCCCTGAAA | 19869 GTTCTGTGGGTGCAGCAGATTC | 30853 AAGTCCAAGGGTCCGCGAAGA | 41837 |
| 8212 GCAGTGGGGTTTGTTCATGGTA | 19870 TGAAAGGAACCACTGTGAGCAAATA | 30854 TCCCTTACTGCAGTGGGGTTTG | 41838 |
| 8213 GCTTGGTTTTTGGAACCATTCTTGA | 19871 CAAAAGCAGCACCAGAGGTGATA | 30855 GTCCTCGAGCTAAGCTTGGTTTTTG | 41839 |
| 8214 GTGCTTTGCATACAGTAGGTCATCA | 19872 GCCCCAAACTTCCTCTCAGTCA | 30856 TCGGAGGAGTGCTTTGCATAC | 41840 |
| 8215 GGCGGGGTACCAAGTAAAGTTGT | 19873 CACCTGAGCAGGATGTATTCCTT | 30857 AGTTACAGGCGGGGTACCAA | 41841 |
| 8216 CGGGTCAACATTTACACTGACTCCAA | 19874 GAGAACAGAATGCGTGTGTGCAAT | 30858 AGGGACAGGCGGGTCAACATT | 41842 |
| 8217 GACTGTGTTTGAGAGGGGCTTCTA | 19875 GGAGAAGGTGTGTAGGAGATGCTT | 30859 GCAACGAAATGACTGTGTTTGAGA | 41843 |
| 8218 ACCCTTAAGAGGCATTTGTGTCA | 19876 CAAAGAGACTGCATTCATACCCTCATC | 30860 GTGTTGGGAGGTGGTACCCTTA | 41844 |
| 8219 GACTCCTAGTTGCTGAAGTCTCTGTAG | 19877 GGAGGCCTGACGTAGAAGAAGTT | 30861 GCCATTTATGACTCCTAGTTGCTGAAG | 41845 |
| 8220 GGAATGGTCCTATAACCTAAGGTGTTTACT | 19878 CTGGCTCTGTCCTTTTTGTGTAAGGAT | 30862 GGCTTCAGGAATGGTCCTATAACCTA | 41846 |
| 8221 CAAGGGGAGAGACATTATTGGCATT | 19879 GTCCAAGGCAGTTCTACAGGATGAA | 30863 GTGTTTCTCAAGGGGAGAGACATT | 41847 |
| 8222 GGAGAAGCCAAAATAAGGGTGTTGTTG | 19880 CTTGTTATGCAGCGTTCAGGTTCA | 30864 CCGTGCCAAACAAAGGGAGAAG | 41848 |
| 8223 ACGTTGCCCCAGACCCTATCA | 19881 ACACCTCCCTCAACTTAGATACCAA | 30865 TCCCAGAACTCAGTCCCACGTT | 41849 |
| 8224 CTCTCAGCGCAAGAACCTAGAAG | 19882 GCAGGCAGTAGGAATGGTCTATCTCA | 30866 AGGTGGCTGCTGAACTCTCA | 41850 |
| 8225 CAGAGAAGCTAATGTGGCAGTGA | 19883 AGAGGGCCTAAAAAGCAAGAACT | 30867 GAGGTTTGTGCAGAGAAGCTAATG | 41851 |
| 8226 TGGAGTCAGGCCTAGGGTTTAG | 19884 ACATCTGGCCCGGGAATTTTT | 30868 TGTTTAAGGGGTGAGATGGAGTCA | 41852 |
| 8227 TCCACTCTTTGAGGCTGTGAGA | 19885 AATTGCAGTTCATGGAGGTTGTATG | 30869 TGACCAATCAGTTCCACTCTTTGA | 41853 |
| 8228 GCAACCATTTTCATGCCCCTTTAGTATCA | 19886 GGTGACCTACAGCTGTGTTGTT | 30870 CCACCCGGCAACCATTTTCA | 41854 |
| 8229 TGGGGAAAGGGAAGAGGACAT | 19887 CTCTGTCCCTCTCTACACCTGAA | 30871 GATGTGGGCTTGATTGGGGAAA | 41855 |
| 8230 CAGGAAGAAATAGGGCTACTGTCAA | 19888 GATGTCACAGTAGATTACTTGGGTTCT | 30872 GCACTTGACCCTGGTTATCAGGAA | 41856 |
| 8231 GCAACTTTTTGCCTTGGTGTTGTT | 19889 GTTGGTACCCTCCTAGACAAAGACA | 30873 TGGTGGATGACGGAGCAACT | 41857 |
| 8232 AGAGCCAGGTACATGCCAGCTA | 19890 GTGTGTTCTCCTGTTGCAGTTG | 30874 TGGCCAGAGCCAGGTACA | 41858 |
| 8233 GGGTTTAGGAATGGCAGGTCATTTG | 19891 GCTTTCTAACCCAGGCACTAATTCATC | 30875 AGGCCTGGAGGGGTTTAGGAAT | 41859 |
| 8234 TCCTACACCTGCCTCTCCAATC | 19892 GCCACACGTGGGAACATGGTAAC | 30876 GCTCTTGACTTCCCCTTCCTACA | 41860 |
| 8235 ACTCTGGCTGCTGGAATAAACAAT | 19893 GAGCAGTGACTGAAGGTTCTGA | 30877 ACAGTCACACAGGCCACTCT | 41861 |
| 8236 GTGGCTGTTGTCAGACTTTGATTC | 19894 GGAGACTTAGGAAGCCTACGGATAG | 30878 AGCTAACTCATGTGGCTGTTGT | 41862 |
| 8237 GGCCTGCTTCAAAGTCCCAGAA | 19895 CTTCTTTTCTTACCGGAGTATGGACTCT | 30879 CTGGTAGGAAGGCCTGCTTCAAA | 41863 |
| 8238 CTCTCAGCTAGCAGACCCACAT | 19896 GCATGGGCCACAATTCTTCTTTC | 30880 GCTGTTGTTCAATGGCTCTCAGCTA | 41864 |
| 8239 CAGTTTGGTGAATGGAAGGTTCTGA | 19897 GGACACTGTTTGTCCCTCTCTATCT | 30881 CGGCACTTGCAGTTTGGTGAATG | 41865 |
| 8240 AGCTGCCATTTCCCCACAAT | 19898 GCAAGTCATCCAGCTTCTGCTT | 30882 CTCTAGGTTGTCTTATAGCTGCCATT | 41866 |
| 8241 GCCCCAGGTCTTTTCAGGCATTTAG | 19899 ACCTTTGCCCCAGCCTGACA | 30883 GCTCTGCCCCAGGTCTTTTCA | 41867 |
| 8242 GCCCTTTAGAAAGCTTGAAGTCCTTAG | 19900 GCCTTTTGGAGGGTAGGTAATCAAAG | 30884 GCTTCTGCCCTTTAGAAAGCTTGA | 41868 |
| 8243 AGGCCAGCCCCTGGAGAACT | 19901 GGGAGTTCCTTGGGGACAAACT | 30885 CCTGCCCACTGCAAGTCA | 41869 |
| 8244 CACGGCAGTCTTCAATGAGTCAGA | 19902 GCATGGGGCAAAGGGTTTGT | 30886 GTTAAACACACGGCAGTCTTCAA | 41870 |
| 8245 GGGTGGGTGCTTGGTTAACAT | 19903 TTTCAGCCGCTTTGGGTTTG | 30887 TGTACGATGGGTGGGTGCTT | 41871 |
| 8246 GCAACCTTGGTTCATATCCATTCGTT | 19904 GCCATTGTGTAGGCACTCCGTAA | 30888 GCCAGTGTAACAGATGCAACCTT | 41872 |
| 8247 GGAAGTTTCTTAAAGGTAGGAACCCATA | 19905 GTTCAGTCCTGTGCTGGGTCTT | 30889 CTGTTGCCAGTGATACTGGAAGTT | 41873 |
| 8248 GGGGAATTTGTCTTGCACCTTAGATGT | 19906 ACTTGCTGCTCTGCCCTACT | 30890 GCAGAGGCAAGAGTAAAGGGAAT | 41874 |
| 8249 GGATGCAAGCCACTTTAGCACTCA | 19907 GCATCTCTGAGTCCCAGTAACCTT | 30891 GCTTCCTGGATGCAAGCCACTT | 41875 |
| 8250 GTGAAGGATTAAAACAGCCCAACTGT | 19908 CCTGCTACAATTACCTCAATGTCGT | 30892 GGAATGAAGCTTCTGTGTGAAGGAT | 41876 |
| 8251 GAGAAGGGAACTGGAAGGCGAAT | 19909 GGATCAGGGTAGTTGGACTCTTTTC | 30893 CGTGTTAGCAGAGAAAGGGAACT | 41877 |
| 8252 CAGTATGGATCATGCTTCTCTTGTCA | 19910 GCCCTTTGTGCTATAAATAAGGGAATC | 30894 CCCACGACCAATAACAGTATGGATCA | 41878 |

FIG. 36M7

| | | | |
|---|---|---|---|
| 8253 TCACAGCAACAAGCCATGTGA | 19911 GTGATTGCATGAACACCCTGATGTAT | 30895 GGTGTGGTAGGTATCACAGCAACA | 41879 |
| 8254 CTGTTGTTCCAAACCTCCCTTTC | 19912 TTCAAGGATCACTGAGGACTGAAG | 30896 TCCCTCAAGTTTGACATCTGTTGTT | 41880 |
| 8255 CTGCCCATCTCCTTCTGTCTTC | 19913 GAGCATACCCAGGTCATGTGTCA | 30897 TGATCTGCCTCTGCCCATCT | 41881 |
| 8256 CTGCTGAAGTCCTCCTCTGTCT | 19914 GTCAAAACCCTAGGGCAGATGTTG | 30898 GAGCCATCTGCTGCTGAAGT | 41882 |
| 8257 CCACCAACTACTGCAGTCTGAAC | 19915 TCCAGTGCCAAAGTACAGGTAGA | 30899 CTGCTGCACCACCAACTACT | 41883 |
| 8258 GTCCCCAGTGTGTTTCCTAGACT | 19916 GGGATTAACATACGTAAGGTTGCTTCT | 30900 ACAAGGTGTCCCCAGTGTGT | 41884 |
| 8259 GTTTGACTGTCTGGCGTTCTTTCT | 19917 CCTCTTCTCTTTCCTGCTCTATCAAA | 30901 ACCCGGATCAGTTTGACTGTCT | 41885 |
| 8260 GCAATGGCCTCCACCATACGAT | 19918 CAGGCTGTTGGGTTTTGGAAGATTG | 30902 ACTCTGGGCACATGGAGCAA | 41886 |
| 8261 GCCAGGGCATTTGCACTTTG | 19919 CCGGGTTCCATTGGGTACAGA | 30903 CATTCTGGAGCCAGGGCATT | 41887 |
| 8262 GCACCATTTGGTTTCTGCTCATTTAG | 19920 CCGAGAGCAAGAAGCAAACATC | 30904 GCTGCCAAAAGCACCATTTGGTTTC | 41888 |
| 8263 GGAAGTGAAGGAGGCTTCTCCTGAT | 19921 CTGTTTCCAGATGGTATGGCTGTT | 30905 GGGGTGGTGGTTAGGAAGTGAA | 41889 |
| 8264 GCCCAGGGAAATCTCCACTTATC | 19922 CCCTGGTAAAAACCTGAGTCACTAC | 30906 AGTCCAAGCCACGGGAAATCT | 41890 |
| 8265 CCAAGATAAGAAGTACAGGCCAATTTCGTT | 19923 GGAACCAGAAAGAGGGCCTATC | 30907 GGTCTCCAGATAAGTCCAAGATAAGAAGTA | 41891 |
| 8266 GTTACTGACTCACTGTAGGCACAA | 19924 CCAAACCACAAATCAATGGGGTAGTA | 30908 CATCTCCACCCTTGTTGTTACTGA | 41892 |
| 8267 ACATAAGTCACGCTGGACAAAGAA | 19925 GGGGTAACTTTAGGAAAAGGCTGTCTAC | 30909 GCCTTCTTTCTGGGTACATAAGTCA | 41893 |
| 8268 CACAAGATGTGTGTTCTTAGCCATTAC | 19926 CCCATCATTTAGTGATTCCCAGTTTTG | 30910 AGTGGAGCATGGATTTTCACACA | 41894 |
| 8269 GGGCACTGATGCTATCTCTGGAAA | 19927 GCACAGCAGTTTCGATGATCCCAAT | 30911 TGCAGTGGGCACTGATGCTA | 41895 |
| 8270 GTCAGGATCACCTCCAGACTGTACT | 19928 CTGGGGTTTTGTTCTGCCAGAGT | 30912 GGCAGTCCACATGTCAGGATCA | 41896 |
| 8271 GCTGACTCTGTGGAAGTGTGGTT | 19929 CCAAGTTACCTTCTGCTAAAGCCATACA | 30913 GCCCAGACAAGCTGACTCTGT | 41897 |
| 8272 GTGATGGTGTTTTCTGGAGAGGATTG | 19930 TCAAATACACCTACCCACAGATG | 30914 GGGTCAGGTGATGGTGTTTTCT | 41898 |
| 8273 GCTCACCTCTCTTGGTAGTTTCACT | 19931 GCATTCCTGGCAAGAGGAATAGT | 30915 TGAAACCAAGCTCACCTCTCTTG | 41899 |
| 8274 AGAGCCCTTTGGAATTTCAGCTT | 19932 TGCCCAAGGTGGGGAGTCTAA | 30916 GACTGAACGGTAGAGCCCTTTG | 41900 |
| 8275 GGTGGCTCTTTTAGCCGACTTTAG | 19933 CTCTCCTCCTCGGAAAACATTTCGAT | 30917 CCAAAACCAATCTGGTGGCTCTTT | 41901 |
| 8276 GGCCAAGGTTAGTAATTCATGGAGAGA | 19934 GGAAGTCTGGAAAGCAAAGCATCA | 30918 TGTGCCTGGCCAAGGTTAGT | 41902 |
| 8277 TCTCAGGAAGAAAGGGTAGACTGT | 19935 GGCTGGCTTTGTGAGTCCTTGT | 30919 CTGTCAGCTCAAATCTCAGGAAGA | 41903 |
| 8278 ACGGAGGACAGGTCTCTGCTA | 19936 GCTGCCTGCAGTACCAAGTCT | 30920 TGGGAGGTAGAACCTGCAACA | 41904 |
| 8279 TGACTACTTTGGGAATGGGGACTA | 19937 GACTTGGAATCTCTAACACTCTCATTCAAG | 30921 CTGGCTCCCCATTGACTACTTTG | 41905 |
| 8280 GCAGGCTTCATGCTAGTGAAGAAA | 19938 CAGTGGTGGACAAGGGAGAAAC | 30922 GGCAAGCAGGCTTCATGCTA | 41906 |
| 8281 CCCACTAGCCACTGAATGTGAATC | 19939 CCTGAAGAATATAGAGCCACCTAACCTA | 30923 TGGATTTCCCACTAGCCACTGA | 41907 |
| 8282 CAGCTGGTTTTGACCAGTTTTGTCT | 19940 TCTAAACCCCTTGTGGCTAGTAGA | 30924 GAGTCATGTGTCAGCTGGTTTTG | 41908 |
| 8283 CACAATAGGGCAATCGAAGGGAAAC | 19941 ATCCCACGCCCTCCCCATTTT | 30925 CCTGCTGCACAATAGGGCAATC | 41909 |
| 8284 TGATCCTTTAGTCTGGGGCTCACA | 19942 GGCTGTGAGTTCAGTTTAGATGGTTTCT | 30926 CCCCAGGTTGCTTCTGATCCTT | 41910 |
| 8285 GCTCCAGTTCCACTTTGCGTTT | 19943 GGGATGGAATCTTGGGTGAGTGTTG | 30927 TCTGTGACGTGCTCCAGTTC | 41911 |
| 8286 GCCACCTATGCCCCAAAGT | 19944 CACCATGGAGTGTTCAGAGACAT | 30928 CCTGCCCTGATGCCACCTATG | 41912 |
| 8287 GGCAGGGCAGATAGTTCCACTAA | 19945 ACCCCATTGACCAAAGAATGTGT | 30929 AAGCCAGGCAGGGCAGATA | 41913 |
| 8288 GGCAAATTCCTGAATATCTTGCCTTCAGT | 19946 GCACACATCCCTTGTTTTGCACAT | 30930 CTGACACTGGCAAATTCCTGAATATCT | 41914 |
| 8289 CAAGCAGTGACCAGGAGACCTT | 19947 CCTCTCTGGCTCCCATGTTCT | 30931 TCCAGCAGGCAACAGTGA | 41915 |
| 8290 TGGTTGAAGCACTGTCACTGTAA | 19948 CTGAGATGCCGTCTTGGTCTAAAA | 30932 AGAGGAAAAATGAGGACTGGTTGAA | 41916 |
| 8291 GAAGCTGGATATTTCCTGGGACTCT | 19949 AGTCAGGGCTACTCATACAGAAAAG | 30933 GGCATTGTGTGAAGCTGGATATTT | 41917 |
| 8292 GCTCTCTCACTGATCCTTTCTGGACTAA | 19950 GTGTAGTAACCCAGCATCAGAGTTCTT | 30934 CTATAACTGCTCTCTCACTGATCCTTT | 41918 |
| 8293 CACAAGCTATGAACACATCAGACTACA | 19951 CCTTCAAAGGTCACCGCCTAA | 30935 GAGCCTAATAGTCACAAGCTATGAACACA | 41919 |
| 8294 GTGTGCATCACTTCTGCTCACAT | 19952 CCAACTAGATATGGCCATGTAACTCCATTC | 30936 TTGGACTTTGTGTGCATCACTTC | 41920 |
| 8295 GAGTTTTCCCCTCCAATGTGACT | 19953 CTGGTGAGTCTAATCACTTGGGACAT | 30937 CACCCACAGCCTCTTTATGAGT | 41921 |
| 8296 TGGACTGCTTCTGTCTCTGTTCTA | 19954 TGAGTTATCAGCCTGAGTCTACTTGA | 30938 GTTCAGTCATTGGACTGCTTCTGT | 41922 |
| 8297 TGCTTGGAGTACCACATGAAACA | 19955 CTTTCAGGCTGCACTGGATGT | 30939 CACTAGATAGTGGCTGCTTGGAGTA | 41923 |
| 8298 GCTTGCCTTTTCAAGAGCTCACCTT | 19956 CAGCTTTCGCGAAGTACTAGGTAT | 30940 GGTGAGGCCTTGCCTTTTCA | 41924 |
| 8299 GCCACCACTTTAATCACCTTGCCTAA | 19957 GGTCTGTCTTTCAGCTCTGATCAAT | 30941 CTTCTATGTTCGCCACCACTTTAATC | 41925 |
| 8300 ACACCTGGTTGAAACCAAGACA | 19958 GACCGATCCATTAAGAAGATGCTGTA | 30942 CCTCCTGTCCAAAAGGATGTCAAAC | 41926 |
| 8301 CCTGTGCTTGAGGAGCCAAGAA | 19959 CTCCTTGGAAGGCATTTCTGAGTGT | 30943 TGTCAGTGGCCTGTGCTTGA | 41927 |
| 8302 GTTGCATCCTCTGCTTTACTTTGAAC | 19960 CCCCTCCAGCCAGAGACAGA | 30944 GGCTTGCCACATTTGTTGCAT | 41928 |
| 8303 CCCAGTTTCCTTCTCTCAGGAATCA | 19961 TGACCTGTGTGGAGGCATCTCT | 30945 TCCTCTTTCCCAGTTTCCTTCTCT | 41929 |
| 8304 GTGAATTGGCCTCAGAACATTACAGA | 19962 GCAGTGAGGGTTGGTAAATAGTGTTCA | 30946 GCTCAGTGAATTGGCCTCAGAA | 41930 |
| 8305 CGGTTTTCGTGCAGGGTGATG | 19963 GGAGGGTGTGGCAAACTGTGT | 30947 CCTTGATGGAAAGGGTCCGGTTT | 41931 |
| 8306 AGGGGAAAGAGGGTGAATTTGATT | 19964 CCTGAGAATGCTTTTGTGGAACTTTCGTT | 30948 GGGGAACTCCATTAGGGGAAAG | 41932 |
| 8307 CCCACTTTTGGTCTCCTGAGTGT | 19965 GTTTCAGCCAGGAGATGAGCTT | 30949 GCAGGAAGGAGCTACCCACTTT | 41933 |
| 8308 GGCATAATGTCATGTCCACCTTGT | 19966 GGGTTCAGTCACGTTGCTTGCTT | 30950 CGTTCAAGCTTGGGAATGGCATA | 41934 |
| 8309 GCCTCCGGTTTGTAATGCAAATAA | 19967 CCAACCGGTAACCACCACTTC | 30951 AGGGCGCCTCCGGTTTGTA | 41935 |
| 8310 GGACCTCAGCACTTTTTGTAGCATTA | 19968 GGGTAAGCCTTCTGAGGGAGCATT | 30952 GTCACTGGACCTCAGCACTTT | 41936 |
| 8311 CCTTTTCTCCGTGTAGTGCAGAGT | 19969 GGAAGGGTGGTTTCTTGGGACAA | 30953 AGTCTCCTTCCTTTTCTCCGTGTA | 41937 |
| 8312 AGGCAAAGGTGTATTTAGCAGAAAC | 19970 AGATGATCCATTCCTCCCCTTCA | 30954 TGGCTGAACAAGAGAAGGCAAA | 41938 |
| 8313 TCCTTTCAGTCCTCATTCTTCCCTAT | 19971 GGAACTTACAGTGGTTGGAATAGGTT | 30955 CCGAGAGACACATTCCTTTCAGT | 41939 |
| 8314 TGGGGAGGGACATGGCCTAAAA | 19972 GGCCAGGCAATAAGCTTTCCTT | 30956 GCAAGCAAATGGGAGGGACAT | 41940 |
| 8315 CTTGACCACCTCTCTAAATAAGTCTGA | 19973 GAGAGTCTCTACTCTTAGCTCTTAGTGTT | 30957 TGTAACCAACTTGACCACCTCTCT | 41941 |
| 8316 GATGGGAGGTCATTTCACCAAGT | 19974 CCAATGGAGAATTTCAAAGCCCTAGA | 30958 GAGGAAGTTGATGGGAGGTCATT | 41942 |
| 8317 TGGTCTTGTCCCAGGTTGTAGT | 19975 GCCAACCACAAGTTTTGTAGCAGTT | 30959 GAGGGGTATGTGACTTTGGTCTTG | 41943 |

FIG. 36M8

| | | | |
|---|---|---|---|
| 8318 TCCTGGCACATTTGTCTTCTGTT | 19976 GGACTGCCTGGTATTCTCTTTCTT | 30960 TCACCATCATCCTGGCACATTT | 41944 |
| 8319 CCCTGGCTCAACAAACTGGAAGT | 19977 TGGTGAAAAGGACTTGGAACCTT | 30961 GCAAGACCCTGCCTCAACAA | 41945 |
| 8320 CTCAGGTGGCATGATATAAACAGGAA | 19978 CATTATGTGCCAACACCCTTCTAC | 30962 CTCAAAACATCTCAGGTGGCATGATA | 41946 |
| 8321 CTGCTTTAGGTGGCATTGGACTTTG | 19979 GTAAGACTACCTTGCTCTGTTCAAGT | 30963 AGGCTCCCCATGCTGCTTTA | 41947 |
| 8322 GGGTTGCTGATAAGTGGAGAGGAA | 19980 TTGACTTCACCAAAACATCCTGTTC | 30964 GGGAAACCAAGGGTTGCTGAT | 41948 |
| 8323 GTGAGAGGGAAGCACGACTTTC | 19981 CTCCTGGCAGACAAGCAACAAG | 30965 AGGTGGGAGGGAGGAGTGA | 41949 |
| 8324 ACCCCTCCTCAATCACTAAGGAAA | 19982 GGTATAAGATTCATCATCTGGGCTGAA | 30966 TGGCTGACCCCTCCTCAATCA | 41950 |
| 8325 GCATCTTTACTAATAGCTGGCTCAGT | 19983 CAGCAAGTGCACTCTTTGCAT | 30967 TTCCAAAAGGGGATACTGCATCTT | 41951 |
| 8326 GCCCAGGTTTGGCTCAGTTTG | 19984 CGATGCCTAAGATACAGCTGATACTCAATG | 30968 GGTGGTGGAAAAAGCCCAGGTT | 41952 |
| 8327 TGACGCACTACGGTGACAAG | 19985 CAGAGAACCTTCCTAAATTCCCTTTCT | 30969 TACGGGCCTTTGACGCACTAC | 41953 |
| 8328 TGTGTAGGCAGTTTAGTGCATCTT | 19986 GCTTTGTAACAGGGTTATACAGGTTTC | 30970 CCTGGGTATGTGTAGGCAGTTT | 41954 |
| 8329 AAAGAGGATTTCCGCAGTGTCT | 19987 CCAAACTTAAGGGACCCTACGACCTA | 30971 GGCTGGCGGCATAAAGAGGATT | 41955 |
| 8330 CGGCAATCCACTACAGGTGAAC | 19988 CCCACCATGAATTGCTGTTGCTT | 30972 CATGGTATTTCAAGGCGGCAAT | 41956 |
| 8331 CAACCATTAGACCCAGCGAAGT | 19989 GGGTGCAGGACACTGTGTATGGTA | 30973 GCTGCAGTGGCACAACAACCATT | 41957 |
| 8332 AGAACCCTATGATGATGTCCTCCTT | 19990 CACAGAGGTGAAAAGGGACTGAAG | 30974 AGCTATCTGGGACATTAGAACCCTAT | 41958 |
| 8333 CCAGTCACTGTGGGTCATTTCT | 19991 GTTCAAGACTGTTTACTTGGCCTTATG | 30975 TCTTGCAGGTAGCCCAGTCA | 41959 |
| 8334 GGATAGAGCTACAGGATGCATCTAAAA | 19992 GAAGGCTGGAACAAGTCCAGAA | 30976 GCTGGGGATAGAGCTACAGGAT | 41960 |
| 8335 GTGTGACAGATTGATTGTGTTCCAT | 19993 CCCTTCTGAGGACTAAACCCAGGAAA | 30977 TTGGCAGAGCTTTCTGTGTGA | 41961 |
| 8336 GGCTCACATTGAAACCTGCTGAGA | 19994 CCCTCAGCCAATTCTTGGTCAAT | 30978 TGAAGCAAGGCTCACATTGAAAC | 41962 |
| 8337 GGAAAGTTGTTAGCTCCTGTCTGTCT | 19995 CGGAGATGCTGGCATTGGAAAG | 30979 GGCAGAGGTAGAGGAAGTTGTTAG | 41963 |
| 8338 CAGACTTCATTCAGGACAGGAGAA | 19996 GCCCAGTGCAAGCTTCAGTTTC | 30980 GGGAAGAAACTACCCCAGACTTCATTC | 41964 |
| 8339 TGGGTGACGATGCCAGGATTAG | 19997 GCTCAGTTATAGGGTGATTCACTTCAGA | 30981 CCAGAGCCTGGGTGACGAT | 41965 |
| 8340 GGGCTCTTTAGTCAGGTTGTGT | 19998 CCCACTTCCCTGAAGACTGAATCCTA | 30982 AGGCCCAAGGGCTCTTTAGT | 41966 |
| 8341 GGCTCCAGTTAGCCTCTGCAA | 19999 CCCTGCAGTGGTCCTGACTTC | 30983 TCCCTAGTGGTGGCTCCAGTTA | 41967 |
| 8342 CTCAGGGAGGAAACCCTACTGT | 20000 GGAGTAACTTGAAACTGGACATGACA | 30984 GCATAAAGGTGCTCAGGGAGGAAA | 41968 |
| 8343 TCTTGGTTGCACCCTGAAACT | 20001 CCTGTAAGCCAAAGAAAGGGGTTGA | 30985 CACTGGACATCTGGCATCTTGGTT | 41969 |
| 8344 CCTTCCTTGCCTCCCAGTTACA | 20002 AAGTCATTCGGGCTGTTCTGT | 30986 GCCAACACAGGACCCTTCCTT | 41970 |
| 8345 GTCTGTGAAGTCAGCCGTGGTT | 20003 GACTGCCTAGTTGCCTGTATCATC | 30987 CCACCCTTACTCCTGTCTGTGAAG | 41971 |
| 8346 GGGGTAGCAGCAGATACTAAAGGAA | 20004 CCCTCCTGCCATTTTAACAGCAA | 30988 GCCATGCTAGCCAGCAGAT | 41972 |
| 8347 ACCCTGACACCCGCACAA | 20005 GGTCAAGCGGGAAGGGCTTT | 30989 TGGGTGCTCTCACCCTGACA | 41973 |
| 8348 GCAGTATGAAGAGACTTTCCCATAGA | 20006 ACCCCATGGCACCTATTTGTTTC | 30990 GGGCACTAGCAGTATGAAGAGACTT | 41974 |
| 8349 GGAAGGAGCTGATGGTACACAGA | 20007 GGCCTACAAATTAGTACAGTCCCTCTCA | 30991 CAGTACTCCAGGAAGGAGCTGAT | 41975 |
| 8350 CCCTTCCTTGGCTGAAGTGAACTA | 20008 GCCAGCATCACAGAGATAGGGAAA | 30992 GGCTCTGTGTCATCCCTTCCTT | 41976 |
| 8351 GCGTCTCTCCAAGTTCTAGCAGTTATTC | 20009 AAGGCCCTGACATGGCTGGAA | 30993 GCATCAGACGTCTCTCCAAGT | 41977 |
| 8352 GGTGGGGAAATGTCAGGAGTCT | 20010 GGTCATTGGTGACCTTCATGTTGCTA | 30994 GTCCAAGGTAGGTGGGGAAATG | 41978 |
| 8353 GGCTCAAACATGGCTCCATCACT | 20011 GGAGATAAGCCCCTTTCCTTAAGTT | 30995 CCAGTGTCCGGGCTCAAACAT | 41979 |
| 8354 GCTACAGGCACAGGACAAGTGA | 20012 CCTCCCGTCCCCATATTCCTTTCA | 30996 TGGGCAGGACTGAGGCTACA | 41980 |
| 8355 GCCAGCCATACTCTTCCTGACA | 20013 GTTGGACACCTTATGCTCATTCAAGAT | 30997 ATGCAGGGAGCCAGCCATACT | 41981 |
| 8356 GCAACTCCAATGCCATAAGCATGAA | 20014 GGTGATGTCTGAGCTGGACCTT | 30998 TCCCCTTCAGCAACTCCAATG | 41982 |
| 8357 TGGATGGACGAGGAGCCTGTA | 20015 GAGTGCTTTAGTGAATCCCAACAGTGA | 30999 AACTTGTGGGGACCGGTGGAT | 41983 |
| 8358 CCCTGACATCTATGAGAAGGACCTA | 20016 GGCCGGGATGGCTTACATTGAT | 31000 CCGGTAGGTAACATCCCTGACATC | 41984 |
| 8359 CTCACTAAGACCAGCAAGTCTGCTA | 20017 TTTTGTCTGTGAAGGAGGCATTTAC | 31001 CAGGATGCAGTAGCTAAATCTCACTAAG | 41985 |
| 8360 TGTGGTCAAGGAGCTGGAGAGA | 20018 CCCAATAAATCCCACTGTCTTGTCT | 31002 TGGACCAGGGTGTGGTCAAG | 41986 |
| 8361 GCTATGCAATTTCTGCTAACAGGAGGTA | 20019 GCTTGCTGGACATTGCAGTCAT | 31003 TGATCTGTGGGCTATGCAATTTCT | 41987 |
| 8362 CCTCAGAAATGAACCCTTTCCTTCCAA | 20020 GAGCTGGAGTCCCTGCTTTGTT | 31004 GGGCCTGCACCTCAGAAATGAA | 41988 |
| 8363 AGTGCTTGGTGTGGGGAAAG | 20021 GCAAAAATCTGCGGCCTTTTCGTA | 31005 TGACCCAAGCCCCGAGAAG | 41989 |
| 8364 GCTTAAAGGCCTCTGGGATCT | 20022 GTATACAGAGTGAAGCTGTAGAAGTCA | 31006 CAAGCCCAAGTCCCTGCTTA | 41990 |
| 8365 GCCTAAGTTCAGGTTGCCAAAG | 20023 GGACAAGAAGTAAATGGGAGTGAAAGGTA | 31007 CAGGAAGCTCTCAAGCCTAAGTTC | 41991 |
| 8366 GGGAGCACATTCATGACAGCATTT | 20024 CCTAGGAGACCAGCTGTGGTTTG | 31008 GCAGAGCTGGGAGCACATTCAT | 41992 |
| 8367 GCAGGAAAACTCATTCCACAGAAG | 20025 AGACTATGGAACCTACTGGTGACA | 31009 GCCAACAGTGCAGGAAAACTCA | 41993 |
| 8368 CCCTGTGAGCATGGTCTGTTCT | 20026 ACCGTGCATCCAGAGTGATG | 31010 GTGCTGCCCTGTGAGCAT | 41994 |
| 8369 CAGCTCAGTAAGAGGCGGGTAT | 20027 CACGGGGCTGTTTCTCCATCTT | 31011 GTGTGTAACAGCCTTCAGCTCAGT | 41995 |
| 8370 GCAAAGGGAAGGAGGGATGTT | 20028 CTTCATCCTCGGCCTCTTTTCT | 31012 TGGGTAAATCAAGGAAGGAAGCAA | 41996 |
| 8371 TCCACCTAGGTTTGTTTGACTCTAAG | 20029 GGCACAGAGGCAGCCTGATAAT | 31013 CCAGGATTCCACCTAGGTTTGTT | 41997 |
| 8372 ACCATGTTCTTCTGGTCACGTTATT | 20030 GGTGAAAAGTGTGAAGGACTCATCT | 31014 GCCAGCCAAGTCTACCATGTTC | 41998 |
| 8373 TGGGCATTACATTTGTCCTCTTGAA | 20031 CAGGAGAGCTGACTCAACTTCAGAT | 31015 GAGCCCCTGGGCATTACATTTG | 41999 |
| 8374 GGTCTGTGTACTCCTCCCCTACA | 20032 GCACTCCAAACAGGTCTTCAGAAA | 31016 CCTTTCAGTCCAGGGTCTGTGT | 42000 |
| 8375 CAGCTCATTCCTTCCATAAGAGTCA | 20033 GCTACTGCACAATTGGACTTGTTCTTG | 31017 CCTTGCCTCTTCAGCTCATTCCTT | 42001 |
| 8376 GGGCATACTGCCCTTGCCATTA | 20034 GCTGTGTTTAGGTGACTAGGGATCAGA | 31018 TGATCTATTGCCTTTCTGGGCATAC | 42002 |
| 8377 CTTCTCCACCAACGCCTTCT | 20035 TGCCGACAGCTTCAAGGGTAGA | 31019 AAAGCCCCTCGCCCCAACTT | 42003 |
| 8378 TGAACCTAGAAATGGCCTGACCTA | 20036 CTCCCACTTTTTCCACCTTCAGA | 31020 GGGCCTGGATGAACCTAGAAATG | 42004 |
| 8379 GGGGTATGAGTCATGGAGCCAAT | 20037 TGAGTCTGTCTCCCCGACATCT | 31021 ACAAACTGGGTGGGTATGAGT | 42005 |
| 8380 CCGGGTTGACTTCCTATCCATTTGA | 20038 TTTGCGCCCTGACTGCAT | 31022 CTGTTGCCGGGTTGACTTCCTA | 42006 |
| 8381 GGCCTTGTAATTACGTTCCTTCTCTACA | 20039 AGCCAACACGCAGGGACAAT | 31023 CTGAGAGACTGTGATGGCCTTGT | 42007 |
| 8382 CACTAGAGATGGAAAGGGGCATATT | 20040 CACAGGTCCTGCAGATTTTCTCT | 31024 GGCAGTGGCACTAGAGATGGAA | 42008 |

FIG. 36M9

| | | | | | |
|---|---|---|---|---|---|
| 8383 | TGCCATGTCCTACTGCTTCCTA | 20041 | GGAGCCAAATGAGAGTCAATTTTCCTTTCT | 31025 | GCCCAACCTGCCATGTCCTA | 42009 |
| 8384 | CCCACCCTTAGATCAGGGATAGT | 20042 | CCTCTGCAGGCTATTCGTGTATTTC | 31026 | CCCTTCACATATTCCCACCCTTAG | 42010 |
| 8385 | GTTGGATGTTTTCTCTCCCATGCAA | 20043 | CCAGTGGGTGCAAACAAACACA | 31027 | TGGTCAAGGTTAGAATGTTGGATGT | 42011 |
| 8386 | CTGAAGGGTTAATGTCTGGCTGTCA | 20044 | TTGGCTCCTTTCCCCTAGACA | 31028 | CTCCTGGCTGAAGGGTTAATGT | 42012 |
| 8387 | CCTGGAAGCCAGGTACATTCAA | 20045 | GCACACGTGGCCACAAAGAAA | 31029 | TGCCATCAGCTGTACCTGGAA | 42013 |
| 8388 | TGTGCCGATGGGAGGAAATG | 20046 | TGAAGACGGGTGGGGTCCTTTA | 31030 | CGGGGAGTATGTGGGGATGT | 42014 |
| 8389 | GTGCCCGGACAGAAAAGACTTTCA | 20047 | GGCAGGATGAAGTATGGACCTGAGA | 31031 | CCACTGTGCCCGGACAGAAA | 42015 |
| 8390 | TCAGCTCTGTTTTATGGGTGACAA | 20048 | CACCTACCTCACTAAGACCCAAGAT | 31032 | GAAGGAGAAAGCATCAGCTCTGT | 42016 |
| 8391 | AGGGAGGGTAGCTGGGGTTTAC | 20049 | CCCCAAGCTGCTCTCTGTAAG | 31033 | TTGGAGTGCATTTGAGGAACAAC | 42017 |
| 8392 | GCGGCTTTAGCTGGAAGCAA | 20050 | ACTTAATGAAGAAGGGTCTACCGAGAT | 31034 | CGGATTCACCTTGAGCGGCTTT | 42018 |
| 8393 | GGATCCCAGCTCCTTCCATCATGT | 20051 | CAGGGCTTCAACTGAAGGACTCTAAG | 31035 | TTCAGGGATCCCAGCTCCTT | 42019 |
| 8394 | GCTCTTGTCGTCTCGCTTTTCTTC | 20052 | CCCACTCATCCACCCTGACT | 31036 | GCTCCCCTTCCAGCTCTTGT | 42020 |
| 8395 | TGGGGAAAGGATGCAGTTTTCA | 20053 | GAAGTGTCAACTTCTCAGCAAGTAAG | 31037 | GGAGCTGGGGTTTGGGGAAA | 42021 |
| 8396 | CGTCCTTTGTTGCAATCTCAACTT | 20054 | GCCTCGTAGTATAGCTTGGAAAGTA | 31038 | GGCAACTCCTGTACTACCGTCCTT | 42022 |
| 8397 | GCCGCTATCAGTACGAGAGTTGT | 20055 | CGTTGAGGAGCACCTGTATCAA | 31039 | TGCCTCCTGCCGCTATCAGTA | 42023 |
| 8398 | CCGGGATCTTAACTGGAATGACCTT | 20056 | TGGGCAGCCCCTAACTGT | 31040 | GACTTGCGATATCCGGGATCTTAAC | 42024 |
| 8399 | GGTCTCTGAGGTCTCCCTTTGA | 20057 | TTGTGGAACGGAGGAAGAGTATG | 31041 | ATCCAGTAGCTGAAGGTCTCTGA | 42025 |
| 8400 | GCTTAAAAGAATGTCCTGGGTTCA | 20058 | GCTGCTGGGTCAGTCTTGAACATT | 31042 | GCAAACTGCCTGTCCTGCTT | 42026 |
| 8401 | CAACATGAAACATGGGCTCCAAATCT | 20059 | CCCTCTGTTCCTATGGTCCTGGTT | 31043 | GGTAGGAGCTGGTTCCAACATGA | 42027 |
| 8402 | GAGGTGGGCAAAGGAACACGTA | 20060 | CCTGCCCAGCCTTTTATGGGTAGA | 31044 | ACTCTCCGAGGTGGGCAAAG | 42028 |
| 8403 | TGGAGGCCTTAGGTCTTGCTT | 20061 | AGGAGGTCTTTTCAAACCCTTTTCA | 31045 | ACAGCCCTTATGGAGGCCTTAG | 42029 |
| 8404 | CAGGGAGGAACAAGTGGCATGA | 20062 | CAATGACGAGGCAAGTCAATATCTCT | 31046 | AGCTGGTCTCAGGGAGGAACAA | 42030 |
| 8405 | GGCCCTGAAGTATGCTCTTAAAGT | 20063 | TTCCCTGTCCCTGTCACTCCTT | 31047 | AACCCGACCTGAGGCCCTGAA | 42031 |
| 8406 | AGGGGTTATATCTGGCCTGGAA | 20064 | GCTGATCAAAGAGGGATATTCTATGGCATT | 31048 | TGAGGGTTTAAGGAGATAGGGGTTA | 42032 |
| 8407 | GACTCTTCTCCAGTTCCAGGAAAAT | 20065 | GCACATGGCTCCCTTTCTGA | 31049 | GGCCAAACCCTGTGACTCTTCT | 42033 |
| 8408 | GCAGTGATGGAACTGCCACCTA | 20066 | CTGGAAGAAGGAACCCTGGATATG | 31050 | GGCTCAAGTCAGCAGTGATGGAA | 42034 |
| 8409 | CCTGTAGGTCCCAGGAAGGTAAA | 20067 | CAGAGTACTTCTTCCTGACCCTAAC | 31051 | GGGTTCGTCCAACTTCCTGTAG | 42035 |
| 8410 | CCAGATACCATTTTGCCTCATGTCA | 20068 | TGAATTACACAGCTTCAGGCCTTT | 31052 | TGCCTTTCCTGACCAGATACCAT | 42036 |
| 8411 | GTGTCGTTTAGCACGAGCAGTT | 20069 | TGCTTGCCTTTTGCAGTAAATGTAG | 31053 | GGTCCCCTCCTAGGTGTCGTTTA | 42037 |
| 8412 | CCTGTGGTTGGTACCCTCTCTTCT | 20070 | GGAAACCTCAATGTGAACTGCTCT | 31054 | CCCAACTGCCTGTGGTTGGTA | 42038 |
| 8413 | GACCAGACCTCTGCTGCTTTGT | 20071 | CGAGTCAGCCACTTGTGAAAC | 31055 | GCGCTTGCTGCTGGTTAAGA | 42039 |
| 8414 | GCTTCTAATAGAGACCATTCTCCTGAA | 20072 | CACTGTATCTGGCCTGGATCCAATTT | 31056 | CAGGTTCTAGAAAGTGTCTGCTTCT | 42040 |
| 8415 | GGCAAGTAAGTCTTCCCTCCTTTG | 20073 | GGCACAAAGCTAGACTTCCAGTA | 31057 | GCCATGCCACAGGCAAGTAAGT | 42041 |
| 8416 | TGGGCTGGAATCCTGACTCT | 20074 | GCAAAGGTGGTTTCAAAGTCACA | 31058 | AGAGGCTGCCTGGGCTGGAA | 42042 |
| 8417 | GTTGGGCGTGATGAGGACTT | 20075 | GGAAACATTCCCTGCCATCTCCTA | 31059 | TGGGCTGCTTTCCCCAGTTG | 42043 |
| 8418 | CAAGTGAGGCTTTGTGCCTTTTC | 20076 | AGTGCAGGCTTAAGGAAAGGTT | 31060 | TGGAGAAGAATACAAGTGAGGCTTTG | 42044 |
| 8419 | GAGAAAAGAAAGGGGCAAGAATTGA | 20077 | GTGGTGAACATAGTCCCCAGTAAAT | 31061 | CTGGGGAATTCAAAACAGGAGAGAAAAG | 42045 |
| 8420 | TCGCTCTTTGGTAAAGTGAGACA | 20078 | GGAGGGAAGAGGCTAGATTAAATACCTTAG | 31062 | GGGCTCTATCGCTCTTTGGTAA | 42046 |
| 8421 | CAACTTAAGTGCCTCAGGCTGTCT | 20079 | GCTGACATTGAAGACCAAGGAATC | 31063 | GTAGCTACTAAGAGCCACCAACT | 42047 |
| 8422 | GCCCAAGAACCCACAATCAATC | 20080 | CAGTGAGCGCAACCATTCCAATC | 31064 | AGCAGCAGAAACCCCTCTTG | 42048 |
| 8423 | CCGTCACAGTCCAAGTAAAAGCTA | 20081 | CCAGATCACATAGGGCATTTTAGACCAT | 31065 | CCCAATGTCTTCCCGTCACAGT | 42049 |
| 8424 | GGGAGTTAGAAAGGGCCTCTAACAGTTT | 20082 | ACTTATTCACTGTGGCCACCTTTC | 31066 | GTTGCAGCTTGGGGAGTTAGA | 42050 |
| 8425 | CGCTAAACACTCTTCAGACAGACA | 20083 | CTCGATCAAATGCAGTGGTCAAATGT | 31067 | ATGTGGTCATCGCTAAACACTCT | 42051 |
| 8426 | GGGGCTACTGATGAAGCACATATAG | 20084 | CTCAGCCTTTTATCCTGTTCTGTGT | 31068 | CGAGCAAGGGGCTACTGATGAA | 42052 |
| 8427 | GGCCCTGTGAACCTTGTAGCTT | 20085 | CCCACCCCACCTTCTCCTTTTG | 31069 | GGGAGAATATTTGGCCCTGTGA | 42053 |
| 8428 | CCGTGCGAGGAAAGTGACAGT | 20086 | GGTCCTTGAGTTCGGGGTTAGGAT | 31070 | TGGTGACCGTGCGAGGAA | 42054 |
| 8429 | GGGAGAGTCAGTGACCAAAGTATG | 20087 | GTCATCCTCGAAAGTCTCCGCTACA | 31071 | CTGGCAGTCTGGGAGAGTCA | 42055 |
| 8430 | CGAGGAGATGAAGGGAGCAGAAAT | 20088 | ACTGCCTCTTTGGCCACGTA | 31072 | CCGAGCTACACGAGGAGATGAA | 42056 |
| 8431 | AGACCTTCAAGAGGAAAGTGAGAGT | 20089 | GAACCACTGCCTTAGATCAAACAAA | 31073 | CCCACTCCAAGACCTTCAAGAGGAA | 42057 |
| 8432 | AGGACTCAGAATCCACTCCCTATG | 20090 | CCACAGCACCTATGCCAAGTGA | 31074 | GCACCTTGGCAGGACTCAGAAT | 42058 |
| 8433 | TGAGGTGGTGAGAATGAACCTACT | 20091 | GGACAGCCCAGGTGAGTCAT | 31075 | CCCCTTAGAAAAATGAGGTGGTGAGA | 42059 |
| 8434 | CCCAGTGCTTCCTGTTTCCAA | 20092 | GGCCTAGTCTCCCTAAGCCTAATG | 31076 | GCTTCAACAGCCCAGTGCTT | 42060 |
| 8435 | GGTCAGGTGGGGTTTTATTCACCAA | 20093 | CCCAGGAGTAGCCCTTAACCAATTAC | 31077 | AACTTGGTCAGGTGGGGTTTTT | 42061 |
| 8436 | GCTGTCAAAGCAAGTGGGAAGA | 20094 | CCAGAATTGGAATTGGGTTCCAGTA | 31078 | TCGGGGCTTCTGCTGTCAAA | 42062 |
| 8437 | GCCAGATAGAGAGCTTGTGGGTTCT | 20095 | CAACCAGGCTTGGGAGAACA | 31079 | CAGTGTTGCCAGATAGAGAGCTT | 42063 |
| 8438 | GGTTAAATGACATCCACTAGGCCAAAAC | 20096 | CATGGTGATTGTCGGTTGTTCTTC | 31080 | CCAGGGTTCACAAGACAAGGTT | 42064 |
| 8439 | GGCAGCATAGGTAGGTTTGGAATTG | 20097 | GCCTTTTATCCCTGAGCCATTGA | 31081 | AACAAGTGTGGCAGCATAGGTA | 42065 |
| 8440 | CACTCACATCCCATTGTCCATATCT | 20098 | GCCTCATCCTCCTTTCAGACAATG | 31082 | AGGTGACCCTTCCACTCACATC | 42066 |
| 8441 | CCACGGGACACAGTCAGCATTA | 20099 | GGACTAAAGTAAAAGAGGCAGTGAGATGA | 31083 | TTGCTAGCCACGGGACACA | 42067 |
| 8442 | CTGACACAGTCCTGCCAGATGA | 20100 | CAGCGTCATGGTCCAGAATCCTT | 31084 | TTGCCCCATCGTGACACAGT | 42068 |
| 8443 | CTGCGTTGAAGGTGACTGGAT | 20101 | GACGCCCACTGTGATTGGTT | 31085 | CAGCAAACCTACCTGCGTTGAAG | 42069 |
| 8444 | GTTCCGCAGGCATTCTACCAT | 20102 | AGACAAGGTCGGCTGCAACA | 31086 | GGATGAGCTCCTTGTAGTTCTTGTTC | 42070 |
| 8445 | CCCATCTGCTTCACAGGGTTATAC | 20103 | CCAGCATAAGGAGCCTGTGATTTTG | 31087 | GCCATCAATCCCATCTGCTTCACA | 42071 |
| 8446 | CCGATGCTTCAACCACACCTAGA | 20104 | ATCTCAGTCCCAGGCCAACT | 31088 | AGGAACCCACCGATGCTTCAAC | 42072 |
| 8447 | GCAGGCTCCTGTAAGGAAGGAGTT | 20105 | CCTTCCCAGTCCAACTCCAAAG | 31089 | ATGTCTCGCAGGCTCCTGTA | 42073 |

FIG. 36M10

| | | | |
|---|---|---|---|
| 8448 TGCCACTGTCTTGGCCGTAA | 20106 GGTTCTGTGAATGCCAGCGCTAA | 31090 GCACCCATCTCATTGCCACTGT | 42074 |
| 8449 CTGTATGTCACCCCAAGGGAGTAT | 20107 CTGGGCCCTGTAACAGTGAGAA | 31091 ATTGGGGTGAATCAGAACTGTATGT | 42075 |
| 8450 CCAGGGAGCCCCTTAGGATTAACT | 20108 CCATCCCATAAAGTGTATACCCTCCCTTGT | 31092 GCTACCCAGGGAGCCCCTTA | 42076 |
| 8451 GCCCAGGCAAAAGCAGGGATATT | 20109 AGGCATAGTGGTCCCCGTGTA | 31093 CCTCTATTCCAAGCCCAGGCAAAAG | 42077 |
| 8452 CGAAAGTAAGGGCTAAAGTCTCTTCTGATG | 20110 TCACTCACCTGGGCCCTAAA | 31094 GGGTTTTAACGAAAGTAAGGGCTAAAGTCT | 42078 |
| 8453 GGAGGAGTGCCTCATGTTATGATAAGT | 20111 GGCTTGCCATATTACTGAGTGCAAAA | 31095 GAGTAAGGAGGAGTGCCTCATGT | 42079 |
| 8454 CCTCTCTGGTAGGATGCAACTGAAAA | 20112 TCAGGATGGCACTGGAACTTAATC | 31096 GCTCATGGCCATCCTCTCTGGTA | 42080 |
| 8455 GGGACCTACCATTACCATTCCCATCT | 20113 GGATAATAAGGCGTATGGCAACAAA | 31097 CACAGAGGTGGGACCTACCATTAC | 42081 |
| 8456 AGCATGGTTGCAGGCACAGA | 20114 GGGAGAGACAGACTCCAGCAATCA | 31098 ATTCAGTGCCCAGCATGGTT | 42082 |
| 8457 GCCAACACGAAGTCGCTTCACA | 20115 CAGTGTCTTCATCCCTCACGGAAT | 31099 GCAAGTTCAGGCCAACACGAA | 42083 |
| 8458 TGCCTGAATTCCAACGAGGATTTT | 20116 ACCCTCTGGATGGGTAAGGTAAC | 31100 TGTGTTCCAATACCTGCCTGAAT | 42084 |
| 8459 GTGGTCTAGGCAATCCCTCAGT | 20117 GTCCCTCTGGGACGAACATACT | 31101 GGTGCCAGTGGTGATAAAGTGGTCTA | 42085 |
| 8460 GGTTGTCTAGGAATAGGCTATAGATTGGAA | 20118 CCCCTGAACATTGCTGATCCTCTT | 31102 GGGGTAGTCAAGGTTGTCTAGGAA | 42086 |
| 8461 GTGCAGTTTTGCTTTCCCTCTT | 20119 CTGCAGCTGTTTCTTTCCCATAGT | 31103 GGAAGCTTGAAACGAATTGTGCAGTTT | 42087 |
| 8462 CACGCAAGCTCCTTAAGCTATTGT | 20120 TCAGGCTCAGAGTGGAGAATACA | 31104 TGTGCACGCAAGCTCCTT | 42088 |
| 8463 TGTCCTTCCGTGTGCTGCTT | 20121 GCTTCAATTCCTTTCTGGGGAAGT | 31105 AGGCTGGGGCTCTGTCCTT | 42089 |
| 8464 GGCTTCTGGGAAAACCCAAGTAAA | 20122 TCCTCCTCCTGTCTTTTTAGGCTAT | 31106 CCTCAGGATTGGCTTCTGGGAAAA | 42090 |
| 8465 TGGCCAGGATTTGGCAGTGA | 20123 GCCCCTACCCAGACCAGAAAAA | 31107 GGTCCATACCCAATGGCCAGGATT | 42091 |
| 8466 GGAGAATGGCCTTAGGAGTCTGACA | 20124 GAGACTAACAGGTAAGATCCAGGATTCAA | 31108 AGGGGAAGGAGAATGGCCTTAG | 42092 |
| 8467 GCTCCTGAAACTGAGCCACACA | 20125 AGGCAGGCCTCACAATGTATC | 31109 CCCTAAATGGTTGCTCCTGAAACT | 42093 |
| 8468 GTGTCATTCACCACAGAACCATGT | 20126 GCAAAGGAAATGAATGGCATCAGTA | 31110 CCAGCGTCATCTTCCAGTGTCA | 42094 |
| 8469 CTCCGGCTTTAACACTTCAAAGACT | 20127 GCAAGAGAGAGACTTGGTCTGCAT | 31111 GTCACTCTCCGGCTTTAACACT | 42095 |
| 8470 ACTGACCGCAAAGGAAATAAGGAT | 20128 GGCTGTAGCTGCCATTTATAACTACTTTC | 31112 GGAAGTGTCTACTGACCGCAAAG | 42096 |
| 8471 GTGCAACTGGGTGACTAAAGACCAA | 20129 CAGAGAGCAAGTAAGCTGTCCCTTT | 31113 CAGTGTGCAACTGGGTGACT | 42097 |
| 8472 GCTGTCTCAGTGCAACAACAAGTGA | 20130 GCTTGGGTTACATGCTTCCTGGTA | 31114 CTGTGTGCTGTCTCAGTGCAA | 42098 |
| 8473 CCCACTTCAGGCCCCTCTCTT | 20131 ATCGGGAGTATCAGGGATGGAA | 31115 ACCCACTGCCCCACTTCA | 42099 |
| 8474 GGCACAGCCTTTAGAATAGCCTCTAAAAT | 20132 GGATTTTAAGTAGGGGAGCAATGTGA | 31116 CTGACTCTTGGCACAGCCTTTAG | 42100 |
| 8475 GTCCGATGTAATGGAAAAGAGACACA | 20133 GGAGATACTCAGCCTTTGGACATGAAG | 31117 CTCAAACTGTCTAAGTCCGATGTAATGGAA | 42101 |
| 8476 GCAGAGAGAGCTCACATCTTACCATT | 20134 GCCTGGGGAGATAGATGTGCTA | 31118 ACTCACCAGTGTGCAGAGAGA | 42102 |
| 8477 GGCATGTATTGACAAAGGCTTCTT | 20135 GACTTTTCCCCTACCACTATAATCAA | 31119 CACTCCAAAAGCAGTGGCATGT | 42103 |
| 8478 GGCAGCAGACTGCCTGACTT | 20136 TGTCCAAGGTCGCGCAGATA | 31120 ACAGGCTTTGGCAGCAGACT | 42104 |
| 8479 CACGCTGAGAGAAGCAGCATTTG | 20137 GGCTAGCCAGCAAGGATTCTGA | 31121 CCAAAAGAGGCACGCTGAGAGAAG | 42105 |
| 8480 CCAGAGGCTGATCTGCACTACCAA | 20138 CTCATGTACCAGTACTAAGCCATTCT | 31122 ATACTGGACCAGAGGCTGATCT | 42106 |
| 8481 TGGGGTGAAGCCAGAAGTCA | 20139 TTCCCAGGTGGCCATGTAGT | 31123 GCTGTTGGTATTCCTTGGGGTGAAG | 42107 |
| 8482 GTCCACCAGAGGCATGTTAAAAGGTA | 20140 CGCCAAGGCCTGTTCAAAAAC | 31124 GCATAGTCCACCAGAGGCATGT | 42108 |
| 8483 ACCAAGCCCAAGTCCTCCTT | 20141 TGGCTGAAAGCAGGTCGCTATG | 31125 CCGCTTTCTGACACCACCAA | 42109 |
| 8484 CACGTCGTAAACATGACTGGTTTTA | 20142 GACAGGCAGAGGAGTTCTGTGA | 31126 GGCAGGACACGTCGTAAACA | 42110 |
| 8485 GCCCCATCTCTACTTGTCACTGAT | 20143 CCTGTGGGTTGCTTCTGTCT | 31127 CCCTCCTGCCCCATCTCTACTT | 42111 |
| 8486 CTTCTGTCAGACCTACCTGCACT | 20144 AGAGCCCTATCCCCACTGAAC | 31128 TCTCCGCTCAGCTTCGTCA | 42112 |
| 8487 CTGTGTGGTTTGTCTGGTGGGTTA | 20145 CATCTGTGGCCAGGTAAGGAATAG | 31129 GCACCTGTGATGCTGTGTGGTT | 42113 |
| 8488 GGCAACAGAGAACGTGATGAAG | 20146 GTGAATCTTCAACAGCAGATGAGTCT | 31130 TGTGGCATGAAGGCAACAGA | 42114 |
| 8489 TCCCTCCCAAACTGCTCTCA | 20147 GGGCTGAACAGTGGTCTGACA | 31131 CTGCTACAACCTCCCTCCCAAA | 42115 |
| 8490 GGCAGAAGGCAGGAGCTTTGAA | 20148 ATCGCCCTCTCCCCTGCAT | 31132 ACTAAAGCCTTTGGGGCAGAAG | 42116 |
| 8491 GGCACATGCCATATGATTGATACTGAT | 20149 GTGAGAAATATGGAGACAGCCAGTT | 31133 GCTCTTGGCACATGCCATATGATT | 42117 |
| 8492 GGGGCGAACACATCTAAAACCAT | 20150 CAGGAACTGTCTGAAGAAGCTAAAAG | 31134 AACCTGAGACCTGTCCCTGTTG | 42118 |
| 8493 CTCCCAATGCAACCCTGTTCTTG | 20151 GCTGAAAGGCTCACTGCTAGGTA | 31135 GCCTAGTGTCTGTCTCCCAATG | 42119 |
| 8494 GGCAACCCATGTTATTTAGTAGGGAAA | 20152 CCCACAGAGTATGGTGATGACTGT | 31136 GGTTGGATAGTTGGCAACCCATGTT | 42120 |
| 8495 GAGCTGGCAAAAGCACAACTT | 20153 CACTCCATCTTCCTAATGGCCTACT | 31137 CCTCAGTCAGTTAAGAGCTGGCAAA | 42121 |
| 8496 CGTGTGGAACTGCACCTCATC | 20154 GGATCCAAGGACTGTATTCCAACTGA | 31138 ATGTTGGGCCTGGCTTTGT | 42122 |
| 8497 CAGGGCCCCTTTTCACAACAAC | 20155 GGAGTTAGCCCTTTAGCGTCTTGT | 31139 TTCCATCCCAGGGCCCCTTTT | 42123 |
| 8498 TTCGCTGCTGCATTTCTAGTCT | 20156 GGTGTGCTGCAGGGGTATGTT | 31140 AGACCTTATATTCGCTGCTGCAT | 42124 |
| 8499 TCTCTAGATGCCCAGGAACTGT | 20157 ATGTGAGGAAATCATCCCATCTTGT | 31141 GGCAAGTTCTAGGAAGACAGTTATTCT | 42125 |
| 8500 GGTGTGTGTTTCCACCTGTGT | 20158 AAGGCAGGTGCAGGGATGAA | 31142 AGCCTCACTGGTGTGTGTTTC | 42126 |
| 8501 GCAGCTTGTGACCATGACAAGAAA | 20159 CCTTATGTGACATCCAGGACTCAA | 31143 GTGTCTGCAGCTTGTGACCAT | 42127 |
| 8502 CGGGGCAGTGAGTCAGGAGTA | 20160 AGGTTGAGCAAGACTACACCTAATG | 31144 ACTAGAACACGGGCAGTGA | 42128 |
| 8503 AGGCACACAACAAAGCAGAAGA | 20161 CCCCACCTGCGCTTCACTT | 31145 CTCAATTCAGCTAGAGGCACACAA | 42129 |
| 8504 CCACCTTATAGGGTAGCCCTCATATCT | 20162 TGTACCAAAGCTGGGGCAGTAG | 31146 GCCTTACAGGGTAGCCCACCTTA | 42130 |
| 8505 GTTCAAATGCGCAGCTCTTAGT | 20163 CTCGGCGAGTGACGGATAAACA | 31147 GCCGGGCCAATGTTCAAATG | 42131 |
| 8506 GCATATGACCTGCGCCTTGA | 20164 CCTCTTCCCTTCATCCCTCTCTGT | 31148 GCTTCTTGGAGGAGGTTGCATA | 42132 |
| 8507 CTCCAAAGGAGGTGTGGTCAAC | 20165 TAGGCCCATGTCCCGCTTACT | 31149 GCTGAGGCCCCTTTTCTCCAAAG | 42133 |
| 8508 GGGGTAGATCTAGTTGTTTTGGACCATT | 20166 GACGTCAGAAGAGGCATGGTT | 31150 CCACTCCTAGGGGTAGATCTAGTTG | 42134 |
| 8509 CCTTCGCCAGGGTACCATTTTC | 20167 GCCACAGCTCAGACGAGCTTAT | 31151 GCAATCCAGGCTGGGTCCTT | 42135 |
| 8510 CTCATCTTACCTGTTTTCACGGCTACT | 20168 TGGGTGGCATCAGGACCTT | 31152 CTCCCATCCTCTCATCTTACCTGTT | 42136 |
| 8511 GCACATGCCAATGTGGGTGTTAG | 20169 GGGTATTCAGTGGTACCCGATGT | 31153 GGTTTATACCTGCACATGCCAATG | 42137 |
| 8512 CCAACATATACACTGCACCTTGAGT | 20170 CCAAAAGCATTTGAGAAGAAGCAGTGA | 31154 CCCTGAACAGGCATACCAACATATACA | 42138 |

FIG. 36N1

| | | | |
|---|---|---|---|
| 8513 CCATCTTTGAACCCCTACTGCCTAT | 20171 GTGTTTTGAAAGGCTAACTCTGGTT | 31155 CCCCATAGTTTCCTGCTTCCATCTTTGAA | 42139 |
| 8514 ACTAAGGCAATGCTGAGTGGAAA | 20172 GCCCTTGTTGGGGACTTTGTGTA | 31156 CCCTGTGGAGCGACTCTACTAA | 42140 |
| 8515 TGGGAAGGTTCCAGGCAGTT | 20173 TTAGGGCCTGGAATGGGGTTTC | 31157 AGGCAAGGAGCTGGGAAGGTT | 42141 |
| 8516 TGGCAGCTACTGGAGACTCGTA | 20174 GGCTTGAACCACTTGGCTCTCT | 31158 GTGGTCAGTTCTTATGGCAGCTA | 42142 |
| 8517 CAGGAGATGTACCTTTCACCAAAAC | 20175 GGGATCCTGGGACTTCCTGTAATC | 31159 GGACGGTCCAGGAGATGTACCTT | 42143 |
| 8518 GGGGTAGGATGGAGATAGGTTTCAGA | 20176 CCTCTTGAAGGTCCCCAAATATTCTTGA | 31160 GGGACAATGGGTAGGATGGAGAT | 42144 |
| 8519 CTCAATTTTGGAGGGTCTGAATTGGTTT | 20177 GGGCATATGAGATTATAAGGGCTAGTTTTG | 31161 TCTGTGTGCCCGTCCTCAAT | 42145 |
| 8520 GATCCAAGCCAATGGGGTATTTTC | 20178 TGCTCTGCTGATACTGTACTTGTT | 31162 GAGTGCCAGATCCAAGCCAATG | 42146 |
| 8521 GCCATCTTAGATCACAGGAGGGAAA | 20179 GAGGGGAAATGGAGATAAAGTGTTCTAAG | 31163 CGGTAAGAGCTGGGAAGCCATCTT | 42147 |
| 8522 CACCATATCCCCTAGGGTCTTGACA | 20180 CCAATCCTCCCTCTTGCAGTTTC | 31164 CCAGCCATAGATCACCATATCCCCTTAG | 42148 |
| 8523 GGCAAACAGGGAGAATGGGAATAC | 20181 GTGAGGCATTTCCCCACCACTT | 31165 GGTGGGAGGGACAGGCAAA | 42149 |
| 8524 GTGCAAGGAGAGCTGAATCCATGT | 20182 TGAACCACAGCAAGGCAGATAC | 31166 GCTACAGGCTGACTGTGCAA | 42150 |
| 8525 GTGGTGGGGTTTGTTGGCATTC | 20183 TGAGCCCTGCAGACACCAA | 31167 AGGTGGTGAGTGGTGGGGTTT | 42151 |
| 8526 CGCAACCCTGTTTGTTCAAAGATTC | 20184 GCCTTCTTAGTTCCTAGTAGCTGATT | 31168 GGCTTTATTCATTCGCAACCCTGTT | 42152 |
| 8527 GGGTAGAGGAGGACTTCAGTAGTTGTCA | 20185 GCTGCTGCCCTGATTCTAGCTT | 31169 GGCAGTGGGTAGAGGAGACTTCA | 42153 |
| 8528 CTTTTTCTCATACCTGCGCACTCT | 20186 CTTCCAAGTGCTGCCATTTASTCA | 31170 CCTCGGCCAGATTTCTACTTTTTC | 42154 |
| 8529 AACCACGGAATGCGGGACTT | 20187 CTCTACAATAAGTGCATCCCCAGAA | 31171 CCATCACAGCCTAACCACGGAAT | 42155 |
| 8530 TGACCTGGCTATGCCTGTTTAAT | 20188 CCTGCTGGACAAGCTTCCTT | 31172 AGTTCAAGTTTTCTGACCTGGCTAT | 42156 |
| 8531 GTCTGGGAGGAGGAACAGGAAA | 20189 ACCCCTCCTCCACTGGTTTCA | 31173 TGGAAGAGGGAGGCAACTCTGT | 42157 |
| 8532 GCTTGATGCAAAGGAAGGAAACT | 20190 CCCCATTGATGCCAAGAGATCCTAAG | 31174 GGCCACTGCTTGATGCAAAG | 42158 |
| 8533 GCCCAATGCCGTTAAAGATCTGA | 20191 GCTGAGCATGAAGTCAGGAGAAAC | 31175 ACAACAAGCCAATGCCGTTA | 42159 |
| 8534 CTCTCCCAATTTAGCACCAGCATA | 20192 GAGAGGAAGAAACTGACAGGTACTCAAG | 31176 CACATGAGGTGTTTCTCTCCCAAT | 42160 |
| 8535 CCCTAACTAGGCCAGGGAGCAA | 20193 CTGCTCAGAATTTGCCTCAAGTTT | 31177 CCTCATGGCCTGAAACAAACCCTAAC | 42161 |
| 8536 GGGGCTTCCCATAGCTAGGATTGT | 20194 GAGAGAACCCTAGGACTCCACATTTC | 31178 CAAAGGTTTAGGGGCTTCCCATAG | 42162 |
| 8537 AGGGGAGTACAAAGCCATCATTG | 20195 GCTGAAGCATAGTGGTCCAGAT | 31179 TGCTACATTCAAAGGGGAGTACAAAG | 42163 |
| 8538 CACTCTCAGTGGGAAGGGAATTAG | 20196 CCACAAAGTTTTTGACACTCCTCTCT | 31180 GTCATTACATCTGACCCACTCTCAGT | 42164 |
| 8539 TGTCTTGAAACAGCTCGTCACT | 20197 CACACAAGGCAGTGTGTTGTCCTA | 31181 CAATGCTCAGTCTCTGTCTTGAAAC | 42165 |
| 8540 GAGACCCAATAATGGCTGTAGGGATTTA | 20198 ATGGGCACAGAAGCCACTTT | 31182 GGCACAGAGTGTGAGACCCAAT | 42166 |
| 8541 CTCACCAAGGTCCACCAATTTTCAT | 20199 GTCAAGCTATAAACTACAGACCCATCTCT | 31183 GCTCTCCCAAGAATTATCTCACCAA | 42167 |
| 8542 CTCCATCCAATCTGCTGACCTAAGAAC | 20200 CTCATGGAGTTGAAGGCTTGGTTTG | 31184 GGGCCTAAGCTCCATCCAATCT | 42168 |
| 8543 ACTGCTTTCTAGCATGTCACCAA | 20201 GAAGTTTGAAAGGCCACTAGGTGTT | 31185 CCATCACATTGCTCAAACTGCTTTC | 42169 |
| 8544 GGGAACATCCTTGCAATAACCCTA | 20202 GGCCTCAATATGGAACCTACATTGTT | 31186 AGGACGTGCATTGGGAACATC | 42170 |
| 8545 GGGCTCCAGGTTTAGTTAGCAGAT | 20203 CGAGGGAGGTAATGGGAGCTAGA | 31187 CCAAGCAAGGGCTCAGGTTTA | 42171 |
| 8546 CGCTACGTGACTTCTGCTTAGT | 20204 TGCATCCCAACAGGGCTTTC | 31188 CTGGATCATAAAACGCTACGTGACT | 42172 |
| 8547 CACCAAGATGGCTAAGTGACGAA | 20205 TGTCCACGGTATCCACACTGA | 31189 GGCTTTTTCCATCTAATCACCAAGATG | 42173 |
| 8548 GCCTGGGTAAGTGATGGCATAG | 20206 GGTTCCAAGGGCACCACATTT | 31190 AGCTACACAAAAAGCCTGGGTAA | 42174 |
| 8549 GGTCAACTATAGGCTTGCACGTGAT | 20207 CTGATACACCAGTGTCCCTAATTTCCAA | 31191 CCTGATCCACTGGTGGTCAACT | 42175 |
| 8550 CGCTGACTCCAAGTTTCTCTATTTG | 20208 CTGATCTTTAAGGCCCAATACTGTAGA | 31192 GATTAAAATGCGCTGACTCCAAGT | 42176 |
| 8551 GGGTGTGCTGTTTACGTGGAT | 20209 CACCAAGCCAGTCCTGGAGATA | 31193 CCGTGGTGGGTGTGCTGTT | 42177 |
| 8552 TGTTGGAGGTCAGTCAGGTTGT | 20210 GAATGATGGGAGCTAGGCTCAAG | 31194 GGCTTAGAGAGGGGAAGCAACT | 42178 |
| 8553 GTAGGGCAGATCAAAGGAATGAGA | 20211 ACTCCCCTCGCTGGGTGAT | 31195 AGAAGGTTCTAGGCAGAAACAGTAG | 42179 |
| 8554 CCTGAGCCAAACCATGCATCTTC | 20212 GCTTTCTGGACTTAGCTCTTGTTTCA | 31196 CCTCCTGGCCTGAGCCAAA | 42180 |
| 8555 AGGTTAGGTGGTCCTCAGCTATG | 20213 CTTGCTAGCTTCTTGGGTCTCATTC | 31197 ACAATTACAGCAGCCATCTAGGTTAG | 42181 |
| 8556 AGAGCACTCCTCAACCAACTTC | 20214 CTGGGAAGCAGTCTTTGAGACCAA | 31198 CCCAAAGGCAGGGATCCAAA | 42182 |
| 8557 CTGGCACACCTGTTGATGTTGAAG | 20215 GGCTAGCCTCCATGTCAGCAAA | 31199 TTACCCTGGCACACCTGTTG | 42183 |
| 8558 GGCTTCACAGAAGAGGTGGTATGA | 20216 CTCCACCTGCCAAAATCTACT | 31200 GGGAAATCCAGGTAGGCTTCACAGA | 42184 |
| 8559 GCTAGGCGCTACCCCTAGAAG | 20217 GGTGTGTTTGAGACCCTTGCATCT | 31201 ACAGGCACACACCACTGCTA | 42185 |
| 8560 CCTGGATGTAGCAGATAAGGGTTTC | 20218 CTACCGAAAGCTGTTGACCAAAC | 31202 GCTTGGTCCTGGATGTAGCAGAT | 42186 |
| 8561 CCCACTGGAAGGAAGCTTTAAGATG | 20219 CCTTTGCCTGTTTCCTGCAGATT | 31203 CCTCAATCTCCCACTGGAAGGAA | 42187 |
| 8562 CTAGCTCTCTCGTATCATTCAGACTAC | 20220 AGTTTTCCCTGAAAGGAGTGACAT | 31204 TGATGTGGCTAGCTCTCTCGTA | 42188 |
| 8563 TTCACACAGCTGTCACAGACAA | 20221 TGTCTGCCTCCCACATCTCT | 31205 GCCTCTCACGTACCATTCACACA | 42189 |
| 8564 CTTGAGGTCTGATTGGATGAAGTGA | 20222 ACAGGACCATCCAAATCACCTTGAA | 31206 GTGGGCCAACTTGAGGTCTGAT | 42190 |
| 8565 CACGTCCACTAAAATTCCTGCTCTTG | 20223 CCTAAACACTGGACTCTTTACACATCT | 31207 CGCTTGAAAACACGTCCACTAAA | 42191 |
| 8566 CCAGAGGCAAAGGGAAGACTCA | 20224 GCACATCACCCAGTTGGGAAAC | 31208 CTTACTACTAGTGTCCAGAGGCAAAG | 42192 |
| 8567 GGCCATAGATAACCTGATGAACACAAG | 20225 GGGATTGGGTGTTGACGATGA | 31209 GGCCTCTTGGCCATAGATAACCTGAT | 42193 |
| 8568 TGAACTTGATTCTACAGGTGAT | 20226 GACGTGTGTCACGTTCTCTTCA | 31210 GGACAGCCCAAAGAATTTGAACTTG | 42194 |
| 8569 TGGCTGCTACACCAAATCGTT | 20227 CCCCTTGCATTTGGCACAGA | 31211 TCCCAGGATTGGCTGCTACA | 42195 |
| 8570 ACAGTGCAAAGAAGGGGCTTAAA | 20228 CTGGAGGGATGTTTTCAAACCCAAAC | 31212 CCCCTGGGAACAGTGCAAAGAA | 42196 |
| 8571 GGCTTTGTGACTGCTTTGACTAACAGA | 20229 GGGCCTGAAAACTGGCATGA | 31213 AACAGGCTTTGTGACTGCTTTG | 42197 |
| 8572 CCGCCAATCCTCTCCAACTTGT | 20230 TCGTCAACCTGTCCATGGTAAG | 31214 CACTTTATCTTCAGGTCCGCCAATC | 42198 |
| 8573 GGTCTGTTCCTAAAGGTCGGAGACT | 20231 GCAATCAGGACGATCAGACAAAAAGAAG | 31215 CCTGAAGTCTGGTCTGTTCCTAAAG | 42199 |
| 8574 GGGGATTGAAATTCAGCACCACCAA | 20232 CTCTGCTTTTGCAGGGGTTGT | 31216 TGCTGCTGAGTGGGGATTGA | 42200 |
| 8575 CGGAGTAAGTCTTTGTCTCAAACAGCAT | 20233 ACCCAAGGAGACAAGAGCATCA | 31217 GGGCGACGGAGTAAGTCTTTGT | 42201 |
| 8576 AAGGCAGGTGCTGCTCCTAT | 20234 GAGGACTGGAAGTGGTAAGTCACA | 31218 AGCTGGCCCTGTGGAGGAA | 42202 |
| 8577 GGGGTGCAGTAGCCCTCTATGAA | 20235 GCCCAAGACTGGCATTCTCA | 31219 ACCTCCTCAGGGGTGCAGTA | 42203 |

FIG. 36N2

| | | | |
|---|---|---|---|
| 8578 CGTTTCGGAAGCTAACGCTTTCT | 20236 ACCTTTTTCCGACTGGGATGATT | 31220 GCAGGGAAGATGGCTTCGTTTC | 42204 |
| 8579 ACATTGTACAGATGCTGCCTAAGAA | 20237 CAGTCCTCGGATTGGCTGTGATAC | 31221 GCCCCAGGTGCAACAACATT | 42205 |
| 8580 GGATGAAAAGTGGAAGACAGGGAAA | 20238 CGCTTTTGGTAGCATCAGTTCCTTGA | 31222 AGACCACGAGTGAGGATGAAAAG | 42206 |
| 8581 GCACCCACTTACCTTCTCCATAG | 20239 CCTAGCTTGTGCCAAGAGGTTCT | 31223 TGTCACCGGCACCCACTTAC | 42207 |
| 8582 GAGCTGTTGTGTCATGGTGAAAAAT | 20240 CCATTTCACGGGGAAGGAAGT | 31224 CCCATGTGAGCTGTTGTGTCA | 42208 |
| 8583 TGCTAGAGACTCAGATCCCAAGA | 20241 GGCAGAGGATCCCTATGTTACCAGTTC | 31225 GCCTGGAGAAGCATGCTAGAGA | 42209 |
| 8584 CTGGTCCCCATGTTTGCTTTCT | 20242 TGTCCCTGTGGAAGCCAGAT | 31226 TCACGGCCACAGTCCATCAAC | 42210 |
| 8585 AGCGGTGTGAGGTAGAGACACT | 20243 AAGAATTGCTTCACCTAGCCTGAT | 31227 TCCTGACTTAGGAGCGGTGTGA | 42211 |
| 8586 GCAGCCTGACAACCTTGGTAAGT | 20244 GGCCCTATACCCAACAAAGCCTCTA | 31228 GCCATCATGCAGCCTGACAAC | 42212 |
| 8587 CTCTAACTACAACATTGGCCTCAGAAC | 20245 GGGGAACCATGAACTCTACCTGAA | 31229 GGTAGTCAAGAGATGATGGTGTCTCT | 42213 |
| 8588 CTGTGAACCAATAGACGGAATTGATG | 20246 GGGACACTTACCCAACCACGTT | 31230 AGTCGTGGCTCGGATCTGTGA | 42214 |
| 8589 CAGAGCTGGACTAAGACTTGTT | 20247 CACCGACTTCTCTGACCCAAGA | 31231 GACCCATTATAAACAGAGCTGGACTA | 42215 |
| 8590 TCCACCTCTTCGCTGCCTTTG | 20248 TGGGAAAAGTACGGAGTCAGATG | 31232 TTTTGCAATGAGAATCCACCTCTTC | 42216 |
| 8591 TCCCAAAGTGAATGCTGACATAGA | 20249 CGTGTCAACTTTCTCCTTACCTGAT | 31233 TTTGACAGAGGACACTCCCAAAG | 42217 |
| 8592 GCTGTCGTTGCCTATACAACTGTTAC | 20250 GGTTCAGTGGAGCTTGTAGTCTCA | 31234 CCTGTGCTGTCGTTGCCTATAC | 42218 |
| 8593 GGAGCCTACTGGGAATCAGGAA | 20251 CACCTATGAATTCAGGGCTCCTTTC | 31235 CTGTGATAAACCATGGAGCCTACT | 42219 |
| 8594 GGAAGAGCTGGGCTTTGTTTTCTGT | 20252 TGGGATGGGATAAGGAGTAAGGAAA | 31236 GCTTGGAAGAGCTGGGCTTT | 42220 |
| 8595 GCCAGATGCAGGAAAGGAACAATG | 20253 CCCAGCCAGTGAGGTAGATGTT | 31237 TGGAGAGCCAGATGCAGGAA | 42221 |
| 8596 CGATCAGGACACTGAGCCTATCA | 20254 TGCCCTGTCTCCTTCCTTTCTA | 31238 CCAGGACATCGATCAGGACACT | 42222 |
| 8597 TTGGAGAGGTAGATGAAAGAGGAGAT | 20255 GGACTGTTTCCCAAGTCTTCACCTT | 31239 GGGAACCTTTGGAGAGGTAGATG | 42223 |
| 8598 CCCCAGTGCAACACAGAGCTT | 20256 AGTGTGTCCCTAGCCCAAGT | 31240 ATGGACAGCCCCAGTGCAA | 42224 |
| 8599 AGGAGCAACCGCGCCATAC | 20257 GGCATATATGTAGGCCGGGTTGTAAG | 31241 ACGCTGGCTGGAGGAGCAA | 42225 |
| 8600 CGGCCCTCATCTTTCAGGAAGTA | 20258 CCCCGTAACCCAGATGATGAGTTT | 31242 CTGTCATACTTCGGCCCTCATC | 42226 |
| 8601 CTGGCTGCTTCCTCTTCCTATC | 20259 AGGTAGTAGACAGGCTTGAAGGTT | 31243 CACATGCTGTATTTACTGGCTGCTT | 42227 |
| 8602 GGGATCTAGGCATATAAACAGTTCTCTTC | 20260 CCCGGATGGGGTAGCATTTCAA | 31244 GGCTTAGGCAGGGATCTAGGCATATAA | 42228 |
| 8603 CTGGAGCTCATTGGCTGGAAGT | 20261 GCAACAAGACTTTTACCCAGAGACCAA | 31245 TCCCTACAGCTGGAGCTCATTG | 42229 |
| 8604 GGTATTCTCTGCTGCATGGATCT | 20262 GGTTCCAATGGCAGACTGTTGAA | 31246 TCTACCTACCACGCTGGTATTCT | 42230 |
| 8605 GACCCCTTAAACTTTCTGGAGCAAAC | 20263 ACTGGCAAAGGAGAAGGGTAGT | 31247 GGAGATGAGAAACAGACCCCTTAAAC | 42231 |
| 8606 CCCTCTCAGGGCCTTGGTTTC | 20264 TCCCTGCCCAGGACCAAGAATA | 31248 AGGCAGGTTGAATCCCCTCTCA | 42232 |
| 8607 GCTAAGGACACCATGAAGGATAGCAA | 20265 CTGCTTATTCTCCTGGTTGAGGTTGA | 31249 TGCTTGTTAGCTAAGGACACCAT | 42233 |
| 8608 AAGTCAGGCGCTGTCTGGAA | 20266 TATGTCTCATCCCGGCCCTCTCT | 31250 GGTGTCGTCTGCAGCAAAGT | 42234 |
| 8609 TGGCAGTGAGGGAGGGATTC | 20267 CCACCACCTTCCGAGGATGAAAAG | 31251 AGATGCTGCTCTGGCAGTGA | 42235 |
| 8610 TGGGAGGAGATTCGCCTGATGA | 20268 AGGCAGCCTTACACATGACATT | 31252 GCTGCCTGCACACGGATAAA | 42236 |
| 8611 GCCCAGATTTAAGAAGAGAGGGATT | 20269 ACATGGCCTTTCCACTTTCTCTTT | 31253 GCAAGTCTCTAAGATCAGCCCAGATT | 42237 |
| 8612 CTGTCCTCCAAGCCTGTACAAAGT | 20270 CTGGCGTCGTATGAGGCTTTTG | 31254 GCATCTGCAAACAAATCTGTCCTCCAA | 42238 |
| 8613 ACCCCTCTACCTTCCAGTGAAC | 20271 GGCTGGGATAAAATGACAGTCCTTGA | 31255 TCCTCCATCCACCCCTCTACCTT | 42239 |
| 8614 GCCAGTTTCTTCAGCTCCAAGT | 20272 GTGGTGGCTTCTGTGGGTTT | 31256 GGTGTTTCCAGATTGCCAGTTTCTTC | 42240 |
| 8615 CCCTGAAGCTGTTCGGCTTTG | 20273 TGGCACTGGTGGACTCAGA | 31257 GCCATCTGCCTGCCCTGAA | 42241 |
| 8616 TGGGGAGGGATCAGAGACACA | 20274 CCCCAACTGGAATAACTGTTGCTT | 31258 AGGAGACAGAGCTCGCAGGAT | 42242 |
| 8617 GCCTCTTGAGGAGGGACCTTTC | 20275 GAATGGGAGAAAGAGTGGTGGTAT | 31259 CTCATGAATTAAGACAAGGCCTCTTGA | 42243 |
| 8618 TCCCACTGCCCTAAGTCTTTGA | 20276 GACCGAGAAGCAGTACACTGAGA | 31260 GGAGAAAGGCTGTAGGGACTTC | 42244 |
| 8619 CGCCAATGGCTCTCCTCACTT | 20277 CAGCTCATTTCCCTACAGGAACAGT | 31261 TTTGTGGGCCACGCCAATG | 42245 |
| 8620 CTTCCCAGACATATTGCAAAGACACA | 20278 AGTGCTGGGTGGCCTTCCTA | 31262 TCAGCAGCTCTTCCCAGCAT | 42246 |
| 8621 GAACCTGTGTGGACCTGATCAAAC | 20279 CCTGGTCCACTAAGTGCTCTTCT | 31263 GTCTGTTCCCCTTGAACCTGTGT | 42247 |
| 8622 GCTGTGGTTTGGGCTGAAGAATTT | 20280 GGGAGCATCAGCCATCCATCAT | 31264 GTCTTAAGGCAGCTGTGGTTTG | 42248 |
| 8623 GCTCAAGGGTTGGACTCCATGT | 20281 CTCGAAACTCATTCATCTTCCTGTGTAAG | 31265 GAAAATCTGGGGCTCTGCTCAA | 42249 |
| 8624 GGGATGTGGTGGGAATCACCAT | 20282 TCAGTGCTACCATCAGGGATATGA | 31266 GGCAAGGTGAATGGGGATGT | 42250 |
| 8625 CAGAAACTACCAGGTGCTTCATGGTT | 20283 CCTCGCTGGAAGACGGGAAA | 31267 CCGCCCTTTCCGTATCAGAAACT | 42251 |
| 8626 GGCCTCATCTTCCCAGTCTT | 20284 GCAGTGCCTCTGCTCCAA | 31268 AAGTGGCAGGCCTCATCTTC | 42252 |
| 8627 GTCAGGGGCATCTTAGTTTTCTGTA | 20285 GGCATAAAAGAGGATCACGTTCACA | 31269 GGGACAAGTCAGGGGCATCTTA | 42253 |
| 8628 ACTCTCCTTTACTGGATCTTCCTACT | 20286 TGAGCCTAGTGGAGGTCACTT | 31270 GAGACAGAAAAACTAAGACTCACTCTCCTT | 42254 |
| 8629 CCTTGGAGTCACCCCTAGATTCTTC | 20287 CCACAATAATTGGTGACTGACTTGCTA | 31271 GCCCAAAACATACCTTGGAGTCA | 42255 |
| 8630 AGCCCCTGATGTACCTTTCTGT | 20288 TGCCTAGTGGTTCACGAGTTAGA | 31272 AGAGTGCCAGCCCCTGATGTA | 42256 |
| 8631 CTAGTCCATGGATACTGGCATTTCT | 20289 GGGTTCCTGACCTGCAAATCTCT | 31273 GCCCAAGGAGGGTAACTAGTCCAT | 42257 |
| 8632 GCCAGCATGGTTGGCTTTTG | 20290 GCAAGAAAGCATCCATCCATCTACA | 31274 GAAGACCAAGGTGCCAGCAT | 42258 |
| 8633 GGCCACCTTAGAGGTTTGTTTGT | 20291 CTGTAGCTTTCCTGTGACTGGTTTC | 31275 CTGGTCCTATGGCCACCTTAGA | 42259 |
| 8634 GGGGAGGGTCAACTGTCCTCTA | 20292 GGGGCAGAGGGACTAAGGTAA | 31276 AGTGCTCTATGGGAGGGTCAAC | 42260 |
| 8635 CCAACCCATTCCAAGGCAGTCA | 20293 CTCCTCCAACCTTAACACCTAGATATG | 31277 ACAGCAGCTCCAACCCATTC | 42261 |
| 8636 TGAATCCTAGAGAGCGGAACTTTG | 20294 CAGCTCCCCTCAAAGTCAGATAG | 31278 CCGCGGTGTAAGGACTGAAT | 42262 |
| 8637 GTGTTACCTGTCATTTCCTACCCTTAG | 20295 GCAAAGGAGACCATCTTCATTCCAA | 31279 CCAGTCACTTCTGTGTTACCTGTCA | 42263 |
| 8638 ATTCCCCTGTGCCGGGACTTC | 20296 CGCAAAGGCCCAGGAAAAGACA | 31280 GGGCCTGATGTCCATGATGATTC | 42264 |
| 8639 GCAATGGCTAGCTCTTAGCTATTCTA | 20297 GGGCGGGCTTATTACCTTCTTG | 31281 GTGTTTTAGATGGGCTACAGCAATG | 42265 |
| 8640 GCCATGTGCCTTTGGTCATGAGA | 20298 GTGTAGGACTCAGCCATGTTCA | 31282 GTGGAATGCCATGTGCCTTTG | 42266 |
| 8641 GACAAGCCTCTTCACGATGAAACA | 20299 GAAGCCCAGCAAGTGGATCA | 31283 GCTGGACGAAGACAAGCCTCTT | 42267 |
| 8642 GGATATTTGTACGGGGACCTCCTATAC | 20300 AGGAGGTGCTTGTATTGACACTTG | 31284 TGTCCGACTACACTTGGATATTGT | 42268 |

FIG. 36N3

| | | | |
|---|---|---|---|
| 8643 TTGACCTCTGCCTGCCATTC | 20301 CCACGGAGCAGCTGGAACA | 31285 GGTCGGGCTAGTGGATAGTCTTTG | 42269 |
| 8644 TGTGGGCAGGCCTCTTAGAT | 20302 CGGTACCCCAGGTTCTTCTGT | 31286 TGACGTGGGATGAGGGATGT | 42270 |
| 8645 CAGCTCCTTCCCCTTAAGAAGTAAATCA | 20303 AGCCAGCACTAGCCTCTTATGT | 31287 TCTTGAACAGCTCCTTCCCCTTA | 42271 |
| 8646 GCCCTTAGAACACAGGATCCAGAAG | 20304 GGGACTCTCCCTTGACCTTGAA | 31288 GGTTCCAAGTTTGAAAGCCCTTAG | 42272 |
| 8647 CCAAGTCTGTCGTGCAAAAATTCTAAC | 20305 CAGGAGTAGAGTAGGAAGGCTGTA | 31289 TCTCCAAGTCTGTCGTGCAAA | 42273 |
| 8648 GACTAGGAAGCTAAAGAATCAGTGAGAGT | 20306 CCAGCTGTGACGCATGGATGA | 31290 GGTGCTTGACTAGGAAGCTAAAGAATC | 42274 |
| 8649 GACGGGTGACTAAGTCTCACAGTTG | 20307 GGATGTCTGGGGAAGAAGATGACT | 31291 GGGCTGAAGACGGGTGACTAA | 42275 |
| 8650 CCCTGGAAAGACTGATTGGCATT | 20308 TCCTGGGGCCCGACTCATAG | 31292 GGATGTGGAACTCAACCCTGGAA | 42276 |
| 8651 CCGGATTCACGAGTGCCTAA | 20309 GCCCCTTGTCACTCAGTCAAAAAC | 31293 CACACTTCGCTTCCGGATTCA | 42277 |
| 8652 GGGAATTGGCATTTCTGGCAACA | 20310 GCAATCCAAGAGGTTAGTGACTGTTC | 31294 CCAGAAAGCAGAAGGGAATTGGCATT | 42278 |
| 8653 CCCCTTCCATTTTCCCTTTCCTT | 20311 AGCCAGTCCCACGTCACATAG | 31295 CTCCAAATATGACTTCCCCTTCCAT | 42279 |
| 8654 TCGCCATCTACCCAGAAAAGATTTA | 20312 AACTGAAAAAGGGTTCCCTCACTT | 31296 CCTCTGGCAGTTCGCCATCTA | 42280 |
| 8655 TGCGACAAGGCTCTCTGACT | 20313 GCCCCTGGACCATAACCAAAGT | 31297 GGTTAGCAAGCCTGCGACAA | 42281 |
| 8656 GGGCGACCATAAATTGCCCTGAA | 20314 CGGCCATAGCCCACAGGAA | 31298 GCTGCTGGGCGACCATAAAT | 42282 |
| 8657 GCCTAGACCCAGAGGCAATTCT | 20315 TCAGGGCCTGTAATGTGCTATG | 31299 GAGTATGATGCTCCCAAGCCTAGA | 42283 |
| 8658 CCAGTGAAGGTTTCTGACATGACCATA | 20316 ATCCATCTTCCACAATGTCACCATA | 31300 GGAGCCAGTGAAGGTTTCTGA | 42284 |
| 8659 GCCAGGATGTACGGCGTGTAA | 20317 GCTGGGCTGCAGGTATGAATCT | 31301 CCCCTACCAAGCCAGGATGTA | 42285 |
| 8660 TGTTCTGTCTGGCTGGCATTC | 20318 GAGCTAGCTGCAGGAGTTGTT | 31302 ACAAGGGAGTGAAATGTTCTGTCT | 42286 |
| 8661 CCTGGCTGATACCTTGGCTTT | 20319 TGGGATAGCATGGCTGGATTATCT | 31303 AACCACAGGCCTGGCTGATA | 42287 |
| 8662 CAACCAGTCTGGGGTAGAGCAA | 20320 GATCCAACAGCCACTAAGTGAAAC | 31304 ACTGCAACCCCAACCAGTCT | 42288 |
| 8663 GGACCGAAGAATGTTTTGAACTACACCATA | 20321 TCCCACGGTCTAGATTTTGTTGAT | 31305 GCATAGAGGACCGAAGAATGTTTTGAAC | 42289 |
| 8664 GAGGGTTCAGTTAGCCTGAGTATC | 20322 GCATGTTGGGAGCAGAACCAA | 31306 CAGGTGAGAGGAGGGTTCAGTTAG | 42290 |
| 8665 GCATTAGTGAGTGTGAGCTATGGTTAG | 20323 AGGCTGCCAGATCAGTGGTTTC | 31307 ACAGGTCCTGACAGCATTAGTGA | 42291 |
| 8666 GCAGGGACCCTATTGTAACAAGACA | 20324 CTCTCATCAACTCACAATGGCGTTTT | 31308 GTGAGAAAAGCAGGGACCCTATTG | 42292 |
| 8667 CCACAGGGACTGATTCAGCAGTGA | 20325 TCCAGCAGACCCAGGGTGTAA | 31309 TGGCTCCACAGGGACTGATT | 42293 |
| 8668 GGGGAGAGACAGGATCAACCAGTA | 20326 GACAATGGACACACACTCCAGTT | 31310 ATGGAATGGGGAGAGACAGGAT | 42294 |
| 8669 CCCCAGGTATTCTCAGCTTCAATG | 20327 AGAGGTTTGCACTTCAGAGACATC | 31311 GAGTCCTTACCCCAGGTATTCTCA | 42295 |
| 8670 TTCCAAAGCCTGCGGAATTCTA | 20328 GCTGCCTGGAGACAGTGCATAG | 31312 GCACCAGGCTTCTCAGCATT | 42296 |
| 8671 GGGGAACAATCAGTGGTCACTATATTTGCAT | 20329 CCTCTGTTGTTGAAGCTTTGAGAATAC | 31313 CTAACCTCTCTTTGCTGGGAACA | 42297 |
| 8672 CACTGCTCAGATCACCCTTAAAGA | 20330 GGAAGCTGCCAGTCTACTGTGT | 31314 TGGAGGTGCACTGCTCAGAT | 42298 |
| 8673 CCAGTTTAACTTTGAATGCTCAACGCTTCT | 20331 AGGTACAAACACCAACCTCACAT | 31315 GTCCATTGAGTCAAAATTCCCAGTT | 42299 |
| 8674 CCACCCTGTAAAAGCAGGAAGA | 20332 TGTCTTCACACTTTAGGGAGCTTT | 31316 GACTGACCTTGCCACCCTGTAA | 42300 |
| 8675 CGTAAGTCCTTTGTGGCCTCCAATA | 20333 AGCTTTACCCCTCCTCTGACA | 31317 CATTGCACCCGTAAGTCCTTTG | 42301 |
| 8676 GGTGGAGGAATGCTCTGCTAAA | 20334 CCTAGGAAGAGGAACAGATTTGGTAAG | 31318 GGTTCCAGTATGGTGGAGGAATG | 42302 |
| 8677 GGTGATTGCTGCAGATGGGCTAAG | 20335 CCCAAGAAAGGTCTGTTCTGACTGTA | 31319 GTGCGAGGAAATAGGGGTGATTG | 42303 |
| 8678 GCAGCATTAACATTGCTGAACGTTTCT | 20336 AGCTCAGATCCACCCCAGCAT | 31320 TGACCAGAAAGATTGGCAGCATT | 42304 |
| 8679 GAGCAACACTGATGGAGAAGAAAGAAATGT | 20337 CTGTGTCTGTTGGATGCGTAGTGA | 31321 CTTTGAGCAACACTGATGGAGAAGA | 42305 |
| 8680 GGCTGTGCTAGACAGGTTGAAG | 20338 GGGTCCACTGTAGTTCATTTCCCTAA | 31322 AGGTGACTGGCTGTGCTAGA | 42306 |
| 8681 CACATGAGTGAGCCTGAAAGTGGATA | 20339 ACTGGGGCTGCAGTTACCTA | 31323 CAGCCAACAGCCACATGAGT | 42307 |
| 8682 CTGGTGCTCTCCATGCACTCATT | 20340 GGCCCTTTACCCCACCCTGTA | 31324 TTCAGGGCTGGTGCTCTCCAT | 42308 |
| 8683 GAGGGTTTATTCACCATCCATCACA | 20341 CCAATTGGAGGAAGGATGACCTATC | 31325 CAGTTGCTATACCAAGAGGGTTTATTC | 42309 |
| 8684 CTGGAGTCTGAAGTCCCCTGAATC | 20342 GTCATCCGTCTTCTCTCACCCTTA | 31326 GCCAGTGTAAGTCCTGGAGTCT | 42310 |
| 8685 GTTCTGGCCACTCTTTCTCTGT | 20343 GTCTGTCTGCCAAATCTATGCAGTTTC | 31327 TCTTTTTGGGCGCTGTGTTCT | 42311 |
| 8686 CCTGGAAAATTTCTTCTCCAGTCCCAAA | 20344 GCTTAGCGGAGGTTCCCTGAAT | 31328 TGAGTGACCGAGAGCCTGGAA | 42312 |
| 8687 GCCATGCTTTGTAGTTATGGGAGAGA | 20345 AGGCCCAGGAGTGGACCTA | 31329 CCTCACACTGGTAGCCATGCTTT | 42313 |
| 8688 CTGAATCTACTCAGCTCCATTGACAAG | 20346 GTGTTCTGTTGAACCATTGGGTATGT | 31330 GACAGAGCATCCCCTTATCTGAATC | 42314 |
| 8689 GCATGGAGTATATTGCTGCTGAAAG | 20347 GGGTCAGAGAGCTCAACTTGGAA | 31331 GGGAACAGATAGGTAGCATGGAGTA | 42315 |
| 8690 GGTCAGAGAGAGAACAAACACTTCCTT | 20348 GGCTCTAACAGCTTTTGTCATGTTT | 31332 GCACAGCACTTAGGTCAGAGAGAGA | 42316 |
| 8691 CTTCCAAGCCAGTCCACCAACA | 20349 GCTGAAAGTTAAAGGAACTGGTGGATTC | 31333 GCTTCCAAACTGAACTGCTTCCAA | 42317 |
| 8692 GGTCGTGTTTGGAAGAGACACACA | 20350 TCTGCTCTTGTACTGTTCTGCTATT | 31334 GCAAATGAGGTCGTGTTTGGAA | 42318 |
| 8693 AGCTCCATAGCAACCTCTCTGAA | 20351 GGACACTGTTTGCTTTGTGTGAGTAAA | 31335 GCCAGGCACAGATAGCTCCATA | 42319 |
| 8694 ACCCTTCCTTGCAAGACATTGAT | 20352 GGAGAGTGTCCCAGACTGATCT | 31336 TTCCCAAATCAAGAACCCTTCCTT | 42320 |
| 8695 GGGAGAATAGCAAGTCTGGTAGCAAAG | 20353 CCACGCCGAGCTGTGAAATAGT | 31337 AGCATGAATGGGAGAATAGCAAGT | 42321 |
| 8696 GGATCTGTGGCTGTTTTCAAGAAG | 20354 TCTTCTCCCTGTCCTGTCTTTCT | 31338 GCAAAGCTGGATCTGTGGCTGTT | 42322 |
| 8697 AGGGCTATTTCATAGGCTTGGATTC | 20355 GCCTGTGGACACAGCTTTGTTTCT | 31339 CAGAAAGGTCTGCTTAAGGGCTAT | 42323 |
| 8698 GAGACAGCAGGTATTTGTTCAGTTG | 20356 CGGCTACTTCCTTTTGCCTTAAAA | 31340 GGAGGTATTCAATGAGACAGCAGGTAT | 42324 |
| 8699 CCCTGGCTCTGAGCTCATTTCA | 20357 GTCTAGGCCACGAGGTCTTCAA | 31341 CCAGTTCCCTGGCTCTGA | 42325 |
| 8700 GCTCTCCATAGCCTCATTTCCCACTA | 20358 CCATAGTCCAGTGTGGCTGCAT | 31342 TTCTCTAGCACAAAGCTCTCCATAG | 42326 |
| 8701 GCAACAACCTTGTGTAAATCCCTTCA | 20359 AAAATTCAGGCTGACAGGTAAGCTA | 31343 GTAACTCTGCAACAACCTTGTGTAA | 42327 |
| 8702 CTCAAGCGATCCTCCCTCTCTTTG | 20360 GCATGGTGGTGTGCATCTGT | 31344 CCTCCAACTCCTGGGCTCAA | 42328 |
| 8703 TGGTTTGCACTTCACTCGTTTC | 20361 GCAGGCTAGAAGGGCAAAGGGATA | 31345 GCATCTGCCCTACATTCTATGGTTT | 42329 |
| 8704 GCTTTTGCACCATTGTGAAGTTG | 20362 CCTGTCTACAAATGGTCCCTGACT | 31346 TGCTTGTTGCTTTTGCACCAT | 42330 |
| 8705 CTGAACCGTCTGTGGGAAAGTTCT | 20363 CACATTGTTACCCTATAACGGTGTTGT | 31347 AAGGTAAAACTCTGAACCGTCTGT | 42331 |
| 8706 CTCCCATAGGCACATCAATTCTGA | 20364 GGAAATAGCTGGGTGTTGCTACTAAG | 31348 CCTGCTATTCCTCCCATAGGCACAT | 42332 |
| 8707 CTGTTCAGAATCAGGACTGACTACTCTCT | 20365 CTGAAGTTGGTATCCCTTTAGCTTCAAAC | 31349 TCCACAGTGGCTGTTCAGAATC | 42333 |

FIG. 36N4

| | | | |
|---|---|---|---|
| 8708 CCCTTAGTTGTGAAGGATGGTTCT | 20366 TCCTCCTTGGCCCAATCAAAG | 31350 GTCCTCTTGTTTTCCCTTAGTTGTGAAG | 42334 |
| 8709 GCTGGCATCTACTGGCACACA | 20367 ATTGGCTAAGCAGGCCAATCT | 31351 TGTTACTACTTCAGCTGGCATCTAC | 42335 |
| 8710 GGACTGTGTCGGTGGTTTGA | 20368 ACCTGGTGTTCTAGTCTACTGTGA | 31352 GGAAAGAGTGGGAAGGACTGTGT | 42336 |
| 8711 CAGTAAGTTCTGAGGTCCTGTGTT | 20369 ACTTGGGGAACAGAAAGATGTCAA | 31353 GGCAGTAATGGGCAGTAAGTTCT | 42337 |
| 8712 GAGGAAAGGGTGGCCATCATCA | 20370 CCACCAGGAGCTCAGTTGTGTT | 31354 CGACTACCAAGTTTCTGGAGGAAAG | 42338 |
| 8713 GCTGCACAGGATTTTCCACAATG | 20371 GTGGTTACTGCATCGGACAGT | 31355 AGGGCTGCTGCACAGGATTT | 42339 |
| 8714 TTGCCTGGGCTTTTGAGGTATT | 20372 GGGAAATGCTTCGGGACCTT | 31356 GCTTTTGTTGCCTGGGCTTT | 42340 |
| 8715 CTGCTCTTTGCTCCGTGACA | 20373 CTTTGGGCTGGTTGGTCTGA | 31357 TCCCCTGTCCTCCTGCTCTT | 42341 |
| 8716 TCAGACTGGCCTTCGAGACA | 20374 AGTGATGGCTCCTGCCCAAAC | 31358 ACAGGCCAAGCCTGCTCAGA | 42342 |
| 8717 GGACCCCAGTCACTGCATTTCA | 20375 GCCCTCCCAGGCTAAGAATATC | 31359 CACATTTGGAAAGGACCCCAGTCA | 42343 |
| 8718 GCAGATCTTGGAGATGACCCATAATTC | 20376 CCTAAGCCTTCTGCAGCTGAAAT | 31360 CCTCCGCAGATCTTGGAGATGA | 42344 |
| 8719 GCAAAGAGCCAACTTCTGATCTGT | 20377 GTGAAGCAGCTGGAAGTCTCT | 31361 GGCAAACCAATAGCAAAGAGCCAACT | 42345 |
| 8720 AGGTAAGGAGGGCAGTTTCTATGA | 20378 ACTGCCTCCCATTTCCATTTTCT | 31362 TGCAAACAACCCAGGAAGGTAAG | 42346 |
| 8721 CGTGGTAACACCGCACTCAAG | 20379 CTTCACTACGTAGATGCCATCCTATT | 31363 TTGTGGCGGCGACGTGGTA | 42347 |
| 8722 GGGTCCAAAGGACATTTCAGACTA | 20380 GACCCTCTGTGTCTTTGTGCAT | 31364 TGACCTGAGAGAGGGTCCAAAG | 42348 |
| 8723 AGGGCTGTGTGAGGTTCCAT | 20381 AGCTGCCTCCCAGAGAAGAT | 31365 GATGGCATTATATCAGGGCTGTGT | 42349 |
| 8724 GCCTTGAAGTTGCCTTCAAAACACT | 20382 AGTCGCTGTGGGGAAAGGAA | 31366 TGCCCCTAGCCTTGAAGTTG | 42350 |
| 8725 GCCTGACCAATTCTGTGGCTCTT | 20383 GGCTTCACGGCTGAAAGGAT | 31367 CCACCGTGCCTGACCAATTCT | 42351 |
| 8726 GGTCTCATCTCACTGTGTCTCAAC | 20384 TGGCAAGGCATCCCCAAGA | 31368 CGCTTTCCCAATGTACCAGGTCTCA | 42352 |
| 8727 CGGGCAATGGATAACCAAGTTTTCTTC | 20385 GTTTCTGCCAGTTAGGAGCTAGT | 31369 GCTCTAATAGCTACGGGCAATGGAT | 42353 |
| 8728 GTGTCATCCCACATTGAGTGAAAACT | 20386 GGACTCCAGAAGCTTCAGACAAC | 31370 GGTTTGACCCTCAACATGTGTCAT | 42354 |
| 8729 CCCTCGTCAGCTTTTCCACTCT | 20387 GGCAACAGAACAAGACCTGGTGAA | 31371 GTCGAATCTACCCTCGTCAGCTT | 42355 |
| 8730 CTTGGTCCTTGGTGCCTTATTTAGT | 20388 GCACGAAGACCATTTAGGAAAACA | 31372 TCTCTCCAGGCTTGGTCCTT | 42356 |
| 8731 CGTGGGCCTAAGTTTTCAACTCATT | 20389 CTATAACTTCCAGTAACTGTGCTCCTT | 31373 TGTGTAGAATTTTACGTGGGCCTAA | 42357 |
| 8732 TGGAGACCCATGCTGTCAGGAA | 20390 CCCCACCTAGCCACTCTCTAC | 31374 GTGTCTGGGGTAGTCACAGATG | 42358 |
| 8733 CCAAGGAGGCTGAATGAAGTGAT | 20391 GGGGAGGGAAGAAGAAGCATAATGTCA | 31375 CATACCAACCAAGGAGGCTGAA | 42359 |
| 8734 TGAAGAACCATTGCTGTCCTGAT | 20392 GGACCTGCTCCTTTCTGTCCAA | 31376 GCAACTATCAGGGTGAAGAACCATTG | 42360 |
| 8735 TCCATCCACCTCGGTCTCCAAA | 20393 GCCACCTTTCAGGACTTGCTAA | 31377 CTCCTGGACTCAAGCAATCCAT | 42361 |
| 8736 AGGGTCATTTTCTGGCCTTTGA | 20394 CCGTTTCAGGCCATAGCTCACA | 31378 TTCCTTCAAAGCAGAGGGTCATT | 42362 |
| 8737 GTGTTCTGGACACGGACGTAAG | 20395 CTGGTTCTCAGGTCCTGCCTTT | 31379 TGCCCCAAGCCTAGTGTTCT | 42363 |
| 8738 GTGGATCTTTGCTCTTGGTGAAGATGTA | 20396 TCCAGGGCAGTGCCTCCTTT | 31380 GGCATTTTGACTGTGGATCTTTGCTCTTG | 42364 |
| 8739 TTGGGGCATGCCGTCACT | 20397 GCTTTCCTTTTAGTCCGCCTTAAGATT | 31381 CTTGGCTGCTTTTGGCAAGT | 42365 |
| 8740 GACAAGGTGGTCCTCAGATAGATTACA | 20398 TTCTCTGGCCAGCCTTTAAGTTT | 31382 ATCTACCTGCCCTGAAAGACAAG | 42366 |
| 8741 AGTGTGCTAACTTGGCTGCAA | 20399 CTCAAGGCCAGTCAGCTCTGT | 31383 GCACGGCTGGGTGGAAATAAGT | 42367 |
| 8742 GGCAGTGGACTTAAAAATATGGGGAAGAT | 20400 CTGTTCATGGCATCCCCTAATGT | 31384 GCATGAAGGTGGCAGTGGACTT | 42368 |
| 8743 GCCAAAGGTTGTCTAACTGGTAGT | 20401 CAGCCTAGTGTTTTGTGACCATCTGT | 31385 GGAAAGATTTGCCAAAGGTTGTCTA | 42369 |
| 8744 CCTGCACCGTGCCTTCTCATT | 20402 GCCAAACAAAGGGAGCACTGGTT | 31386 GGCTTCTGTGCACCCTGAA | 42370 |
| 8745 CTGGAATCAGCTGCTGTGGTATG | 20403 ACTGCAGCAACTATGCATCACA | 31387 GTGTTGGGAGCTCTGGAATCA | 42371 |
| 8746 GCAGCTACACATCCCCTTCTCT | 20404 GGCTTCTCTCCCTACCCCAGATT | 31388 GCCAGCAAGCAGCTACACAT | 42372 |
| 8747 CCTCTCCATTTCTGGGCTCCTT | 20405 AATGGGGAAGGGCTGTGAGTAG | 31389 CACCGCTATCTCCTCTCCATTTC | 42373 |
| 8748 GCAGGAGTCAGAAAAGTAACACAAA | 20406 CTTCCCTATCCAGCTGGTCACT | 31390 CCAGAGGAATGCAGGAGTCAGA | 42374 |
| 8749 GTGAAGGGGCTGAGTCAAAATGAAC | 20407 GCAGCAGGTGATAATGCAGAATTG | 31391 ACTCTGTGAAGGGGCTGAGT | 42375 |
| 8750 CAGTGGTTTTCAGGAGCCCTAATC | 20408 ATCTGTCCGCAGAGGGCTTT | 31392 GGGTGAGATAAACTGTTTCAGTGGTTTTC | 42376 |
| 8751 GTGTCATTTGCTCGTTTGCCTTT | 20409 GGAATCCCATGTAAGGTACTTGCTGTT | 31393 AAAAGCTCCTGGCTGTGTCAT | 42377 |
| 8752 GGTGGGGCACAAATTCAGTTAC | 20410 GTGGGCTTAGATTTGGGATATTGGTA | 31394 GGAGGTAGGTGGGGCACAAA | 42378 |
| 8753 GCACTTTACACATCCTGATGTCTTT | 20411 AGTGGGGTTTTGCAGCCTATC | 31395 GGATCCCAAAGCACTTTACACATC | 42379 |
| 8754 CCAGGCTTTGGGAACCAT | 20412 CCTGGAAAACACCACGCTCTT | 31396 GCTAAACAGCATTCCAGGCTTTG | 42380 |
| 8755 GCCTGACATTTTTCCTAGAGGGAGAT | 20413 GAGAAGACGACCAGGTCATTTGCTTTG | 31397 CTGAACACAAACCTGCCTGACA | 42381 |
| 8756 AGAAGGGAACTCAGAGGTTACCAA | 20414 GCAGGGCATGACTGACTTCT | 31398 CCAATGTCAGAACTAGAAGGGAACT | 42382 |
| 8757 GGCTTCAGCAGGGTCAGACT | 20415 GTGTCCATGCCTCTAGGACATCAT | 31399 TGTAGAGTCCCTCTGGGCTTCA | 42383 |
| 8758 CCCACTACACCATGAGCTCTTCT | 20416 CCAGTAGTGCAGTTCCAGTCTGAGT | 31400 CCTTCTCCTACCCTCCCACTACA | 42384 |
| 8759 CCATGTGAAAAACTGCTTCCCTTCT | 20417 GCACTAACCCTCCTGCCAGAGAAA | 31401 GTGACTCTGCTTTCCACCATGT | 42385 |
| 8760 GCTCAGGGGTTTAGCCTTCTTTG | 20418 CTCCACCATCAAGACCGTTTCT | 31402 TTGGCAGCTCAGGGGTTAG | 42386 |
| 8761 CAAGAAGGAAGCCAAGTTTGGTTATG | 20419 GGGCAGGGGATGGATAGGAGAAA | 31403 TTGAGGGCCTTTGCTCAAGAA | 42387 |
| 8762 CACAGTCCTGATGGTTGTCATGGTT | 20420 CCTGTTTCTCATGCATACTTAGCCATGTT | 31404 GGCGTCACACTCCTGATGGTT | 42388 |
| 8763 CAGAAGACAAGATCTCTCCCAGATG | 20421 CTCCTGACCAGAAATAACGGCTGGAA | 31405 CTGCTTGCCACAGAAGACA | 42389 |
| 8764 GTCTCCTTTGACACTGGCCAAAA | 20422 AGCTTGAAGTAAGCCCCTTCATC | 31406 GCCCAGGGCTGTCTCCTTT | 42390 |
| 8765 TCAACACACATGGGGTTCCAT | 20423 CCTTAGTCAATCCAATGGGAAAGCTA | 31407 CCTCTTGGAACATACCTAAATCAACACACA | 42391 |
| 8766 GGACCTAGTCTTATTGGACTGGGAAT | 20424 GGAGCTGGTAGAGCCAGAATTCAA | 31408 GACTTCCTAAGAGCAAGGACCTAGT | 42392 |
| 8767 CGCCCGGCCTTATATAGTATTTTCACT | 20425 AAGACTGCCAGGTGGAGGTT | 31409 CGCGCCCGGCCTTATATAGT | 42393 |
| 8768 CTCTGGCCTTTTTAGTTTACAGAGTTC | 20426 GAAACACCATCCCACACAGATGA | 31410 AAGACCCTCTGGCCTTTTTAGTTT | 42394 |
| 8769 TGCTCATTCACTTGGGATTTGGAA | 20427 GAGAAGCCTTTTGAATGCTGTTACTGT | 31411 GTGGGTTTTCCCATGCTCATTC | 42395 |
| 8770 CCATCACCTGCAATGCCCATTAGT | 20428 GTGAGGAGTTGTTTGTGAGCTTTAG | 31412 CGGTCTTCCCATCACCTGCAAT | 42396 |
| 8771 GGCACTGGGGATTACTAGAGGAATAA | 20429 CCAACAGGTAGTTTTCCAGCTCTT | 31413 GGAACAGTAGGCACTGGGGATT | 42397 |
| 8772 TCTCTCTTCAGCCGAGATGTAATTG | 20430 GGCAGAGTAGCATTTCTGCAAAC | 31414 ACCTCACCGTACTTGTTCTCTCT | 42398 |

FIG. 36N5

| | | | |
|---|---|---|---|
| 8773 AGGTGTGTTGGAGAGGAAAAACAA | 20431 TTGCAAGCCACTTATCAGGAAGT | 31415 GTCATGTCCCTCAGGTGTGTTG | 42399 |
| 8774 GGCCCCACAAACCTTCTTTTCT | 20432 GTAAGCTGCTGAAACTGATGGTAAG | 31416 ACAGAGGACTGGCCCCACAAA | 42400 |
| 8775 GGCTTGTGTCACGAAGGGAAA | 20433 GCTGGCCCAGGAAAGAAGAGTT | 31417 GTTCCATCAGATTGGCTTGTGTCA | 42401 |
| 8776 GCACAAGACTCACAACCTCTGT | 20434 TCATCCTCAAAGGGTCCTTTTTCA | 31418 GGCAGCACATTGCACAAGACT | 42402 |
| 8777 GGCCTCAGATATTTTTGGACGCAAT | 20435 CCCTCCAGTATCACAGTCTTCCTTTTG | 31419 GTCCTCCAGGGCCTCAGATATT | 42403 |
| 8778 GCCCTCTAGTTCTCAGTTTGACAGA | 20436 ACTGAGCACTGACCTGAATGAAT | 31420 CTGGCTTGACTTTCTGCCCTCTA | 42404 |
| 8779 GTCCCAGAAGTGGCACAGATCA | 20437 CATAGGTACATGCACTTGGCTAAAG | 31421 CCTCTTAAGGCCTTGTCCCAGAAG | 42405 |
| 8780 AGATGGGAACTAGCCTGGTATGT | 20438 CCCTGCAGCCTCATTTCTTACT | 31422 AGGCCCCGAGATGGGAACTA | 42406 |
| 8781 GCCGTGGGATCTTGACTGCAATTT | 20439 TGCAGGGCCTGGGTATAACT | 31423 TCCTCTTGCCGTGGGATCTT | 42407 |
| 8782 GTCCCTTCGTTTGTCACCTTCT | 20440 ACAGAGAGCCAGCGAGATATTTTT | 31424 GATGGAGTTTGTCCCTTCGTTTG | 42408 |
| 8783 GGAGCTGAAAAACAATTACTGAACCCGTTA | 20441 GCAGCAAATTGCAGAGAACATC | 31425 CCATCAGTGGGAGCTGAAAAACA | 42409 |
| 8784 GCCTGATCTATTAGAGGAGCAGAGATGT | 20442 GGAGGCCATGGAACATGTAGAAC | 31426 ACCTGCATCTGTGCCTGATCT | 42410 |
| 8785 GCCATCTGGGGAAAACTGGAGAAC | 20443 GCATAATGGAGAGGGAAACTTGTGAT | 31427 CCTGCTGCCATCTGGGGAAAA | 42411 |
| 8786 CTGCAAAGGTCAGAGCTGTTTGTTG | 20444 CCCTAAAGTGCTTGCTTTTGTCTAC | 31428 TGCCTCCTGCAAAGGTCAGA | 42412 |
| 8787 GAGCTGGCCTTTGTGAGTCTCT | 20445 GGAAATCATGTGGCGTCCCTTCT | 31429 CCCTCCAAATCTGAGCTGGCCTTT | 42413 |
| 8788 GTGCTGAAAGCAAGGCGAGAAG | 20446 AGACCGTCCTCCTCTTAATGGAA | 31430 TGGGCTGCGAGTGCTGAAA | 42414 |
| 8789 CTGGAAAACAGGCAGAGCAAAGA | 20447 TCCCTTCGCCTGAGCTCCTT | 31431 CAGGACCCAAGCTGTCTGGAAA | 42415 |
| 8790 TCCAGTATACAGAAGCAGCGTTT | 20448 CGACTACTCCCCGTGTCTTTC | 31432 TTCTGCCCTACCCAGAGCAT | 42416 |
| 8791 CCAGATATACCGATCACTGGGTATCAGTTC | 20449 GCCTCATCCAAAGTCATGCTCCAT | 31433 TCATACACCCAGATATACCGATCACT | 42417 |
| 8792 GCAGGCCCACCTTCTCATGAAT | 20450 GCCAGCTCACAAAATAACTCTGTTC | 31434 ACTCAGCAGGCCCACCTT | 42418 |
| 8793 CCTCTCCAACTTAAACCCTTGATTTC | 20451 GAAACGTTTTGTGGGGAATTAGGAA | 31435 GGGGAAGGTTTATTTCCTCTCCAACT | 42419 |
| 8794 TCCCCAGACTGTGGTGATTTTC | 20452 GGTGGCAGGAAACTTAAGGCCAAT | 31436 ATTCCCTGTCCCCAGACTGT | 42420 |
| 8795 TGGAGGAGGAGGAGGTATTTTGGTT | 20453 GGAGAAACCAGCACAAAGAGGCTAA | 31437 GGCGAGGTGTTGTGATCCTTTG | 42421 |
| 8796 GGACTCTGGGACATTGGGAACTGT | 20454 GCAGGGAAGTCCTAGTTGCACTCT | 31438 TGAACGAGGACTCTGGGACAT | 42422 |
| 8797 CCAGATGTTTTGGTCTGTGCAGTA | 20455 CGGATTATTTAGCAGTTGGGTAAGAAG | 31439 TTTGGAGGCAACCAGATGTTTTG | 42423 |
| 8798 GGCGAGAGTAAGAGCCAGTAAG | 20456 GCTTCCTTTTCCTTCGGCATTAG | 31440 GATGGTTGAGATGGCGAGAGT | 42424 |
| 8799 CCCTTTATCCACTAGATTCTATCCCTACT | 20457 GGGATGAATTGCTGGGATGATGTTC | 31441 GCCAACCCTTCCCTTTATCCACTA | 42425 |
| 8800 CCTTGCCATATTCCCATTCATGCTGTAG | 20458 GCATCAGCCAGTAAAGGAACTAGAA | 31442 TGAAAGCCTTGCCATATTCCCATT | 42426 |
| 8801 CCAGTGAACAAGGTGAGGTGTAG | 20459 GTGCCTTGTGACTGGGATACATTC | 31443 GGGGTTGAACACTTCCAGTGA | 42427 |
| 8802 AAAGTCCCTGATGAAGTGCTGTT | 20460 GAAGGGAGGAAAATGGAGAGGAATC | 31444 CTGGCTGATGAAAAGTCCCTGATG | 42428 |
| 8803 CCAACACCTCAGGCTACCTTCT | 20461 TGTTATCCCCAGGTTCCAGTCT | 31445 GGCTCCTCAAGATTGACTCCAACA | 42429 |
| 8804 AGTTGCCCTGAATTCTTGTGTGA | 20462 CTTTGGATACCAGAACCCCACTTC | 31446 CACCTGCTTTTCTATAGTTGCCCTGAA | 42430 |
| 8805 GCTATCAAAGGCCTGACAACAAG | 20463 AGCAAGGAAATGTGGCTCAAAAG | 31447 CAAAACTGACGCCAAAGCTATCAAAG | 42431 |
| 8806 TGGCCTAAGGAGGGGTGAATC | 20464 CCAGCACAGTAGTTTTTGGTCTGCTT | 31448 GGGGACTACCAGGTGGCCTAA | 42432 |
| 8807 GCCCTGCTTAGATCCACTTTGT | 20465 GCAAGGGTCCATCTCAAGAACACAT | 31449 CCTCCTCTGCCCTGCTTAGAT | 42433 |
| 8808 GCTGGTACAGCTGATAGAGAGACTA | 20466 CCCCTATCCAGCAGGAATGGTTTC | 31450 GGACTAGGTGTATGTAGCTGGTA | 42434 |
| 8809 GGTGTCAAACACTCACTCTGTCA | 20467 GGGGAAGTTTCCTTTACTAGTGCCATT | 31451 CTCTCTACCCAAGGTGTCAAACACT | 42435 |
| 8810 CAGGGGTTTGTTTGATCCATTTTGA | 20468 CCCGATGAGAGCCAAAGACTGA | 31452 GAGTAACTCAAAGACAGGGGTTTGT | 42436 |
| 8811 AGGGAGGATCACCAGGAAGAAA | 20469 CTGGACTCCATACCACTGAACTGATG | 31453 CCTCTCTCTAGAAAGGGAGGATCA | 42437 |
| 8812 AGGGCCGTGACACTTGCTCTA | 20470 GGGCAAAGACGTGGAAGTGAGA | 31454 TCTAATGGAGGGCCGTGACA | 42438 |
| 8813 GCAGAGCTAATGTTTGGGCAAT | 20471 GCAGAGAATGTTTTATGCTGGGATT | 31455 CACTAACAACAACCTGCAGAGCTA | 42439 |
| 8814 CCTGGTTCAACAGTTCAATGCTGTCT | 20472 GGCCAAGGCAATCTCAGAGAAG | 31456 TCAGGCCTGCTTCAACAGTTC | 42440 |
| 8815 GCCTTTGCCTAAGACAGAGAGAAC | 20473 CCTGCAGTAGCCAGTTGAACCTA | 31457 TGGGCCTGCCTTTGCCTAAGA | 42441 |
| 8816 GTCTCTGTGTTCAGAAGGTAGTTTTGACT | 20474 GTGCCCTTTGTGTGAGAGCAA | 31458 GGCAAAACAGTTAAGTCTCTGTGTTCA | 42442 |
| 8817 GGCTTTGAGCAGCTTTGATGAAG | 20475 GCATTTGTGGCTGACCATAGATAAG | 31459 GTGTGACTGAGCAGGCTTTGA | 42443 |
| 8818 GCAGTGAAGCCAGGTCCTCTAA | 20476 AGCTGCAGAGTTGGGGTTTC | 31460 AGGCAGCCCAGGCAGTGAA | 42444 |
| 8819 GGAACAGCCCACCTATATATCCAGATT | 20477 TGCCAACCCCAAGTAGCTTTAAT | 31461 GGGAGGAACAGCCCACCTAT | 42445 |
| 8820 GCTAACTCTTGCTTCGACAAGAAAC | 20478 AGACAGCTCCCTACGAGCAA | 31462 TTCCTGGCCTGGGCTAACTCT | 42446 |
| 8821 GGACAGACGTAGAGCCCAGAATAC | 20479 GCCTCTGCCGGGTAAAAGTCA | 31463 TGGCAGGAACGACAGACGTAGA | 42447 |
| 8822 GCAAAGACAGTGGTGAAGGATGA | 20480 CCATCACCATCGTAGCTGACA | 31464 GCCTTATGGGCACAGCAAA | 42448 |
| 8823 CCCAAGAAGGCACAGAACCACAA | 20481 GCTCAACAACTATCCAGTTTCATCCTAAAG | 31465 GGAGCATCTCTCAGACCCAAGAA | 42449 |
| 8824 ATCCTACCCTACTGGGGAGCTA | 20482 GGGTCTCTTGGACACTTGTTTCTTC | 31466 GCCAAAGCTTAATCCTACCCTACT | 42450 |
| 8825 TGTCACAGTCCAGTTGTCTGAATAAC | 20483 CAAGTGCCACTGATGCTTTACAA | 31467 TCAGTCATTTGTCACAGTCCAGTT | 42451 |
| 8826 CCCTGTTTGCACTCTGCCATCT | 20484 GGAAAAGACTGGAACAAGACTACTGA | 31468 CCATTACTTCCCCTTCCCTGTTTG | 42452 |
| 8827 GGCCACAGAAGGGAGAAAGAGT | 20485 TGATTGCCCTTAAGTGACATGAAGT | 31469 TATGGCCAGGGCCACAGAA | 42453 |
| 8828 GCTGCTGGTATTATTCAGGAGTTACATTG | 20486 CCCTCCCCTGACACCTTACT | 31470 TCAGTTGTGTGCTGCTGGTAT | 42454 |
| 8829 GAGCAACTCTAGCTCAAAGCAACA | 20487 GTCCTGGATGAGGGGAATGAGTT | 31471 TGTGTAACACGCCAGAGCAA | 42455 |
| 8830 CGTGAAGGACATTTCTTCTTCTGCAT | 20488 CTGAATAGACCTATCTTGCCACACA | 31472 GGACTATGGAGACGTGAAGGACATT | 42456 |
| 8831 GGTGGCTGTTTAGGAGAGAGTTAG | 20489 GTCCTTGGATCAGCTAAGGCATGT | 31473 CTGACATTTTACTCAAGGTGGCTGTTTAG | 42457 |
| 8832 CTGTGAGTCGGCTTGTTTCTCA | 20490 GCTGAGAACTTGCCTTAGGCTACA | 31474 CCACGGACAGCCAAAGAACTGT | 42458 |
| 8833 CAGCCACTGGAAAGTGAGAGGATA | 20491 TGATGGCCCCATCTCTGAGTCT | 31475 GACAACCACAGCCACTGGAAAG | 42459 |
| 8834 CCTTAGAGGTAAACAGCAACTGAGA | 20492 CAGTGTTTGCATGGGACTTTCTTCATC | 31476 GCAGCCTCTCTAGACCTTAGAGGTAAAC | 42460 |
| 8835 GCCCACTAGAACCCTTCACAATC | 20493 CAACACACAAGGGGTGAGTTG | 31477 TCTGAGCCTGAAGCCCACTA | 42461 |
| 8836 GGGTATGGGACCCAGTGTGATCT | 20494 GCTGGGAGACTGTGGGTCAGA | 31478 GCTTAGGTCTCAGCAAGGGTATG | 42462 |
| 8837 TCCTGTTCACCATCCTCTCCAA | 20495 CTGGACAGGCTAAATAATGGTGGAATC | 31479 GCCCACTTCCTTGAGTGATGA | 42463 |

FIG. 36N6

| | | | |
|---|---|---|---|
| 8838 GTGGACTTGATTTTAAGGACACCAACA | 20496 GGGCCACTTTGTACGTGGCTAT | 31480 GGCCAAGTGAGTGGACTTGA | 42464 |
| 8839 TCTCATCTCAGTGGCTCACATTTATC | 20497 TGGACTTAGGGTACCATCTACTCTTG | 31481 GGGTAAAAGTGAGTCTCATCTCAGT | 42465 |
| 8840 GGATTTTAGCTGTCAGGAGACAACA | 20498 TCCTCTAACACCTGTGCCATTTG | 31482 CCCATGTGAAAGTGGGATTTTAGCTGTCA | 42466 |
| 8841 AGCCCCTCCTACCACAGCTAAC | 20499 CAGATGGAGGACAAAGCCTCAGA | 31483 AGAAGCCATTAAGCCCCTCCTA | 42467 |
| 8842 CCCAAGCAAGAGATTATCAATGCTTCA | 20500 ACCAACCTCCTTAAGGGAAAGGAT | 31484 CCTTACTCAATTTACCCAAGCAAGAGA | 42468 |
| 8843 GCAGCAATTGTAACAAGGTGCATA | 20501 GTGGCAAGCCAGGACAACTGTA | 31485 GCTTGGAAAAGCAGCAATTGGTAA | 42469 |
| 8844 GGAAACCAGTTCAGAAAAGGGAGGAAA | 20502 AAAGGAATATGGGTTCTTGGCTACA | 31486 CCTAGCAACAGGAAACCAGTTCAGA | 42470 |
| 8845 GAAGCAAGACACCTTCACAAGACA | 20503 TGGTAGTTCCTCCTGCGTTCAT | 31487 GGTAAAGAGGAAGCAAGACACCTT | 42471 |
| 8846 GAGTCTTAGGGCCTTGAGTGAACA | 20504 CCATTACCTAGTTGTAACCAATACCTGACT | 31488 GCCACCTGCTGATTGTAGAGTCTTAG | 42472 |
| 8847 GCCTCAGCAAGTCTGCTCTT | 20505 CTGCCAGCACGGCTAAAATG | 31489 GAAGACCAGAAGCCTCAGCAA | 42473 |
| 8848 GGGGCTTCTAGAGCCACTTTAC | 20506 GGAGCATAAACTCCCAGGCACTTC | 31490 CAGCTGGCTTGGGGCTTCTA | 42474 |
| 8849 GGTGGTGAAGGAGCTTCCTAAG | 20507 CTCCTAGCTCTTTAATCCTTTCACTGT | 31491 CCACTTGTAGTCTGGGTGGTGAAG | 42475 |
| 8850 TTCTAGGGCCCTCACTTATTATCCTA | 20508 GGCTGATAACCGGGTGATTATACAACT | 31492 GCCTACATTTCTAGGGCCCTCACT | 42476 |
| 8851 TGGTCTGCCAACTTTGCTGTT | 20509 TTCCCCGAAGCCCACAGTCTA | 31493 TGGAGTGCTTAGGGGAGGATTG | 42477 |
| 8852 ACAAGGCCACCCAGGAACCTA | 20510 TGGGCTCACGGCAAGTTCA | 31494 AGGGAGGAGAAAAGGCTGAAGA | 42478 |
| 8853 CCCAAGAATTCTGCTAGGACCTAAAAAC | 20511 TGCATGCACCTGCTGTGA | 31495 GCTGCTGTCCCTAACCCAAGAA | 42479 |
| 8854 TGAAGACCCCAAGAGCCTACT | 20512 TGTACCCTAGGTACCAGCTCATC | 31496 AGCCTAGGCCTGGACTTGAAGA | 42480 |
| 8855 GGTGGGACAAAAGCCAGATCACA | 20513 TCCACTTCTCACCTCTCCTTCA | 31497 CAGCAGAGTGGTGGGACAAA | 42481 |
| 8856 GAGACAAAACTGCAAGCCAGTGA | 20514 GGGGAGGCTCGAGTGGCTTATG | 31498 AACACCAGGCCAGAGAGACA | 42482 |
| 8857 TCCATACAGCTGGCCACAGA | 20515 CACGTGTAAATGCAGGGACACATC | 31499 CAGTCAGCAAGTCCCTCCATACA | 42483 |
| 8858 CACAACTGTGCTATGCTAGGGGTAT | 20516 GCTTGGGAGGGTACACAGTGAT | 31500 GGCTGCTTTTCCTTGACACAAC | 42484 |
| 8859 GCTACAGGCAGTGAATTCGTGATG | 20517 CTGGAAGGAGGAAAATGACATAGGAT | 31501 ATCAACGCTACAGGCAGTGAA | 42485 |
| 8860 GGTCATGCTACTGTCTAAGGTGCAA | 20518 ACCTAAGAAAAGCAGAGGAAACAGT | 31502 GCTCTATCCACTGTGGTCATGCTA | 42486 |
| 8861 CTGAAGTGAACTGATGTGGAGTCA | 20519 TGCCCCAGCTAGTGGAAAGT | 31503 CCAGGTGGAGTCTGAAGTGAACTGAT | 42487 |
| 8862 GGTCATGCCAGTGATTACAATGGAGTAA | 20520 CACCAATTATGCCCTAGCCTAAGAAG | 31504 GAATCTGGTCATGCCAGTGATTACA | 42488 |
| 8863 ACTGGGTCAACTGAAGGGTAGA | 20521 GTGCCACTAGGGTTGAATTTATCATGTTC | 31505 CCTGTGCTAGGTACTGGGTCAAC | 42489 |
| 8864 GCAACATGGAAGTCAGGGTAATCTTG | 20522 TTGCTCCCACAGCTCCATTG | 31506 AGTGGAACTTAGCAACATGGAAGT | 42490 |
| 8865 GGCCTCAGCTTCCACTTTTCAA | 20523 ATCTGTTCCACGAGATGTTGATGA | 31507 TGGGGATGGCCTCAGCTT | 42491 |
| 8866 TGCCCTTCACCCTACCAAACT | 20524 CTCACAGCCAGTGCAGAAGT | 31508 CTCAGTAATGGTGGATGCCCTTCA | 42492 |
| 8867 CCACTAGACAGTGCATCTGGATT | 20525 GTGCCTTCACCCCATCTGACAA | 31509 TCATGGGGTATCTCAACCACTAGA | 42493 |
| 8868 GTGCCTTACTCTCACCTCAGTCA | 20526 GTCTAAGGTGTGAGCAGGATGTTG | 31510 TGGGGAATATGTGCCTTACTCTCA | 42494 |
| 8869 GCTGCTTGGATGACTCAGCTGTTTT | 20527 CCTGGTCTGTTTGCACTCTCCAA | 31511 GGCCACCATCTTTGCTGCTT | 42495 |
| 8870 GCCCCAGTTTTCATGCCAACATAC | 20528 GGGTGGAAGTTTTGAGATTATCTGGTT | 31512 CCTTCTTGTGGCCCCAGTTTTC | 42496 |
| 8871 CCAGAGGAAAGAATTGTGTGGTCCAT | 20529 ACCCATTTGTTCCCAAGTTGTTG | 31513 TCCTTGTCTCCAGAGGAAAGAATTG | 42497 |
| 8872 GGCATTGTTCCACAGAAGCAAGT | 20530 GGTGGTTGGGTGCAGTAAAATAGTCA | 31514 GGTGGTCACTGTGGCATTGTTC | 42498 |
| 8873 GAAATTTAAGCGGCATGGGTTGA | 20531 TGGATACCCTTTCGGTGACATCT | 31515 TCTGTGGGGCAGACAACATAGA | 42499 |
| 8874 GCCTGTACTAGTCTCTCCCAGGAA | 20532 CTCCACAACTGGAGAAACACATGAT | 31516 CACTGTATGCTGATGGCCTGTACT | 42500 |
| 8875 GGTCAGAAATACCCCATCTGTGATGA | 20533 TACATAGCGCAGGTAGAAATG | 31517 TCAGCACCACAATTGGTCAGAA | 42501 |
| 8876 GGCGCTAATCTCCATGCATTTTACT | 20534 AGCTCACCTAAACCAAGTGCAA | 31518 CCTATTTCCACATGGCGCTAATCT | 42502 |
| 8877 TGTGGTCAAGGATGGTGAGATTG | 20535 CAGGAGCTCTTCCCACTGATCTTG | 31519 CTGCTACCACCTCTTGTGGTCAA | 42503 |
| 8878 ACTTACCCAAGGATAAACCTACCAAGA | 20536 GGTGCTGTTGCTAAAGGCTCACA | 31520 TGGCTCAACTTACCCAAGGATAAAC | 42504 |
| 8879 CTTCTCTCCTGGGGCCTACTTT | 20537 CCAGAGGTCCTTTTCCCAACAGAT | 31521 CAGGGCTCCAATCCTCTTCTCT | 42505 |
| 8880 CCACCTGACTTTCTTAGGAGCACAA | 20538 GCAGAGAGTACAAATAGCAGTAAGCAGTT | 31522 ACAAGAACCTCCCACCTGACT | 42506 |
| 8881 GGGAGGAACCAAGGTGGACAAG | 20539 GACTCCCTGTGACCTTGAACAGAT | 31523 TTCGGGTGGGAGGAACCAA | 42507 |
| 8882 TGCCAGTGTGAATCTTACCAAGT | 20540 CTGATCCAGCTCGCAGAGTCTA | 31524 CTCGCATCTTTTCTGCCAGTGT | 42508 |
| 8883 GGCCTGCCCATCTCCTTTATGT | 20541 CATGGATCGTTAAATGTAGCAGGATCT | 31525 GTGTTATGGCCTGCCCATCT | 42509 |
| 8884 CTGCCTGTGTTTCTAGGCTCTTC | 20542 GCCTTAGCAATTTCCACTCGGATT | 31526 GGCAATTTTCTGCCTGTGTTTCT | 42510 |
| 8885 CTGGAGGAGCTAGGTAGCAGAAATAG | 20543 CAGTGGAGAACTGGGGTCTCATAG | 31527 CCTATGCATCTGGAGGAGCTAGGTA | 42511 |
| 8886 GGGCTGGGTGTTGGGGATAAA | 20544 TGAGCTCCTTGACGACAGGAAT | 31528 TGGAGAATGGGCTGGGTGTTG | 42512 |
| 8887 CAGAGTGAAGACCTCTTTGACTATGATTG | 20545 TGTCTGGCCTCCTGTTCCAT | 31529 GCCTCAGAGTGAAGACCTCTTTGA | 42513 |
| 8888 CTTCCCCTAGATAGCTGGCTTTG | 20546 GTGCCTCTGAAGCAAGAGACTTC | 31530 CTTACCTGCCTTCTTCCCCTAGA | 42514 |
| 8889 CCCAAGTAAACCCACTAATTTCACACTTG | 20547 CCCCAAAAAGGCTTACACAGTTAAA | 31531 AAGGGCTTGTGTTTCCCAAGT | 42515 |
| 8890 CCCTACACAATGGATGAGTGACTGGAT | 20548 CCAGAACAGGCATTGACAAACTATG | 31532 GCTCACAAACCCTACACAATGGAT | 42516 |
| 8891 ACCAGGAGAGTGTGATGTTATGGAT | 20549 GCTGTAGACCTTATGCTTCCTGTAT | 31533 GGGTGAGAACCAGGAGAGTGTGA | 42517 |
| 8892 GGCTCAGACCATTGTATTTCTTCCAT | 20550 CCTTCACACAACAGGAGAGGCATT | 31534 TGACTAAAACAGGCTCAGACCATT | 42518 |
| 8893 GGCCAAGACAGCTTACCTCATGTGT | 20551 CTCCTCAGTGCCACTATGTCA | 31535 GGACAAGGCCAAGACAGCTAC | 42519 |
| 8894 CTCCTCTTCTCCCATATACAACTGGAAT | 20552 GAAGGATTTGAACGCATTTAGGAGGTA | 31536 GTCATCCACGGATCTCTCCTCTTC | 42520 |
| 8895 GAGTGGATGACACGCAATGCAA | 20553 GGGATGTTTAGGGACTGTGCAA | 31537 GCGAGTCTGTTGTGAGTGGATGA | 42521 |
| 8896 GTCTACCCCAGAGATTATTTCCCTCATACT | 20554 GGTTGGCTGCATTGCTCAAA | 31538 CCCTACTTGTTAAAGTCTACCCAGAGAT | 42522 |
| 8897 GCTCAAGGGGAGGGAATGTA | 20555 AGGGTGGCCCTCATGATTTCT | 31539 ACATGTCCTGCCAATGCTCAA | 42523 |
| 8898 GGAGCTGGTTACAGAGGGCTTT | 20556 CTGCTTTGATTGGGAACAGATGGTCTA | 31540 GGGGATTTGTGGGAGCTGGTTAC | 42524 |
| 8899 CCCTTGTGGGTGTATGAGGGAAGT | 20557 GAGAGAGAAGGTTGAGGGGTCAGA | 31541 CCCATATTTGACCCCTTGTGGGTGTA | 42525 |
| 8900 GAGGCAAGAGAGTGAGGCTTTC | 20558 GGGGTAGCCTGTAACCAGTGATTG | 31542 TGATCAGCCTTGAGGCAAGAGA | 42526 |
| 8901 GTTTGTGTAGACACCCTCTGCTT | 20559 CTGCTTTTCTTCCTGGAGTCTGGAAT | 31543 GGGGTTTGTATTCAGTCTGTTTGTGTAG | 42527 |
| 8902 GGAGCCAGACAGGTAAGAAGTAAA | 20560 TGGTTTGCTCCTTTTGGTGGTT | 31544 ATGCCTACTGGAGCCAGACA | 42528 |

FIG. 36N7

| | | | |
|---|---|---|---|
| 8903 CAGCCTTCCTGAACTGAACAGACA | 20561 CTCAAACTGTAGCTGTCTTGGTTTTC | 31545 GCATAGCAGCCTTCCTGAACT | 42529 |
| 8904 GCCAGGACTCAAGTGGAAGAGAAG | 20562 GCCCACAAGTCTCATCCCTCTCA | 31546 ACAGTGCAGCCAGGACTCAA | 42530 |
| 8905 GTTGGCTTGAACCTGGGATTGA | 20563 GCTCTATGCCCAGGCCAGATT | 31547 GAGGTGGGTAGTTGGCTTGAAC | 42531 |
| 8906 TCCCCTTTGCCTCTCACCAT | 20564 GGCAACAGAATTTGCTTCTGGTAA | 31548 GTGATATGTGCCCTTCCCCTTTG | 42532 |
| 8907 GAGAGCCATTGCCCATCTGT | 20565 GGAGAGTCCACCAAAAGATAAGTGT | 31549 AGCACCAGAAGAGAGCCATTG | 42533 |
| 8908 ACCGAAAGACAGAGTTTGTCAGAT | 20566 GGTTTGGCCTATGGTTGGGTCTT | 31550 AACATACCAACCGAAAGACAGAGT | 42534 |
| 8909 TCTCCGTCCCTCCCTCTCAAA | 20567 GGATATGAAAGTTACAGGACAGCAATC | 31551 TAGCCCATGGCTCTGTCTCT | 42535 |
| 8910 AGCAACCCAGCTAGTTCTGAAAA | 20568 TCTGGTGCCTTCCATAAGACTAGA | 31552 GCTCCCATAGCAACCCAGCTA | 42536 |
| 8911 CCTCTGGTTTGCCCCTAAATTCT | 20569 GGCTTAGCCCACAAGTGTTCTT | 31553 GCAGTTTTCTTCTACCTCTGGTTTG | 42537 |
| 8912 GCTAGAAACTGTGAGGCTTGAGT | 20570 TCCTCTCCCTCAATTCCAACCAT | 31554 TGGAGTTAAAAGGGCTAGAAACTGT | 42538 |
| 8913 GTCCGTGCTTATCCAGATCCAA | 20571 GGTGCTGGTGGTGCTGGAAGTTA | 31555 CCTGTAGTGGGTAATGTCCGTGCTT | 42539 |
| 8914 CTGGACCCTTTCTAGCATCTTCTCT | 20572 CCATGGAGGTGGGCTTCTCA | 31556 GTCAGCTCACTGGACCCTTTCT | 42540 |
| 8915 CCACCAAGCATTCCCTGCAAGT | 20573 AGACAGGCAGGCCTTGAACT | 31557 CCACTCTCTCCACCAAGCATTC | 42541 |
| 8916 CGTAGAATGTCTTGTATGGTGAGAGT | 20574 GGTGTAATCTAGCCTAACTTGACTGA | 31558 GCCTATGGGATTAGTTTTGAACGTAGA | 42542 |
| 8917 GGAGGTGAAGACTGAGGCACAA | 20575 CCAAGCTCCAAGATGACAAGCTCAA | 31559 TGCTATGACTTGGAGGTGAAGACT | 42543 |
| 8918 TCCACCCTCTTGCACCTTTCT | 20576 GGATCTGTGGCTCAAGCTCAGT | 31560 AGGCTGAGTTCCACCCTCTTG | 42544 |
| 8919 GTTTTGGAAAATGCAGCACTCAAG | 20577 AACTACAGCCCAAAGTGAGAAAATG | 31561 GCAGGTAATGGGTGGTTTTGGAA | 42545 |
| 8920 TTTCTCTACCACCCAAGAAAGCAT | 20578 TCCTAAGGGCATCACTTTGACTTAC | 31562 GTGTAACTCTGCCCCTTTCTCTAC | 42546 |
| 8921 CCAGGAAGTGTTGAAGTGACTGAA | 20579 TCTCTGCTCTGCCCATGCTG | 31563 GGACTGTCAACCAGGAAGTGTTG | 42547 |
| 8922 GGGAAATCCAAGCCCAGAGGTT | 20580 AGCCCTTAGGCAGTAGCCTTGT | 31564 GCACAGGAGACAAGCTGGGAAATC | 42548 |
| 8923 GGGGATAACCCAAAGCTATTTGCAT | 20581 CCTCATGCCTGGCCCATTTAGT | 31565 GGAACAACAAGAGGGGATAACCCAAAG | 42549 |
| 8924 CCTTGCATCTGCATCCCTTAGA | 20582 TGTAACATGCCTCTGTCATAGCAA | 31566 GAGCACATTCCCCTTGCATCT | 42550 |
| 8925 CAGATGTTGCAGGCACCTCTCA | 20583 ACTGGCTTGAATTCAGGGCTTTA | 31567 CGGAAGCACAGGGCATTTCAGA | 42551 |
| 8926 GGGGTTGGGGAAATATCCTGCTT | 20584 TGCTGTGGTTTATGAATCCATGTTC | 31568 ACCTGTGAAGGGGTTGGGGAAA | 42552 |
| 8927 GGGAGGTAGCATTTGAACTAAGTCTTG | 20585 CTTGCACCTTCCAACCCCTATC | 31569 CCCTCAAACTAGGGAGGTAGCAT | 42553 |
| 8928 GCCACTCAAGCTAATCCTGAAATTGAA | 20586 GGGTCACAGAGGCAGTGATGAT | 31570 GCTCAGTCAGCCACTCAAGCTA | 42554 |
| 8929 TGTCCTTTCCTACCCATGAATGAAAC | 20587 TGAGACTGGTAAGCTATGGACTCT | 31571 CAAGTCATGGTCTTGTCCTTTCCTA | 42555 |
| 8930 GCATAGCATGAGAAATACCTTGCAGTT | 20588 CCTGCTAGTAGGCACCTAAAAC | 31572 CTGCCTGCATAGCATGAGAAATAC | 42556 |
| 8931 GGGAAAGTGTACCACGATTTGTTCAGA | 20589 TGTCCCACAGAGGACAGCTT | 31573 CCACAGGGAAAGTGTACCACGAT | 42557 |
| 8932 CAGGGAACATAGTCAATGCCTGAGTTAAT | 20590 CCTGACTGATTGGTCATGTGGTCTT | 31574 TGAGTCAATCCAGGGAACATAGTCA | 42558 |
| 8933 CAGCTCCTTTGCCACAGCATA | 20591 GGACCCACCATAGTCAGAACTAAGA | 31575 ATGTGGTCCTCAGCTCCTTTG | 42559 |
| 8934 GGGGCCAAATGTGCTAATTGTTCA | 20592 TGGACAGAATCCAGTTTGATGGAA | 31576 CCCTGTTTTAATGGGCCAAATG | 42560 |
| 8935 ACTTTACTCTGTCCTCACCCTAGT | 20593 GACTGGAGCACAGGTTACTTTACA | 31577 TTGTCCACTTCAGCACTTTACTCT | 42561 |
| 8936 GAGCAAGAATTACTGCCTCCAGATA | 20594 GTGCAGACAAGTTCACTGAGTAATTC | 31578 CTCAAGACGCCAAGAGCAAGA | 42562 |
| 8937 CCTGAAAAGCTGCTAGTGGATGTTG | 20595 GGATCTGTTGCAGAGCTTTCTTTTG | 31579 CAGGGTGACCTGAAAAGCTGCTA | 42563 |
| 8938 CCCTCCCTTGCAATTTGATATAGTCCTAAG | 20596 TTACTTCCACTTACATTCCGTGACA | 31580 TTCACCCTCCCTTGCAATTTGA | 42564 |
| 8939 GGACATTGTGATTGACCGAACCTA | 20597 GAGCAAACTGGTAGCCACTAATTCTT | 31581 CCCAAAAGAAAGCCTAGGACATTGTGA | 42565 |
| 8940 CTGTTGGGAGGGAGTTGGATGAA | 20598 GGAGGAGATCTGAAATAGGAAAGACAGTCA | 31582 ACAGCCCTAGATGGCCCTGTT | 42566 |
| 8941 GTTACGCTCGGTGAAGAATGTTTAAG | 20599 GGAGAACTTAGGGAAGTCCAGTTG | 31583 CTCCAAGTTACGCTCGGTGAAG | 42567 |
| 8942 CTGTTTTCCTGGCCGCATCT | 20600 GAGCAGTGACGCCTCCATTT | 31584 CCCCTGCCTGAAATGCTGTTT | 42568 |
| 8943 TGTAACAAACATGGACCAGAACAGT | 20601 GGGAGCTCTGTTTTCACTGTGTTA | 31585 GGTCAGCTTGAGCTGTAACAAACA | 42569 |
| 8944 CTGAGGCTTTCCTGACTCCAGAAT | 20602 CACTGGGACAAGTAGCATGACA | 31586 CCAGAACTGGAACTGAGGCTTTC | 42570 |
| 8945 GGTGCCTGCTGCATAGCATAGTAG | 20603 CTTCTAATGCAGGGGTTTTTGTCTT | 31587 AGAACGGTGCCTGCTGCATA | 42571 |
| 8946 GGTCTGCTTGATCTCTGACTACTCCTA | 20604 AGTGGGGTAAAACCTGTGTTTCT | 31588 TGGAGGGTCTGCTTGATCTCT | 42572 |
| 8947 GTTGTGATGCTAAAGGGCTAATGGATA | 20605 GGTTGAGAGACAAGCCTTAGCAT | 31589 TCACCTGGGAGTAAAGTTGTGATG | 42573 |
| 8948 CAGAGGGCTTAGCTCACTTCGTT | 20606 CTCCATTCTCAACTCATTCAACCTCTAAG | 31590 GCCCAGAAGAGAAGATATTTCAGA | 42574 |
| 8949 GGCTCAAGCAATCTTCCTGTCT | 20607 GGCATCCATCTGTACTCCCAGCTAT | 31591 CAGTTCCTGGGCTCAAGCAATC | 42575 |
| 8950 GTTTCTGCTTTCAATGTCCAGACTTC | 20608 GGTGATTGACACACTGAGGATCCAA | 31592 GGTATGGCATCAGTTTCTGCTTTCA | 42576 |
| 8951 TCCCCACAATCTCCCTGGTACT | 20609 CCCCACCACCCCGATTTAATAATAC | 31593 GCTACAAATGAGTTTTCCCCACAATCT | 42577 |
| 8952 GCTTCAGTGTGGGGATGTGA | 20610 CCAACACAGGGAAAGGTTAAGTGA | 31594 CAGGATTGCATGCTTCCAGTGT | 42578 |
| 8953 GCTCCATTTTCTGAGCTGGAAAAGTTC | 20611 GCAAACAGGAACACCTGGTTGTCT | 31595 GCTTGAATGACCTGCTCCATTTTC | 42579 |
| 8954 GAGTGAGAGAATCCAAGAGGACAAG | 20612 GTCTGTTCTCAAACCTTCCTTCTGT | 31596 GGCCAAGGGAGTGAGAGAATCCAA | 42580 |
| 8955 CCACCAACAGAGGACATCAGAACT | 20613 CACAACACAGGCTAAGAAAACCTAATG | 31597 GGCAATGAAGAATACCACCAACAGA | 42581 |
| 8956 GGTGGGACATCATTTCTGACCAGTAG | 20614 GGAGTTGGCAGGAGCATCAGA | 31598 GACATGACCTGGTGGGACATCA | 42582 |
| 8957 CGCTTCATCCCATTGGCCTACA | 20615 GGGACCTTTTGAGGCTTGCAGTTC | 31599 ATGCCTGGGAGCCGTTTCATC | 42583 |
| 8958 GTATTGACAGGTCTTCTGCCTTCTA | 20616 CAGAGGCAAATGAAATGAGCTGTTAG | 31600 GGCCTTCAACTATTGACAGGTCTTC | 42584 |
| 8959 TGCTTATGGTCCCAGCTCTTG | 20617 AGCACAAAGCACTTGGTCAGA | 31601 CAGACAGAGCGAGGTGCTTATG | 42585 |
| 8960 GACTGACAGGCAGAATACCTGTGT | 20618 CCACAGACCCTGACCCAATGATG | 31602 AGGTGGACTGACAGGCAGAA | 42586 |
| 8961 CTGAACCCCTGCTCTACACTTAAGAAG | 20619 GGAAGTTAACTGGGAGAGGCAATAG | 31603 ACTACTGAACCCCTGCTCTACA | 42587 |
| 8962 GCAGATGGACTACCATGCCTTGTT | 20620 GCCCATGTTGAGATAATGGCTACCTT | 31604 GGGGCCAGATCCTGCATTG | 42588 |
| 8963 GGAAGCATGACAGCAGGACTGTA | 20621 AGGATGGGAAGCTAGAAGTCAA | 31605 GAGCTGACTCCATACTGTCAAGGAA | 42589 |
| 8964 AGGATCCTGCTAGGTGCTGAAT | 20622 CATTGCCTTGACCCCACTAAGA | 31606 CCTGGAGTGTAGGGCTGTAGGAT | 42590 |
| 8965 GCAAAACGAATCATGCCCAAAAC | 20623 GGGGAGGCAATGAAGAAAAGCCTAA | 31607 GCCCATCCTACAGCCTAGCAAA | 42591 |
| 8966 CGGGGACCAAATTTACAGGGACAA | 20624 TGCCCAATGTCCAATGTCTTGA | 31608 AGATGGAGTAACGGGGACCAA | 42592 |
| 8967 CCCGGGAGGGTCTTAGAGTTTGT | 20625 GAGTCTGTCTTCTTGCCTGTCA | 31609 ATGGTGCCCGGGAGGGTCTT | 42593 |

FIG. 36N8

| | | | |
|---|---|---|---|
| 8968 CCCCTGCTTCATGGGCTCAAA | 20626 TGAAAGGCATGCAAACAGTCTTC | 31610 TGGGTACTGCCCCTGCTTCAT | 42594 |
| 8969 ACCACATCCCAGCTCACAGA | 20627 GGTGGGAGCTTCTCTTTAACTTTTC | 31611 GACCACACACTCTACACCACAT | 42595 |
| 8970 GGGCATTAATGAGCACATTCCTTTTC | 20628 GCTTCCAACGTCCCTATCTTAGTGT | 31612 GGCCCCAGTAAAAACAGTGGGCATT | 42596 |
| 8971 GTTGTTGGCTCAGTCAATGAGAAG | 20629 GCCATTGACATGTCTGGCTGAAG | 31613 GCCTGGGCAGGTCATGTTGTT | 42597 |
| 8972 CGCCTCTGATTCTAATCCCACTATTAC | 20630 GCCTTTGACTTTGGTGTGAACCTA | 31614 AGGGGATCGCCTCTGATTCT | 42598 |
| 8973 GGCTACTGGTCTCAGACAAAGATAC | 20631 CTGGTGAGCTATTTTCCACTGGATATG | 31615 ACAGGGTGGCTACTGGTCTCA | 42599 |
| 8974 GCCTGAAGGTGAGACAATCAGAAA | 20632 TGAAAAAGTGGCCTCTAGTGTGT | 31616 GCTTAACTTTGCCTGAAGGTGAGA | 42600 |
| 8975 AGTGGGGTATGCCTGCAGTTG | 20633 GGGAGAGAGAGTTTTGTGTCTGTTC | 31617 AAAGCAGACTCAGTGGGGTATG | 42601 |
| 8976 GTGTGGACTCGAAGAGGATTGTTGA | 20634 CCACTACCAGCAGGCAACCTT | 31618 CACCATGTGTGTGGACTCGAA | 42602 |
| 8977 GAGCACGATCCTGAAACAGGTTA | 20635 CCTGGAATAAACTTTGCCCAGACA | 31619 GCAGGTGACATTTGAGCACGAT | 42603 |
| 8978 AGTCAGTCTGGCCCAGCAGTA | 20636 CTCAATCCTGGAGTACAATTTCTGTCT | 31620 CTCACCAAGGCATAAAGTCAGTCT | 42604 |
| 8979 CCACCTGGCAAATGCAGTTAAAGT | 20637 AATCTGCTCCTTTCCTGGTCTTC | 31621 TGGACTCCACCTGGCAAATG | 42605 |
| 8980 GGGGTAATAGGGCTTAGGAGGAACA | 20638 GACACTCAAAAGGCTAAGGGCTAAC | 31622 CCAGGAAGGGGTAATAGGGCTTA | 42606 |
| 8981 ACAGGGCTGAGACCAGCACAT | 20639 CACAGTGGACAGCATGACTCAGA | 31623 AAGGGGAACACAGGGCTGAGA | 42607 |
| 8982 CACTGCTAGTACAGGTTGTAAATTGGTATG | 20640 GAAATGGTGCTAACTTGCTCTCCAA | 31624 CTCATTCACTGCTAGTACAGGTTGT | 42608 |
| 8983 GGTGCTGACTCCAACTACTGAAAC | 20641 GGCTGCCCCTGTCAATGATGA | 31625 CTTGTGTAGGTGCTGACTCCAA | 42609 |
| 8984 CTTGGCTGCTGATTGGAATTGTT | 20642 GGGTCAGCTGCAGATTATGTCATT | 31626 GTCCCCTACTTGGCTGCTGATT | 42610 |
| 8985 CCAGCCAGTAAAGCCTTGTATGA | 20643 CAAGGGAGAAGGTGGGAGACA | 31627 CCAAATGGTTTTCCAGCCAGTAAAG | 42611 |
| 8986 GCTCCTTCATTCCCTTGGCAAGTA | 20644 AGTCCAAAACCGTGACAAGACA | 31628 CAGCTGTCAATGAATGGCTCCTT | 42612 |
| 8987 GGAAGGCATCTGGGGCTCTAAG | 20645 ACCGGACTTTGCCAGTCATC | 31629 CCTCGAGGGGAAGGCATCT | 42613 |
| 8988 AGGGCATCCTCGAGCCAAAT | 20646 GACACTTCTGGTTGCCACATACA | 31630 AAGCACCTGTGACTTTGTCTGA | 42614 |
| 8989 GGATGTATCCAGATGGTGTGTGAAAG | 20647 GTCTCACACACAGCCCAAACGTA | 31631 GGTTGGAGGAGAGTGTGGATGT | 42615 |
| 8990 GGGACTAGTGTACCTTCTGGTCTA | 20648 GTGGTCATTTGCCAAGGCTCTA | 31632 TGGGGCTGTGGGACTAGTGT | 42616 |
| 8991 GGACGTGGTTTGCTAAGGTGTT | 20649 GTCACACCCTTCATTCTCCCATCT | 31633 GTGGTGACAGGACGTGGTTT | 42617 |
| 8992 ACTGTGTCCCCTGGCACCTA | 20650 GTGGTCAATGTTAGGGGTTCAGTCT | 31634 ATCCGAACTAACCATTCACTGTGT | 42618 |
| 8993 GGCAGGATCTGCCAGCAAAA | 20651 TTTGCAGCGCAGCCTCAGCTT | 31635 TCTCTCACAGTTGGGCAGGAT | 42619 |
| 8994 GTCCTTCCTGTCTGCTCTTGGTA | 20652 CCTGGTTAAAGGAAGAGTGAGTCTCAGAA | 31636 GCTGCAGTAGTCCTTCCTGTCT | 42620 |
| 8995 CCCAGACATACCAGTGAGGCTTGA | 20653 GGCTAGGAAAACCACATTCAACA | 31637 CCAGGCAACTTTCCCAGACA | 42621 |
| 8996 GTTGAAGCCAGATCATGGAAGACT | 20654 GCTTACCAAATAAAGTCTTCACCCCTTAG | 31638 CCAAAAGTGGGTTGAAGCCAGATCA | 42622 |
| 8997 TCTGAAAAGCAGTACAGCATCTTT | 20655 CGAATGTCCCACTACTTATGGTGAA | 31639 TGCCTGCACATCAGTGATTCT | 42623 |
| 8998 CAAGATCTCGTGCTATTCGTGTTTTG | 20656 CCTTGAATGATGCTAATCCTGAGCGAAA | 31640 GTGGCTATTAATCAAGATCTCGTGCTA | 42624 |
| 8999 CCATCTGCCATGATAGTATTGTGTCT | 20657 GGTTTTTGTACTGGAGGAACCAAAATG | 31641 CTGCCTCCCATCTGCCATGATA | 42625 |
| 9000 CGGTGTTTGGGGTCCCATGTAT | 20658 CCTAGCAGTAGCAATTACAACCATCT | 31642 AAAAGCCCCAGCGGTGTTTG | 42626 |
| 9001 GGCTTTGTTAGGACAGACCCAGTTC | 20659 GAGGGAAAGGAGCACTAGACTTC | 31643 GCACAGCACTGGGCTTTGTT | 42627 |
| 9002 CCTGGCCCTGTATTAGCTGTGGAT | 20660 CTGGAGAAAGGACTACATAGCAGAATTAGA | 31644 CAGACAGTATTCCTGGCCCTGTA | 42628 |
| 9003 CCTCCAGCCTGGCCTGATAC | 20661 TGCAGGCCTGGAGCCTGAT | 31645 CAGGCTGGTACCTACGGATTGA | 42629 |
| 9004 GGGGAGAAAACATTCCACCCATAAGATA | 20662 GCCTTCTGTGTCAACAGTGT | 31646 CCTCTTTAGGTTTTGGGGAGAAAACA | 42630 |
| 9005 GTCAAAGGCAGGAGCCATGAGA | 20663 AGCAGTGCAAAACAGACTAAGGTAT | 31647 CCCAGCCAGGAACTTTGTCA | 42631 |
| 9006 TGTCATATGAGGACACAGTGTTTGA | 20664 AGATGGTGTCTTGAATGCTGCTT | 31648 TTTTGCCCTTCTGTCCCTTATGT | 42632 |
| 9007 GGACATTATATGTCAGGGAGTGCAA | 20665 GGTGTTGGGTGTGTGGGATCAA | 31649 GCTTGCTCACAGGGTGGACATT | 42633 |
| 9008 GAGAGGCAGGTGTGAGAAATCATTG | 20666 ACGTGGTCAAGGCCATGTGT | 31650 TGATCAGAGAGGCAGGTGTGA | 42634 |
| 9009 CCCATCTTTGTGTGGGAAAGTTAGTGA | 20667 GCTTGTGGCCAGGGAAAGGTT | 31651 GCATCTCAGTCTCCCATCTTTGTGT | 42635 |
| 9010 GTCCAGCTGTTCATGGAGTCAAC | 20668 TCCCCTCAGGCCTGGTGAT | 31652 CAGGGATTTGAGTCCAGCTGTTCA | 42636 |
| 9011 TCAGGTTAGTGGGTTCCCTTCT | 20669 GACCCTAGGTCTTGGATGACATTT | 31653 GGCTTGGTTTTCACTTCAGGTTAG | 42637 |
| 9012 CCCTAGCAACACCAAGGAACAAAG | 20670 CTGGCAGGCAACAGCAAATG | 31654 GGACATCCTCCCTAGCAACACCAA | 42638 |
| 9013 GGAAAGAATAGGTAGGAGTGCTTCTCT | 20671 AGTGGTTGGCAGTCTGTGAAG | 31655 GGAACTGCAGAGCCCTATGGAAAG | 42639 |
| 9014 TGGCAGAGAAAGTCTGAGAGTAAATG | 20672 GGTTGGTGAGGGACAAAGTGTAG | 31656 CCTTCTATTCGCAGAGAAAGTCTGA | 42640 |
| 9015 ACCCTCTCATAACCTCACTTGACA | 20673 GGAAGCCATTTGGGGCTCCTT | 31657 GACAGGTTGCTTGAAATACCCTCTCA | 42641 |
| 9016 GGGCAGGTAGCATCTACAGCAA | 20674 TGTCCTGCCTGGGATGTGAA | 31658 GTGACTGATCGGCAGGTAGCAT | 42642 |
| 9017 GGCCAACAGACCAAGAAGTGCTTA | 20675 CACAGGGAGGTCTTGCACATCA | 31659 GGGAGAGGCCAACAGACCAA | 42643 |
| 9018 CCAGGGAGCTCTAGGATAGAACTGAA | 20676 GGGCAACCAACATCCACTCAGA | 31660 GCTCCAGGGAGCTCTAGGAT | 42644 |
| 9019 GGAAGTGGGTCTTTGAAGAGATCATGT | 20677 GCTCCATCATTCAGCGCTTCT | 31661 GGGCAAGGAAGTGGGTCTTTGA | 42645 |
| 9020 GCTGCCAGGATGAAACCAGAGA | 20678 GGCCTCCTCTGGGTAAAACCTACT | 31662 TGCAGGACTGCTGCCAGGAT | 42646 |
| 9021 GTTTGGTGTTTAATGGGCGATAG | 20679 GGTGTTACTGGGGAAAAGCTAGT | 31663 GCTGTGGCACGTTTGGTGTT | 42647 |
| 9022 GTTCAGTGGAAAACTGATGCAACT | 20680 GGATCTGAGTCCTTGCAGGTGAT | 31664 GCACTCCCAAGTCCAGTTCTAAAG | 42648 |
| 9023 CCCATCTTTCTGGCTCATTCCATCT | 20681 GTCCGCCATGGTTGAAGTGATG | 31665 CTTTCCACCACTTCCCATCTTTCT | 42649 |
| 9024 GCTTTAGGACCAAGTTGCTGAATTG | 20682 GGCTGCTGGTTTTAATGGAGATGT | 31666 CTGGAGTAAAATGCTTTAGGACCAAGT | 42650 |
| 9025 GGGGCTCAAACAGGTAAGGTT | 20683 GTGTCCTCAGGCCAGACTACTCTAA | 31667 AGGTAAGAAAATTGGGGCTCAAACA | 42651 |
| 9026 CCCAGCAAAGCCATGCTACAGT | 20684 TCCGCTAGTGCTTCAGTAGTCT | 31668 AGCAACCCCTATCCCCAGCAA | 42652 |
| 9027 GCCTGAAACAACCAAATACCAGGAAA | 20685 CTGGTTCTAGTGTCTTGAAAACTGTTG | 31669 CCCTCCTGCCTGAAACAACCAA | 42653 |
| 9028 CACCCTGGAACCTATGGGAAGAATG | 20686 TCAACGGGCTGCCTTCTCTT | 31670 GGGTTGTTCACCCTGGAACCTA | 42654 |
| 9029 AACCTGCAGAAGCACATCAGT | 20687 GCACCATCGACTTTGCACATTG | 31671 GAGGGGACTTTAAACCTGCAGAA | 42655 |
| 9030 CAAGTTAAGTAGTGTAGAAATCGGGAGTAG | 20688 GCACCCTCTAGCATGCTTTTTGTCA | 31672 GGTGAAGTCTATGCTGACCAAGTT | 42656 |
| 9031 CCCAGACCTTATCCTGTAGCTGAATG | 20689 GCAGAAGAAAGCACAGGATTTGCATAG | 31673 GCTTTAACTTGCCTCCCAGACCTT | 42657 |
| 9032 AGGTAGCCTCTTGGCATCTGT | 20690 CGGGCCTTTAAGGAAACCAGGAA | 31674 CCATCTACAGACACTAAGGTAGCCTCTT | 42658 |

FIG. 36N9

| | | | |
|---|---|---|---|
| 9033 GGGCCTCAGAAAACTACTGGAACT | 20691 TGGTGGTGTGGTGGGTCTAT | 31675 CCCTCTCTTGGGCCTCAGAAAACT | 42659 |
| 9034 GAAAGGCATAAACCCCACAAGCTA | 20692 CCACCACAGGCTCCTTTTCACT | 31676 GACTGATGATGCAAGAAAGGCATAAAC | 42660 |
| 9035 TGCAAGGTTCGAATCGAGTGAT | 20693 GTCCAGAATCCCAAACTGTCAGA | 31677 CCCCAGCTGTATGTTGCAAGGTT | 42661 |
| 9036 GGAAGAGCTGGATCAGAGGGATGATAA | 20694 GGAGGAGCTGCATCCATCTTTTG | 31678 CCAGAGGGAAGCAGTTGGAAGA | 42662 |
| 9037 CTGGGATAGATGGTGTCCGACTT | 20695 CCCTCCTGAAAAATAATGCTTACCCCATT | 31679 TTTGAAATGCCAGTGTCTGGGATA | 42663 |
| 9038 GGCCCTACTGAAACAGGAGAGTT | 20696 CCACAGCCCTGTCGCATGT | 31680 GCAAATCCTCGCCCTACTGAAAC | 42664 |
| 9039 GCCTATCGGCTGGTAGGATGAA | 20697 TGGTGTGGTGCTTGGCTCTTC | 31681 CACCTGGGCCTGAACATCAA | 42665 |
| 9040 GCCATACACAAACAAGCACACAATC | 20698 CCCCTGCCCAAGTATTTTAAAGCAA | 31682 CACTGAAGCCAAAAGCCATACACA | 42666 |
| 9041 GGCGCAGATACAGCGGACTTA | 20699 CCATTGCTCTCTTCAGATCCAGTAG | 31683 GGCTGTGGGCGCAGATACA | 42667 |
| 9042 GGGAAGACAGAGATATGTGACCGTTT | 20700 CAGGTTGCCCATTACAGCTATTTTGA | 31684 CAAGAATCCTATCCTGGGAAGACAGA | 42668 |
| 9043 GGGCAGCTTGAAGGAATGTGGAA | 20701 CCAGTCACAAGTGAGCCTTCTT | 31685 TCCACATGGGGCAGCTTGAA | 42669 |
| 9044 AGCTTGTGTGGCAGGTGTGT | 20702 ACACGTGTCAGTCACATCACATA | 31686 ACGGGTGTGGAGCTTGTGT | 42670 |
| 9045 TGTCCCTTTTCCTTGGGACTGT | 20703 GCAGTACCCATGATTGCTTTTCAAG | 31687 CCACAATGTGCTTTGTCCCTTTTC | 42671 |
| 9046 GCTGTTTCTTCTGGCAACAAAGTTTC | 20704 TGAAGCTGGGGACACTGAATTTG | 31688 CTGAGGATGGGAAAGCTGTTTCTTCT | 42672 |
| 9047 GGCCCTCCATTCGAAAGTCAAC | 20705 GCAAAAGTAGGCCAGTCAAGACA | 31689 GTTATCATTCTTTGGCCCTCCATTC | 42673 |
| 9048 GCCCAGACACCTATTGACTGGAAA | 20706 TGCCAGGCCATCTTGCCTTT | 31690 GGGGCAATATAGTAGCCCAGACA | 42674 |
| 9049 GCCCATGCACTGATGACTCCAA | 20707 GATGTGCAGCCTAGGAAAGAAGA | 31691 ACCTACTGCCCATGCACTGA | 42675 |
| 9050 CTGATTCCAGAGCTTGGGGAGAA | 20708 CCCAGACCCCTGCTCCAAA | 31692 CTGGTCACAGCCAACCTCTGATTC | 42676 |
| 9051 GGGCCCATTTCAGCATTAGAACTCATC | 20709 CGAAAGGTAGGCTAGGCCACAA | 31693 CTCTGGGCCCATTTCAGCATT | 42677 |
| 9052 CACAGGAATCCAGAGCCACTATG | 20710 GACAAGTATTTAGCTGTAGGGAAGAGA | 31694 TGACATTGCCATCTTCACAGGAAT | 42678 |
| 9053 GACTGATTCATTTGTGTTCCCGAGTT | 20711 GGGGTGCATCTGTGTCTGTGT | 31695 GGCAGTTTCATTTAAGGCTGACTGATTC | 42679 |
| 9054 AGCCCTACCAATGCATTCATTCAA | 20712 GGACCAAAAATCTGTTAGGTACTCAGGAA | 31696 GCCTGTCCAAGCCCTACCAAT | 42680 |
| 9055 GGAGAAGTTATTGGTCCAAGGTGAT | 20713 GATCTGAATTGAAATCCCAGCTCTTTC | 31697 ACCGAGGTTCAGAGAGGGAGAAG | 42681 |
| 9056 CCTGCTTTTGGCATGGTCTTG | 20714 GGACACCAAATTTTAGGTCAGCATTTGACT | 31698 GGTCTTGCCTTATCCTGCTTTTG | 42682 |
| 9057 GTCCTTGTGGTCCAAGTTCAACTCTT | 20715 AGCTAGCTGTGTGGGTGTTG | 31699 CCCATGTGACTCCTTGTGGTCCAA | 42683 |
| 9058 CAAGTGGGCATTTGGGGTCTCT | 20716 GGGTCCAACATGCTGTCCAA | 31700 CCACAGTGGGTTAGAGCATCAA | 42684 |
| 9059 AGTTGCTGAACTAAGGCAGCTATTT | 20717 CTGCAAACATAGTCGGAGGTATAAGAAG | 31701 CTGGCATGGATTGTAGTTGCTGAAC | 42685 |
| 9060 GGGAAACCCCACCTAAGTCACTTTC | 20718 GGGGTACCGTGATTGCCTCCATT | 31702 CTTCTGGGGAAACCCCACCTAA | 42686 |
| 9061 GGCTGGTTTGGTGTTTTCCTTTC | 20719 CCCTCCATCATAAGGTGAGCTTT | 31703 ATGTGAGGGAGGGGCTGGTTT | 42687 |
| 9062 CAGTGAGGGAAATTTGCTGTGTAG | 20720 GCCACCAGCACTATGGATGCAA | 31704 AGTCCAACAAACAGTGAGGGAAA | 42688 |
| 9063 GCTGTTAAATCCAGATGACCCAAAC | 20721 CGCTCATGGTCACAGTGGTACA | 31705 CAGACACCAGGACTTTCTTGCTGTTA | 42689 |
| 9064 GGAACATCTGAAGATCATGTGTCTTGT | 20722 CACCAGTAAGACACTCCCTGAGAT | 31706 TCATGCCCACCTTGGAACATC | 42690 |
| 9065 TCTTGGTGTAATGGGGTAGGTCTAAT | 20723 CATCCTTGCTTCCTGTTAGAGACT | 31707 GGGAGGTGACGGTCTTGGTGTAA | 42691 |
| 9066 GAGGCAACCAACAACCCTTTTG | 20724 AAGGTGAGCAGGGGCAGAACT | 31708 GTGCTTCCACAGGCAACCAA | 42692 |
| 9067 CCAGATGTGGTTTCATTCTGTGAGCAA | 20725 GAGTAGCTGCGTATCAGTACCAA | 31709 GCTGCAATTCCAGATGTGGTTTCATTC | 42693 |
| 9068 TCTGGGATGGGGAAGGATATTAGT | 20726 CGCGCCCGGTCATGAGATAAA | 31710 GCTCCATTCTGGGATGGGGAAAG | 42694 |
| 9069 CAACCCTGGCTCTCCTTCCAAA | 20727 TCCAAACCACTACCACCCAAGA | 31711 GTCTGAAGCTTGGTGCTTACAAC | 42695 |
| 9070 GTATGGCAACTGAAGACCAAGAGA | 20728 GGCACACGAGCATTCTGTCTGTA | 31712 CGGGGAGTAGACCTGCTTGTAT | 42696 |
| 9071 GACTGGACTTCTACTTTCACTGGAAAC | 20729 GCCATTGTCTGCCTCAGAAGTGTT | 31713 GACCTTTGATGGACTGGACTTCTAC | 42697 |
| 9072 TTCGATTGGCCCCTGGCTCTA | 20730 GCACTAGAGCAGGGCTTTCTTC | 31714 CCAATCAGGTCTGTGTTCGATTG | 42698 |
| 9073 GAACTACCACTGTAGCATCTCAACT | 20731 GGGGTATACAAAGGTAGTGAGGCATGA | 31715 GTGCCATTACAATGAACTACCACTGT | 42699 |
| 9074 TGGCTTGCTTGAGCCCATATT | 20732 CCAGCCCAACAAAGCCCAGATT | 31716 CGCTGTATGAATGGCTTGCTTGA | 42700 |
| 9075 GTTTGCACTGAGTTGCACATACTT | 20733 CTCACCCTTGATCAGCTCCCATTC | 31717 GGGATAGAGAGTTTGCACTGAGTT | 42701 |
| 9076 GAGGGGAGAAATGGAAATCAACTGT | 20734 GCCACTGGAACTCAGAAGAGTCAA | 31718 GACAAAAGGCTAAGAGGGGAGAAATG | 42702 |
| 9077 CCAGGCTAGAAAAGGCCTGGTAA | 20735 CTCTGGTTCCTCCTGCAACCATT | 31719 AGGGTGGCCAGGCTAGAAA | 42703 |
| 9078 CATGTAGGCTTCCTGTCCCTATAC | 20736 GTGGTTATCCAGAGAAGGTGGAACA | 31720 CCCTTTGTCCAGCCCACACAT | 42704 |
| 9079 GGCAAAAGAAAGCAAGATGCCTATG | 20737 CCCCAGCTCCAGTGGATGAAG | 31721 GGGAGGCAAATCTCTGGCAAA | 42705 |
| 9080 GTCTACCCAGTGCTGCAGTTTC | 20738 CCTGCCCTTGTCCACAATGTT | 31722 CCAGGGGATATGGGCTCTGTCTAC | 42706 |
| 9081 GCAAGGAAATACACTGTCACTACTCCTA | 20739 GCACTGGCTAGGACTTCCAGTATG | 31723 GGGAAGAAGGCAAGGAAATACACT | 42707 |
| 9082 GGGCAAATTTCAAAGTCAGATGGAT | 20740 TTTCCCGCTATATCTGTCAAGT | 31724 CCAGGACCTAGGGCCAAATTTCA | 42708 |
| 9083 CCAACTCTGCTTTGGAGAACCTGTTA | 20741 GGAAGAAGGCATCCCATTTGAAACA | 31725 CGCTTCTTTACACTTCCAACTCTGCTT | 42709 |
| 9084 CTGTCAGCTCACGAGTGTGTTT | 20742 CACCCAGGTCCCAATATAACATGA | 31726 GGACTTTCTAATATGTGTCGGCTCTGT | 42710 |
| 9085 CCCAGGAAGAAGCAGAGGTAGTTG | 20743 CAAGATAAGTGCCATGGTTGTCTCA | 31727 CTTTAGTAAAACAGCCCAGGAAGAAG | 42711 |
| 9086 GACTTGGTCCATAAAAATCTCTCCTTGCAT | 20744 AGTTGGCACAGAGAAAAGTGTTTG | 31728 GATGTGTGCAGACTTGGTCCAT | 42712 |
| 9087 GGGGCAAATTAGGCTGACCTTTG | 20745 GTCTGTGCAGAATAAAGCCCAAACT | 31729 CTGGAGGGAGAGGGGCAAATTA | 42713 |
| 9088 CAGTCTCCTTTGCCATTCTGCTACA | 20746 ACCAGGCAGGCTTTGCTGAA | 31730 GACTGTGCATTCAGTCTCCTTTG | 42714 |
| 9089 ACACCATAGGTAGGGCTCACA | 20747 TCATCCTCCCAACCTGACTGT | 31731 GAGTGCTGTCATCCTAACACCATAG | 42715 |
| 9090 TCTGTTGCCTCAGCTCTTTTCA | 20748 TGTCAGAACCTTGTTGAGTTGTGA | 31732 AGGCTTTTCTCTCCCTCTGTTG | 42716 |
| 9091 ACTTGGAGTTGGTAGGTGTCTTTAG | 20749 GACTCAACCATCTGCTGCCTAAAATAG | 31733 CCACCCCTTTACTTGGAGTTGGTA | 42717 |
| 9092 GCAATGTCGCAGAGAAGGTAGTCT | 20750 TGCTGGGGAGTTAAAGGAAATTGT | 31734 CTCAGTGGACATGAGTTTGCAATG | 42718 |
| 9093 GTGGGGAGACTCTAGACTGGAT | 20751 CAGGACCACAATTGATGCCATTT | 31735 GGTGACTGACAGTGGGGAGACT | 42719 |
| 9094 ACCGTGTCGCATGGTTCTCT | 20752 AGTAGGAGACAGAGGGTTTCTATCAT | 31736 TCCTGGTGGTCATCCCTGAAAC | 42720 |
| 9095 GAGGAAGAGCAAGATGGCAGAA | 20753 AACTTGGTGTCTTTGTGGGGTTA | 31737 CCAGAGACACGAGGAAGAGCAA | 42721 |
| 9096 GTCAGAACCAGGTATCACTGAGCTA | 20754 GGGGTGGCAATAGGAGCACTTT | 31738 CCTCACTGAAGTCAGAACCAGGTA | 42722 |
| 9097 TCCGAAAAGCCATTGTGTTTACCTA | 20755 CATGCCAAGCTGTGCTGACT | 31739 ACAGGTCCGAAAAGCCATTGT | 42723 |

FIG. 36N10

| | | | |
|---|---|---|---|
| 9098 CACTTATCTCTAGGGGTCCAGAAGA | 20756 TGCGTGAGTGGGTGCAGAAT | 31740 CCTCTGGGGTCACACTTATCTCT | 42724 |
| 9099 CCTGGCCAAACCCTGTTACCTA | 20757 CTTCTACTGAACTCCTGGAAGGAGAA | 31741 CCTGCTGTAAACCTGGCCAAA | 42725 |
| 9100 AGGTTCAGCTCCCCACTAGTCT | 20758 GCAGTCCATTTTCCACCCAATC | 31742 GCTAGGCAACGGTATGGAGGTTCA | 42726 |
| 9101 CTCTCTGTAGTACTTTGCCCAACA | 20759 GGACCAGGAAAGGAAGGTGCATAG | 31743 TGGGACTGGCCCACAGAACT | 42727 |
| 9102 CCTCTACACCCTTGGAATACTCTCCTT | 20760 ACATTTGGGATGGACATTCAGAACA | 31744 CCCATCCCCACACTCCTCTACA | 42728 |
| 9103 CACTGATGGTCTTTCTTCTGGACCTTT | 20761 GGGAAGGGAATCTTAGGCAGAGGAA | 31745 CCTGAGCACAACACTGATGGTCTT | 42729 |
| 9104 GGAGCTACAGACCTGGCTCTCTT | 20762 CCCCAGTGGAAGAGAGATATCCAA | 31746 TTGGAGGGCAGGAGCTACAGA | 42730 |
| 9105 GTGCTTAGAGCTGGATGGCTGAA | 20763 TGAACTTTAGGCTGCCTTTATGGAA | 31747 CCCAAGGCTATAAGGGGTGCTTAG | 42731 |
| 9106 TCTGCTCTTTGAGAACTGTTGCTT | 20764 GTGGGCTCAGGGAATCATACTAC | 31748 CTGAAGACATGTACATCTGCTCTTTGA | 42732 |
| 9107 GCCCTAACTCCCAGGTGACATT | 20765 TCAAGGCAATGGGTTTCCTTCT | 31749 GGCCCTTTTTACAGGCCCTAAC | 42733 |
| 9108 GCTTAAGGGGAAAGAATGGAGCAAAC | 20766 GGGCAGAGGTTGGGTACCTT | 31750 CGTCCCTCTGCTTAAGGGGAAA | 42734 |
| 9109 GCCCTTCAGAGCTGCCATTC | 20767 AGCCAGGTCTGGGAGACAAC | 31751 TCCCTCCCTGCCCTTCAGA | 42735 |
| 9110 CGGGCAGCCTTTTCAAAGAAGT | 20768 CACGGTGAGGCCATTCACT | 31752 GTCATAAACATACGGGCAGCCTTT | 42736 |
| 9111 AGCCAGTCCAGGATAGGCCAAA | 20769 AGGCCAAGATCAGCCTCCTT | 31753 GCTCCTTGGCTGTGTAACTGTGA | 42737 |
| 9112 GGGCAGGGTGGGAAAAGTTC | 20770 TCGACCCCAGGTCCATCAACT | 31754 CGGAGGTGCGCTCCATAAG | 42738 |
| 9113 AGCCCGGTAAGATAAATTCCTGATT | 20771 GACGCAAACCAAATCCCAACTGT | 31755 GAAGCTCAAGCCCGGTAAGAT | 42739 |
| 9114 GGCACCCAATTGTTTTGAGGTT | 20772 TCCCTGACAACTCCTTCTAAGACT | 31756 TGAGTCCCAGGGCACCCAAT | 42740 |
| 9115 CCCTTTTGGAGTAGCAAGGGTTAC | 20773 CTGCCACTTACCTAGGGTCAGAA | 31757 GGAGAACAATACTTTCCCTTTTGGAGTAG | 42741 |
| 9116 CACCATCCCTTAATGCTCTTGTGA | 20774 GCCCTTGCCTGTGGGCTTT | 31758 GGAGCTTTAATTGTCTCTCACCATCCCTTA | 42742 |
| 9117 CAAGGCACAAGTGAAAAGCTGGAA | 20775 GCCACTGCTGATCTCATCCCATT | 31759 CGTGGCAAGCCACAAGTGAA | 42743 |
| 9118 GGGATGTGTGGTTTTGGCAGAAG | 20776 GACTCACATCTATTCCCTTGGTTACT | 31760 GACACAGTGGGATGTGTGGTT | 42744 |
| 9119 CCATCTTGCTACTACGCCTCTCT | 20777 GAGATGGGACCTAGATAAAGCAGAAG | 31761 CCTCTCGCCACCATCTTGCTACTA | 42745 |
| 9120 GGCAGTAGAGTCACATCACCTTGA | 20778 GGCCAACATCTGGGATTGTGATAC | 31762 GGCCCAGGCAGTAGAGTCA | 42746 |
| 9121 TCCCTTTACCCTGGGCTTCACA | 20779 GGACTTGTGTTTGCTGTGGTTT | 31763 CTAGATGTCACTGCCTCCCTTTAC | 42747 |
| 9122 CAATGCCTGTTACCCTAGGTATTACT | 20780 GCTCTTGCGGACTGGTGCATA | 31764 CCAGTTTCTCAGTAAAACAATGCCTGTTAC | 42748 |
| 9123 CAACGTCTATCCTGTGCCTGAA | 20781 TGAACTCCTGGGGCCAAGT | 31765 CGTGCTGTCTGCAAACAACGTCTA | 42749 |
| 9124 GGCAAGTGTTGAAAAACTTCCTGTT | 20782 GATCCCCTTGCTCAGTTAGTGAA | 31766 GAGGAACAGGAGGCAAGTGTTG | 42750 |
| 9125 CAGGTTGTGTTGGATGCGTAAAG | 20783 GCACTGTAACTGCGAAAACATCTT | 31767 GGCAGGCCTGATAACAGGTTGTGT | 42751 |
| 9126 GGCCATCCTGTAGCCACCAAAT | 20784 AGATTCAGCCTAACAGTCAGTCAAT | 31768 GCAAGCTGGCCATCCTGTAG | 42752 |
| 9127 CCAGGTTGCATCCCTTCTCAGGAA | 20785 AGTGACCACTGAGACTGACACT | 31769 TCCCCTTACCCAGGTTGCAT | 42753 |
| 9128 GGCTCCATTCCAATGGCACAA | 20786 CCTGATAAGTTAAGAATGGGTCCCTGAT | 31770 GTCCTGAAAGCTTTTGGCTCCATTC | 42754 |
| 9129 GGCCTTGAAATGCAGCGGAGAAA | 20787 CCGACTCTGACACCTGACTCCTAT | 31771 GTGTTGGTCTCGGCCTTGAA | 42755 |
| 9130 TGAATCAAATCTTCTGCGCTAGGAT | 20788 CCCCTGAAAAGCTTGTCCAATAACA | 31772 GCCAGAGTTCTACCCTATCTAATGAATC | 42756 |
| 9131 GCAAAGCTCAACCTCAGGGATTC | 20789 GCCAAGCTGACTTGTTGGTACTGT | 31773 ACCACAGGCAGATGAGCAAAG | 42757 |
| 9132 GTAGTCCCATCTGCTAGAGAGGTT | 20790 TGACCTCCAGGGCTGAAGTGAT | 31774 GTGGCATACACTTGTAGTCCCATCT | 42758 |
| 9133 GGCCTCCAAAAGGTAGCTTGTTCT | 20791 GCTCTGCACTTTTCAGTGGAGGATA | 31775 GCAGCTCTTACTTAGGCCTCCAAA | 42759 |
| 9134 CCTCTCTTCCTCCTCTTTCAATGTGCTA | 20792 GGGTTCCTTTTCAGCATCATTTGT | 31776 TGCAACCTCTCTTCCTCCTCTT | 42760 |
| 9135 GGCAGCAGTTCATGGGTAGAA | 20793 TCTTCCTCAGCTCAGTCCTTACA | 31777 GCAGGTTGAAGGCAGCAGTT | 42761 |
| 9136 GGGCCACAAGCCTTTGAGTGTA | 20794 GACTGCAATACCCCTTCCAATTTC | 31778 AAGCAACCTCGGGCCACAA | 42762 |
| 9137 GGGAATGCCCCGTTTTGAATC | 20795 CCTTGCCGGGAAACAGACAGA | 31779 TGTCCTGTCCTGAATTGGGAATG | 42763 |
| 9138 TCAAGGCAGCATAGTGTCATGAAT | 20796 CCAGAAACACAGCTTGTTGGACAAA | 31780 GGATGTACTTTGTTCAAGGCAGCATAG | 42764 |
| 9139 TGCGATGTCCGTGATGATGATG | 20797 CACATCCTAATTCACTCCAGACTATGGAAA | 31781 ATCCCATGGGTGTGCGATGT | 42765 |
| 9140 GGAGAGCTGTACTATGGTAAAGTTGAGA | 20798 CAGAAAACTGGCTATGGGGAAATTCCTA | 31782 TCTTCATCTCTGGAGAGCTGTACTAT | 42766 |
| 9141 ACACAAACACTACCTACCTCCTAAGT | 20799 CAGCTTCAGATTCGGGCAGGTT | 31783 CAGCAATGTGCGAAACACAAAC | 42767 |
| 9142 CCTCAGGGGAATGAACTTCTTTTAGA | 20800 GCTAGAGGGGAGGAGTTCTGAAG | 31784 GGGAATTTTCCTCAGGGGAATGAACT | 42768 |
| 9143 AGGTGCAGAAAGGCCATGAAG | 20801 CTAGCCAGCTATGCTCCTGTTAC | 31785 CACCCAGGAAGGTGCAGAAA | 42769 |
| 9144 GCTATGCGAGAGGGTTGCTTGA | 20802 GGGGTGCAGCGGCATAATCA | 31786 TGCACCTCCAGTCTCAGCTAT | 42770 |
| 9145 CCCTGTGCTGTTCTCATTATTCTTTG | 20803 CCTAAAGCCACGTGATCTTTGACA | 31787 TCCTGCCCTGTGCTGTTCTCA | 42771 |
| 9146 GCCCAAGGCTATGTCTTCTGT | 20804 GCCTATTTCCCTTGCACTGTGA | 31788 TTGTGTACATGCCCAAGGCTAT | 42772 |
| 9147 AGGGCTCCATGATCTCCACCTT | 20805 GACCAGTAGGACTCCAGTGGAAGA | 31789 GCCTGGTATTCAAGGGCTCCAT | 42773 |
| 9148 GGACTGTTGTGGTACTGGCAAT | 20806 CCAAAGCAGACCGACTCTCCTACA | 31790 GATATATTCGGGCAGGACTGTTGT | 42774 |
| 9149 GCAGCTAAGTGGCAGCTCATCTTG | 20807 GTGCACACATCACACATCCTTGT | 31791 CCCCTCTAAGGTCTTTGAGCAGCTA | 42775 |
| 9150 GTCGTTTGCTTGCTGTTTTAACTGT | 20808 GGCCAACTACAAGTCCCTAGCTCTTT | 31792 CTGAAGAGGGTGTAGTCGTTTGCTT | 42776 |
| 9151 GCCAGAAAGTGGGCTTTGAGTGT | 20809 ACGGTGGAGGTGGGTGTAGA | 31793 GGCCATCACAGCCAGAAAGT | 42777 |
| 9152 GGTGTCTCAGACTACTCCCATGAT | 20810 GGGTCAAACTGTAGGCTAGACCAAT | 31794 CGGAAAATGCTAGGGAAGGTGTCT | 42778 |
| 9153 GAACGATAGCCCCTAAAATGATGTGT | 20811 TGGCAAAGACACTTTATCACAGGTT | 31795 ACTACGTGTAGGTGAATTGAACGATAG | 42779 |
| 9154 GCTACCCAGAGATAGAAGCACACCTA | 20812 GGGTGTTAAAAAGTGCTTTGCTCCAA | 31796 GAAAGGAGTGCTACCCAGAGATAG | 42780 |
| 9155 CGCTGACCAAGTCTTGTTTGAAT | 20813 AGCCAAACCTGACTCCATCAATTT | 31797 CAGTTCTGCGCTGACCAAGT | 42781 |
| 9156 GGGCCTTTATACTCACAGCCATAG | 20814 TGTCTCCTGGTAGTTCTTGGTAGT | 31798 CACCTGCGGCCCTTTATACTCA | 42782 |
| 9157 GGGCATGCAATTCAGGGATATGAA | 20815 CAGCGTCACTGGATGGGTAATG | 31799 GAGACCTTTGAGGGCATGCAA | 42783 |
| 9158 CCCATCTTTCCCCACGAAGTATG | 20816 CAACCTGATAAAGGGCAACCACAA | 31800 AGGGGAAAAGCATCCCATCTTTC | 42784 |
| 9159 AGCTGATACCCTCCAGGTCTTT | 20817 GGCTGCACCTTCACAAATGGAT | 31801 GGGCAAAAGGATCAGAAAGTCTAAG | 42785 |
| 9160 TGACGATAGTCACACCTTCACAAAG | 20818 TGGCTGGAGGTGAACAGTTG | 31802 GGCTGAGTAGGTTTGTGACGAT | 42786 |
| 9161 GTAGCCCAGCCTTATTCAAGGAA | 20819 TCCAAGCCCGCAGTTCTTCA | 31803 CTGAGATCTTGTAGCCCAGCCTTA | 42787 |
| 9162 GCTAGCTGCTGAGACAGTGAAG | 20820 AAATTGTTGGCTCGCCTCTCT | 31804 ACGTACCCTACACCAGACAACA | 42788 |

FIG. 36O1

| | | | |
|---|---|---|---|
| 9163 TGGCAGCACTACCTGAGAGT | 20821 CACCAGTTCCCATGGAAAACCATAAG | 31805 GCAGAGTTGTGGCAGCACTA | 42789 |
| 9164 GCCCCTTAGGTAACTGCTGATAG | 20822 CCTATTTGCTTCCATCCTCCTAGTAGATTT | 31806 GATTATCTGGATGCCCCTTAGGTAAC | 42790 |
| 9165 TGCTCTCTGAATTGACTCACTGTT | 20823 GCGTTTTGGTAACCCAGACAAAG | 31807 GCTTTCTATCGCTGATGCTCTCT | 42791 |
| 9166 TTGATCACCATGACTCTGCATGT | 20824 TGCCTCATGCCTGGACTAATTT | 31808 CTGCTGGGTCTTTGATCACCAT | 42792 |
| 9167 CCTGCTCAAACTGATTTCTCACTCTCT | 20825 CGAAGGTAAGACTCTGGCAAGTGAAG | 31809 GCCACATCCACACCTGCTCAA | 42793 |
| 9168 GAGGTGCCTGTTTCCTTTCTGGAT | 20826 GGAGCAGCCTCAAGGACCTTAT | 31810 TGTGTAGACAGAGGTGCCTGTT | 42794 |
| 9169 CCCTTTCGACTCTCAAAACTTCCTTAC | 20827 GCAGCTGTTATATGTACCTCTGTACT | 31811 GCCACCTCAATACCCTTTCGACTCT | 42795 |
| 9170 TCCTCCCAGAAACCTGGTGCTT | 20828 AAGGACAGGGTAGCAAAGTGTAG | 31812 TCCACTTCCTCCTCCCAGAAAC | 42796 |
| 9171 GCCTGCCACCATTTCATGGTTA | 20829 TGTCTGTAACCCAGGAGTCTCA | 31813 GCTAAAAGTTAGCCTGCCACCAT | 42797 |
| 9172 CTGTGACACCAAAGGCAGAAACA | 20830 TGGGATATTGGCCTGAAGTTTTCTT | 31814 CGGCATCACTGTGACACCAAAG | 42798 |
| 9173 GGTCGGAATGATGACCCCTGTT | 20831 AGGCATCAAATACCTCTGTGCTT | 31815 CCTTTATGTAAGCAGGGTCGGAATG | 42799 |
| 9174 GAGCATTCCAGCAGAGGTCAGT | 20832 CACCATAGCAGTAGTGCTGGTCTA | 31816 GAGATGGGCCAGAGAGCATTC | 42800 |
| 9175 CCAGGAGCCAGACTTGAGAATCA | 20833 GCCTCATTGTCACCTTTTCTCCTGTA | 31817 GTGTGTTTCCAGGAGCCAGACT | 42801 |
| 9176 GGGTAGAAGCCATTGGTATAGTTCA | 20834 GGGCAAGGAGAGGGGTGTTTTA | 31818 ACTCCGATGGGTAGAAGCCATT | 42802 |
| 9177 GTGCCAGTCCTTGTGTTAGGTTCT | 20835 GCAGCCTCTGTAACAGGGTTTGAT | 31819 GACTAACTACTCTGTGCCAGTCCTT | 42803 |
| 9178 ACCAGCCTCTGTACCGGCAAT | 20836 GGCTTCCTTTACTGGACCTACTTTC | 31820 AGATGGCACCAGCCTCTGT | 42804 |
| 9179 GCTCTGGGATCATCACACAACA | 20837 CCCACTGGTTCTGGCTCTTTGT | 31821 GACTTGGCAAGCTCTGGGATCAT | 42805 |
| 9180 TGACGCTTCTGTTTCCAACAGTTA | 20838 CTCAGCTTAAAAACCAGTGTCCTAGA | 31822 CTCATGTAGCATGACGCTTCTGT | 42806 |
| 9181 CCTCTCTGTACTTTTGCACTCACTGT | 20839 CAGAGAGGAGCAGGACATTCCATAC | 31823 AGTGGTTCGCCTCTCTGTACTT | 42807 |
| 9182 CCTCCCCTCTCACACAGGAAGA | 20840 GGCCAAGGCACCTTCTCATTGT | 31824 TCCCTTCTCCTCCCCCTCTCA | 42808 |
| 9183 CACATTTCCCAAACCAGACTGTAGAGA | 20841 AGGTTCCAGGCTGCAGTGA | 31825 AGACAGGGTCTCGTCACATTTC | 42809 |
| 9184 GATTCCAGCAGCATGAACAGACA | 20842 GCTCTGCGTTCCCGGAAGT | 31826 GGCCTTGGTTGATTCCAGCAGCAT | 42810 |
| 9185 GGAAAGGGTACTGGGATTTTTGTTTAG | 20843 CATTCTGAAAGTAGGGAGGGACTAAG | 31827 GCTAAATAAGCAAAGGGTACTGGGATT | 42811 |
| 9186 CCTGAGCTAGCCTTTCCACACT | 20844 CACCTTCCCAAATGGAGGACAT | 31828 TGGGCATGAACCCTGAGCTA | 42812 |
| 9187 CCCTCAGGTTTGGGAATAGTCATC | 20845 TCAGGCCCTAGGTTCAGTCTGT | 31829 GATCTTCGGTCCCTCAGGTTTG | 42813 |
| 9188 GTCGTCACTACAAGGGGCTCAA | 20846 GGGGTCTGCTCTAGGGAACAATC | 31830 GGGCTTGGATCTTTGTCGTCACT | 42814 |
| 9189 TGGGGTCCTCACAAGGAAATGT | 20847 AGAACAGAACTCACTGGAATGACAA | 31831 GTGGGCGCTTTTGCTTCTTG | 42815 |
| 9190 GTAGAAGACTACTGCTCTGGCAAA | 20848 CTGCTGTATGTGACTGACTGGAATTG | 31832 TCCGGGCAGGGAGTAGAAGACTA | 42816 |
| 9191 GAGCTGGGAATTTGGTGGTTTTG | 20849 CATCGAAGTGGCAGGAAATGAAG | 31833 GAAGGCTAAATGAGCTGGGAATTTG | 42817 |
| 9192 CACCACAGGTTTCTTGCCAATC | 20850 GACAAGTCCAGCTCAGAGAATGAA | 31834 TGAGATGCTTATCACCACAGGTTTC | 42818 |
| 9193 CCCTGGAGGTCAGACAGAGAAGT | 20851 CCTTGACTGACAGGTAACTCACAAA | 31835 ACATGCACCCTGGAGGTCAGA | 42819 |
| 9194 GAGGAGTGTGGTGGTTGGAAA | 20852 TCTGAAGAACAGGCTCAGTGTTG | 31836 GGCTGTGGACGAGGAGTGT | 42820 |
| 9195 TGTGCTGCGCTGACACTTTG | 20853 TTCTCCAAAGAGGATTCTGCTCTAC | 31837 TGGCATCCCTTGCAGTCTGT | 42821 |
| 9196 CTCTCCAGGTACAACCCCAGTA | 20854 GAGCTGAGCACTGGATGAGACTTA | 31838 GCACTCCCTCTCCAGGTACA | 42822 |
| 9197 CCGTCTTCAAAGCCAATGCTAAG | 20855 GCCGATTGAGCAAGTGAGTTCTCCTA | 31839 GAGTTTTCCCGGTTACCGTCTTC | 42823 |
| 9198 GGAGGGCAGCATGGATAAAGAA | 20856 GGACTTTTCCCAGGGCCTCAAA | 31840 TGGTGAGGAGGGCAGCAT | 42824 |
| 9199 TGTTGCCAAAAGTTGCTCAGTAAG | 20857 GACTGCAGGGGTTTCACTTGT | 31841 GTGTTAAGCATGTTGCCAAAAGTTG | 42825 |
| 9200 CCCACACGCTAAAGGCAAGAAAAC | 20858 GTCATCCCATGTGGCCTGTAGT | 31842 TCCATTCTCCCACACGCTAAAG | 42826 |
| 9201 GCCCTCTACCCTTTCCACTAAC | 20859 GGATGTCACTTGTGGGCAACT | 31843 TTCTGTTGCCAAGCCCTCTAC | 42827 |
| 9202 CTGCCTTTCACCAAGTTCCTTTC | 20860 GAACGCGGCTCACTCATTTG | 31844 TCTGCCCTGCCTTTCACCAA | 42828 |
| 9203 GCCGATGGTTGCATTCCTACT | 20861 GGCGCCAGTGCTTTATGTCT | 31845 CATCCTGGTTTGCCGATGGTT | 42829 |
| 9204 CCACTGGGGTTGAGAGAGAACA | 20862 GGAGGATTCTCATCTTCCTGGTATCATC | 31846 TGAGGCCACTGGGGTTGA | 42830 |
| 9205 CCATTGCTGGCCGTGTCACT | 20863 AGGGGTGGTCTCCTCCCTTAT | 31847 AACTTCCCCTCCTGCCCATTG | 42831 |
| 9206 GACCACCTTTTTCCTACAGAGATGT | 20864 TGTGCAGTGGGCAGGAAGA | 31848 CCTACTCACCCATTTATGACCACTT | 42832 |
| 9207 AGTGGAGCTGTTTGTTTTCTACCTA | 20865 CAAACAACCATAGGTCCTTTCTCTCA | 31849 GCAATGGAGTGGAGCTGTTTGT | 42833 |
| 9208 GGGGTTCTGAGGTGCACATAGTTAAG | 20866 GGTCTCTTAGTTTAGAGGTCACTTCGTT | 31850 TGAGGGTAAACAGGGGTTCTGA | 42834 |
| 9209 CTCTACTCGCAAGGGTCTGTT | 20867 TTGAGGAGGGGAGAGGCAAAAG | 31851 CAGTAACCAGAAGCCGCTCTAC | 42835 |
| 9210 GCCTGTCCAGTCTCATCTAGCATT | 20868 GCAAACACAGTGTAAGGTAGTAAGAAC | 31852 GTGTTGCCTGTCCAGTCTCA | 42836 |
| 9211 GTAGTGGAGCACCCAAACACTT | 20869 CTTTCTCCAGCAAGCTCTCTTTTTAC | 31853 AAGGATATGATGGGTGCATTGTAGT | 42837 |
| 9212 AAGAGAGAGCTGTCCTCCTTGA | 20870 GCTGGCAGGACTCATGTGAT | 31854 TGAGCTCAGGGAAGCAAGAGA | 42838 |
| 9213 CTTCTTTAGGGCTTGGTGTCACT | 20871 CCAGGATGGCCAACACATTCTT | 31855 ACCCCAGGTTGAGAATAACTTCTTT | 42839 |
| 9214 GCTGCTTTGGTCTGCTGTTG | 20872 CAGCCGTACTGCCTTTCACA | 31856 GGCTTAGCTACTTTGAGCTGCTT | 42840 |
| 9215 CAGTTTCCCCTGGGAGCACTTT | 20873 GCAGACCCTGAGATGGAGATTG | 31857 TTCTCCTGCCCTTACCAGTTTC | 42841 |
| 9216 CGAGTTATCTAATCCTCCCCTACAATG | 20874 CTGCTTGCTCAGGGTTGTGAAAA | 31858 GCGATGGGACAGTTTTCGAGTTATC | 42842 |
| 9217 CCTCCCTGCAAAGACACTTACA | 20875 CTCCAAGCCGGCTCCTTTACAT | 31859 GAAGGTTCATTCCTCCCTGCAA | 42843 |
| 9218 TGCAGCTGTACTTTATGGATGACAA | 20876 GTTTGGAGCTCTCCCTGAACAATAAA | 31860 CCCACACACTTCTTGCAGCTGTACT | 42844 |
| 9219 TCTGGCTCTATCACCTGGGTTT | 20877 TGACTTCAAGTGAATTGTGGAGCTT | 31861 CCCCATCACTCACTCTGGCTCTA | 42845 |
| 9220 AAGGGGAGTCGCATGGGTTA | 20878 GGCCCAGTGTCGAGTTTGTCTA | 31862 TGGGCAACGTGGGGTCAA | 42846 |
| 9221 AGCGGAAAAACCTGGCTAAGA | 20879 GTTCACGTGGCTGAGACAAAC | 31863 GGTGCATGGCATAGCGGAAA | 42847 |
| 9222 GGCAGACTGTGACGTTAGTGAGA | 20880 GGCATACAGGAAGGGAAAGGATGACA | 31864 GCTGAGGAAAGGCAGACTGTGA | 42848 |
| 9223 GCCATTGGAACCTAGAATTCTGTCGT | 20881 TGCGGGATGCAGAGCAAA | 31865 GACACTTGGCCATTGGAACCTAGAA | 42849 |
| 9224 CCACACTACTCCATGCCAGGATCT | 20882 GAGACTGAAAAGCCTCCAGACA | 31866 TTCCAGGGCCACACTACTCCAT | 42850 |
| 9225 AGTCACAGAACTCCCCAGAAATATAC | 20883 GTCATTGTGGGAAGTGCATTTGTT | 31867 GTCTCTGTCATCACAGTCACAGAACT | 42851 |
| 9226 CACCCTTGGCTATAGCTGCTAATTTC | 20884 CCAGGACACCTATTTCGTACCCATT | 31868 CACACCTCTCACCCTTGGCTAT | 42852 |
| 9227 GCCTTTTGGGAGCCCGAACTAT | 20885 GACGGTGATTGTGATCTGCTACTA | 31869 TCCCAGGAAGCTGCCTTTTG | 42853 |

FIG. 36O2

| | | | |
|---|---|---|---|
| 9228 CCAGTTCCCCACAGAGGAGGAAAA | 20886 CTGCACCATCTTAACCCCACTTC | 31870 CCCTTCCAGTTCCCCACAGA | 42854 |
| 9229 CCTGTCAACATGATGGTCGTAGTAAC | 20887 GGGCCTAACAATCCACCAAAACA | 31871 GGAATCTTGCAGCTCATCCTGTCA | 42855 |
| 9230 CCTGTGTAACATGACTTGTACTCCTA | 20888 CCAGCTTTCTATGACATTGGGCTAT | 31872 GTTAGTGAAGCAGTCCTGTGTAACAT | 42856 |
| 9231 GAAGAAAAGCAGTTCATCCCAAACA | 20889 CCAGTTACTACCCTGCGCTTAATG | 31873 GATGGCATACGACCAGAAGAAAAG | 42857 |
| 9232 GGGAGCTTGCTTTCTCTCTTTACTCT | 20890 TGGAGATGGCTGTCTTCTCATTTT | 31874 GACCTAAGGGAGCTTGCTTTCTCT | 42858 |
| 9233 CCTGGTTGGGTGTCTTTGTGT | 20891 GCACAGGATGGACATCAGGTTCACT | 31875 CCCAGTGGACAAGTACCTGGTT | 42859 |
| 9234 AGAAGAGAGGTCCTTCTGGTATGT | 20892 CCCAGGCTCTGTGCTTTGA | 31876 TGGGCCACAGCTCCCAGAA | 42860 |
| 9235 GGGCAAAGGAGTGGCATAATCT | 20893 GTGCACAGCCAGAATCATCCTT | 31877 GAGACAGGAGCCACTGGAATTTTG | 42861 |
| 9236 GGCTCATGGTAGCTACACCTTTC | 20894 GCAGCCTGGTGGACTATTGGAT | 31878 GTACTGTGTGTGGCTCATGGTA | 42862 |
| 9237 GGCTTCAGCAGAGTAAAGTAGGAA | 20895 GCCCCTGCCTGCATCTCTA | 31879 AGGTCCCAAGACTGTGGCTTCA | 42863 |
| 9238 CCAACTCTCCTCCAAACAGTGATTC | 20896 GGAGGGGACTCAGGGACCTAAAAT | 31880 TCTTGAGACCAACTCTCCTCCAA | 42864 |
| 9239 CAGATTACACGCGATTCACAAATCA | 20897 AGTCAGTAGGGTTGCAGAAAGTATAAC | 31881 GCGCTCAGATTACACGCGATT | 42865 |
| 9240 GAAGGAAGTAGAATCCACCAGATCAAC | 20898 GGCCTCTGTCCCTTCTCTTTAC | 31882 ACAGCTGTGAAGGTATTGAAGGAA | 42866 |
| 9241 GGAGGAGGAATCAATGATGGTGTAGAT | 20899 CTCCCTGCAACACCCTCTTATC | 31883 GGAGCAGGAGGAGGAATCAATG | 42867 |
| 9242 GTCTGCTAGGGTTAAACAGGGCTTT | 20900 CAAGGTGGTAACCTGTGATTTGGTT | 31884 GCCCAGGTCTGCTAGGGTTAAA | 42868 |
| 9243 CAGCACAGCCATCATTTCTTCCAATG | 20901 GGAGGAATAATGTTTGCACCAGGGAAT | 31885 CCATCCTCAGCACAGCCATCA | 42869 |
| 9244 GAGATGTGCCTATACTGCGTTTGAAG | 20902 GGCCCCTCCCTCTTTACAACT | 31886 CAGACAGGTTGAGATGTGCCTATAC | 42870 |
| 9245 TGGGAGGGAATGAGGTGTTATCT | 20903 CCGGGTTCGGGTCACCTTT | 31887 ACGACAGTAATGGGAGGGAATGA | 42871 |
| 9246 GAGACAAAATCCCACTGTCAGGATAAC | 20904 AAGAAGACCCACCCCTCAGAGA | 31888 GGGAATGGCTGATGTTAAGAGACA | 42872 |
| 9247 GGCACAGAAGTAGAGGCTGTAG | 20905 AGTGGGGCCTGTCCTCAAGT | 31889 TTGGGAGAAGCAGGCACAGA | 42873 |
| 9248 ACACCCCAGGTCCTGACTGATA | 20906 AAGGACGGCGCAGTGAGGAA | 31890 ACGCTGGAGCTGGTGAAACA | 42874 |
| 9249 CCTCTTGTTTGCCCCAAGCTTTC | 20907 GGTCACTCCCTCATCAGCTTAG | 31891 GTGGCAAAATTGCCCTCTTGT | 42875 |
| 9250 GCTTTTCAAGAACGGGAGACACACA | 20908 CCCTGAGCCTAGGGTATTGTAATTT | 31892 GGACCACGGATGATGCTTTTCA | 42876 |
| 9251 CCAGGAAGGAATGTTTTTACCTCTTC | 20909 GGTGCAACTGATGGCTGTAGT | 31893 ACCACATAAAACCAGGAAGGAATGT | 42877 |
| 9252 GGAGTGGCTTTCATTACCCTCAA | 20910 GAGGAAGTTTGAGCACACTGGGTTA | 31894 GCCCTACAGGAGTGGCTTTCAT | 42878 |
| 9253 CCTGGCTTTAGTATATGCCGAGACA | 20911 CTTGGTTCTGAAGTTTTCAGGTCAATC | 31895 GGCACAAGGAGTCCTGGCTTTA | 42879 |
| 9254 GCCCAAACTCCACTTAAGAGCAGAAA | 20912 CCCCATAAGCTCCCACTTAGTGTAT | 31896 CTCTCATGCCCAAACTCCACTT | 42880 |
| 9255 AGGCTCCAGTTGGGGACACA | 20913 CTGCCCAGTGCTGTATCACACAT | 31897 CGACAGCACAGCCTCCAGTT | 42881 |
| 9256 CACTTCCATCCACCTGCAACA | 20914 GTCCGTCCAAACAAAAGGTTGACT | 31898 GCACTGCGGATCACTTCCAT | 42882 |
| 9257 GCAGCTCCTCCTACAACAAAGA | 20915 ACACAAAAGACTTGGACTTCCTTCT | 31899 CCTGTGTTTTGCAGCTCCTCCTA | 42883 |
| 9258 CTGCCTGTTGAGAGACTTGACA | 20916 GGCTCTTCTACATAATACTCTTCTCTCATC | 31900 CCCTGCAGATAATTCTGCCTGTTG | 42884 |
| 9259 CCGTGTTTGCCCCTCCTTTT | 20917 TCCGGGCCACTGGGGTAAAT | 31901 CAGCCAAACATAAAGCCGTGTT | 42885 |
| 9260 GCCCTACAGGGAAGATGCAGAGA | 20918 CTAGGGACCAAATTGCAGTAGAAATC | 31902 TCTTTGGCCACTGCCCTACA | 42886 |
| 9261 CCTCAGGGGTATATCAACTTTGTGTCA | 20919 GCAAAAGGTGATCCAGGTCTCT | 31903 CTGTCCTACCTCAGGGGTATATCAAC | 42887 |
| 9262 CTACTTGGAAACTCCCTCTTCCTTAG | 20920 AGTGGGGAGACACCAGGAAA | 31904 AGACAGTCTTGACCACTTTCTACTTG | 42888 |
| 9263 TTGCCGAGACAGGGATTTCAA | 20921 TTCCCAGGACTGAGCTCTTCA | 31905 TGGTCCCGTTTGCCGAGACA | 42889 |
| 9264 GCCTCTCTGACAATGACCATAACCCTTA | 20922 GAGAATGACTTCCTGCACAATTGGTT | 31906 GGCAAACAGCCTCTCTGACA | 42890 |
| 9265 TCACTTCCCAGTGGTGATATGAGT | 20923 TGGCTTGGAGGAGACCAGGTA | 31907 AGCTTCTTCCCAGATTTGAATCACT | 42891 |
| 9266 CCTCCTGCAAGAGCAGCATTGA | 20924 GCCTGTGTAAACTGATCTTGGACTTG | 31908 TGTCTTGGGCCTCCTGCAA | 42892 |
| 9267 GCTGGCCTTGTGATCTGCTTTGA | 20925 GGAGGCCCAGAATGCCATTTCA | 31909 TCCTTTGAAATTAGCTGGCCTTGT | 42893 |
| 9268 GGAGGCAAAGGGAGGATAGTCA | 20926 GCACTGAAAGCCTTGGAACTGA | 31910 ATGGCAACAGGGAGGCAAAG | 42894 |
| 9269 GCTTGTCAAGTTCTCTCTGATGCAA | 20927 CCTGGCTTTCCTCCTTTGACATACAA | 31911 GGCAGATTTCTCCAGCTTGTCA | 42895 |
| 9270 ACTCACCATGGGTGGGTCAA | 20928 ACCCTCACCATCCTCAGTTGAT | 31912 GTGGCAGCAGTAGACTCACCAT | 42896 |
| 9271 CGGCAAAATCCGAGAAGGACGTT | 20929 TCCTTAAATGCCTGAAGCCAAAAG | 31913 CCCTACTCTGAATCAAGCGGCAAA | 42897 |
| 9272 CCATTGCAGAAAGATGTGGTCTTG | 20930 CCACATGTAGCTGCTTTGCAATTA | 31914 CAGCAGCCCATTTTAACTTCCATTG | 42898 |
| 9273 CCCACCATTACCGAAGTAGCCATT | 20931 TCCTTCTGAAATCCTTCCATTGTT | 31915 TCAGGCAACCTCCCACCATT | 42899 |
| 9274 CCCTGGGCTTGTAGTTTTGCT | 20932 GTCTTCTACCCAGTTCCTTCTCACT | 31916 CATCATCCTCCCTGGGCTTGTA | 42900 |
| 9275 ACACACCCCGCTCCATTACT | 20933 AAGCCTTGTGCCGGAGAGT | 31917 GGTGTTGGGTGGCTGAAAGACA | 42901 |
| 9276 CCTGCCACACATTTTTGGTGAA | 20934 CAAGATGGGTCTATGCTGGAACA | 31918 CTTTGTGGCTTGGGGAGTGA | 42902 |
| 9277 GGCACTGGCTGCTAATTAAGGCAAT | 20935 GGGCTTTCTCCTTCAGCAAAGA | 31919 GGAAGGCACTGGCTGCTAAT | 42903 |
| 9278 GCCACTACTGGCATCTTAGCAA | 20936 GCAGAACCAGAAGGCCGAAT | 31920 TGGACCACTGCTGCCACTACT | 42904 |
| 9279 TCTGAGACAGCTTCTTTACTTGACTTC | 20937 GGGGCAAAACCTGGAGTCAGATG | 31921 GCACTTGCTCGTCTCCTTCT | 42905 |
| 9280 GGAGCCTGGTGGTACTTTTGTTC | 20938 ATGCTGAGCTGCACCGTACT | 31922 GGTCTCAGGAGCCTGGTGGTA | 42906 |
| 9281 CGGGAATCAGGCAAGAGATCCAA | 20939 GAGGCATCCAACCAACAGTTTTC | 31923 AGAGGGCAGGCGGGAATCA | 42907 |
| 9282 GGGCCAGTAGGAACATCTGTGAAC | 20940 CTGAAGCTTAAACAAAGTTGGCAGAAC | 31924 TCTGCCTTCAGGGCCAGTA | 42908 |
| 9283 GTTAGGAGGGTGTAAATCTGTGAATGA | 20941 ACTTTTAGCTCAGGGTCATGCTT | 31925 CCTGCATAGTGGTTAGGAGGGTGTA | 42909 |
| 9284 GCTGTCACCTTCCGGTTGGAT | 20942 AGAGCCACGAGGGCTCAAA | 31926 TGGAGATCCTGGCTGTCACCTT | 42910 |
| 9285 GGTCAGACACTGGCTTGTCCAT | 20943 TCCTGAGTGCCCTACCTTGT | 31927 CCACCAGGGGTCAGACACT | 42911 |
| 9286 GGGTCTGCGTGAAGAGAAAACA | 20944 GCCATGTTAAACTGCATCACCTCTAA | 31928 TGGAAAAAGGGTCTGCGTGAA | 42912 |
| 9287 GTCTTCCTTTTACAACCTACGTGACA | 20945 CACCACTGTGGAGAGGAAGTA | 31929 CCCTGACAGACAACCGTCTTCCTTT | 42913 |
| 9288 GCTGCTTCGTTCCTTTGTTGT | 20946 CAGGTTCTTGGCGTTTTGAACA | 31930 TCTGCTTTCGCTGCTTCGTT | 42914 |
| 9289 CTGCCCCTGGTTAGAATCAACT | 20947 GCATTGCAAGTGTTGTGACAGA | 31931 TGCTGTGCTGCCCCTGGTTA | 42915 |
| 9290 GCTGTGACTCATCCACACTGTCT | 20948 TTTCCTGGAGGCCATTTTGTCA | 31932 GGGTGATGGATCTGCTGTGACT | 42916 |
| 9291 GGGCAGGTGGATGCTAAGTTTG | 20949 TCCAGAGTCCCTTGCTTCATCA | 31933 TGGCTGAATGGGCAGGTGGAT | 42917 |
| 9292 CCTTACATCAAAGAGGGTGAACTGT | 20950 CACTGCCAGAGCAACAAGAAAC | 31934 GTCCCCACTGCACCTTACATCA | 42918 |

FIG. 36O3

| | | | |
|---|---|---|---|
| 9293 GTGTGTGACAGCGATATGAGCTA | 20951 GAAGGGAGGGAGTAGGGAAAGT | 31935 GCTGCCAGAGGAGTGTGTGA | 42919 |
| 9294 AGGCCAGAGTTTGTCCAGGAT | 20952 GGCTGAGGGATGGGAAGAAGA | 31936 CACGGCAAAGGCCAGAGTTT | 42920 |
| 9295 ACTGCAGTTACCTTGCTTTCTTTC | 20953 CCCCGTCCACCCCTTCTACTAT | 31937 GGTCTGCATACTGCAGTTACCTT | 42921 |
| 9296 CAGCAGGGGCTACTGTATTTGTGT | 20954 AATTCAGGGACAGAACTGAGAGATG | 31938 GCTGACAGCAGGGGCTACT | 42922 |
| 9297 GGTTTTTGAGACAAGTCTGCTGAT | 20955 CCAGGTTGAGAAAGGAAGTAGCTTTATTC | 31939 CTCTCAGGGAGCTTGGTTTTTGA | 42923 |
| 9298 GGACGGGTGAAGGGATTTTCAAAC | 20956 CCTGGTGGTGACTGGTGGATTA | 31940 AGGCCAAAGGACGGGTGAA | 42924 |
| 9299 GCACACACAGACTGGCTAGAAG | 20957 TCTTCCTCCCCTCACTCCCAAA | 31941 GACCTGAATAGCACACACAGACT | 42925 |
| 9300 GTGACACTGCAAAGGAGCTGAAA | 20958 GTCTGCAGCAAACCGGAGGTAT | 31942 AGTCTTAAACTAGGTGACACTGCAA | 42926 |
| 9301 CCTGCTTCCTGGAAATGAGCAA | 20959 GAGCTGCAACAACCATGGAAAT | 31943 TCAGGCTGATAGAAAATCCTGCTT | 42927 |
| 9302 CGGAGGCGATGAACAGGGAAA | 20960 GCTAGTAAAGTAACAACCCTCCTTGT | 31944 ACCAGGTCGGAGGCGATGA | 42928 |
| 9303 GGTTTCTCAGGGAGTTTACTCTTGCATT | 20961 GGGAAAAATGACTCCCTTCACTTCAA | 31945 CCAGAAAGGGGTTTCTCAGGGAGTT | 42929 |
| 9304 TCAGCACTTGCCCCAACTTC | 20962 CCCTGGTGACCGGGAAAATGAT | 31946 TTCCAGCTCAGGTCAGCACTTG | 42930 |
| 9305 GGGTTGAACAGTTGCTGCAAAG | 20963 GGGCTGCTCCTCGTTTTGTA | 31947 CTGACCCAGAGGGTTGAACAGT | 42931 |
| 9306 CCACCATCACTACTACCACTCTGT | 20964 GCCACCACAATAATCCAGTGGAAAG | 31948 CAACTACTTCTAACCACCATCACTACT | 42932 |
| 9307 CCAGCCATAACCAGAGGTCAAGTTC | 20965 AGCTGTCAGGACTTGGGTAACT | 31949 CCACACAACAAGGATTCCAGCCATA | 42933 |
| 9308 TGCTGGACACCTTGAATTGTTTC | 20966 CGAGGATATCTTAGTGGCATTGCTT | 31950 GTCCCCTATTGCTGGACACCTT | 42934 |
| 9309 GGATGGCGCTAGAGACAGGTGATA | 20967 GGGTTGACACTCAAATGCCTCTT | 31951 AAGGAGTGGGATGGCGCTAGA | 42935 |
| 9310 CCACCAACCTTGCTTCCAAGT | 20968 TTGCATTCATTACCACCTTCACCTA | 31952 TGCCGGAAACCACCAACCTT | 42936 |
| 9311 CCATGTCCTGATATACAGCCTTGCAAAT | 20969 CAGAATTGGAGACTAGTGGGTGGATAC | 31953 CCATCATCAATCACCATGTCCTGATA | 42937 |
| 9312 TGCCAGGGGTTTTCTCTCTGT | 20970 GGCTTACTCCAGACACCATTGCTT | 31954 TGTGCACTTGCCAGGGGTTT | 42938 |
| 9313 GCAGCTGGCAATTTTGCTCTTTCT | 20971 GGCTGGGAATGGTAAGCCTTATAC | 31955 GCAAAGGCAGCTGGCAATTTT | 42939 |
| 9314 GGGCAGCCAACATAGCCTAGAA | 20972 GGTGAGAAGCCCATGGAAGTATTGA | 31956 TGCTACAGGGCAGCCAACAT | 42940 |
| 9315 GCCGGTTGAGACAAGACAGTT | 20973 GGCCTCCAGCCCTGATTTCATA | 31957 GACTGTGCCGGTTGAGACA | 42941 |
| 9316 CCCTCAAATGGATGGATTGTGTGGTA | 20974 CATGGCATGATCCCTGACTCATAG | 31958 TGCTCCCCTCCCTCAAATGGAT | 42942 |
| 9317 GCATATGGGACAATCGTGGCTTT | 20975 CTGAAGTGCCCCAGCTTTAGA | 31959 TGGGAGGGGCATATGGGACAAT | 42943 |
| 9318 GCTTTCCAGCCTCGTTTCTCACT | 20976 GCCAGAATTGGCCAGAGCAT | 31960 CCATCTGATCCCAGCCTGCTTT | 42944 |
| 9319 CAGTGGAGCAGAAAAACCCATACATC | 20977 ACTGTACGGTTAAACATCGTCTGT | 31961 CCCGACAACAGTGGAGCAGAAA | 42945 |
| 9320 GGGGCGCATTGAAAGTGAGGAT | 20978 CTTCTCTCCTGCTGGATATACACATCT | 31962 TGGTTTGGGGCGCATTGA | 42946 |
| 9321 GAGCTCTGACTGAATGATGTGCTACT | 20979 TGTTACGTGTAGAATGATGGTGCAT | 31963 ATGCAGAGGGAGTTGCAATAAGA | 42947 |
| 9322 CCATGAGCAGCAGAGTTTAGCTTGT | 20980 AGAGGGAAACTCTGGCCAAAAA | 31964 CTGTCCAGAACCCATTCCATGA | 42948 |
| 9323 ACCCACTTGGGTTCCTCCATT | 20981 GTGAACTGCTTCACAGAGGTTTC | 31965 TGGATGACTGTTGTAACCCACTTG | 42949 |
| 9324 CCAGAGGTAACTTCTCCTCCCATGA | 20982 CAGCAGAAAGTAGCTGCATTACCTAAG | 31966 TCCTGGGGTCCAGAGGTAACTT | 42950 |
| 9325 GTGAGAAAAGGCAAGGCAACAT | 20983 TTGGCAGGGCGGTGTTTCTT | 31967 AGGTAGCCTTCCAAAGTGAGAAAA | 42951 |
| 9326 CCTGGTGTTTGCTTGGCAACTA | 20984 ACTTGGGAGGTGGAATCACTTG | 31968 AGGACTCAGTTACCTGGTGTTTG | 42952 |
| 9327 CCATGGACTGACAAAATGCAAGTTC | 20985 CCATGGTCGCCATCTTGAAGT | 31969 CATTGGCCCATGGACTGACA | 42953 |
| 9328 CTCGTACGGGTAACGGTTGCTA | 20986 ACAGAAAGGGCAGAGTTCATTGT | 31970 CCCAGGCTCGTACGGGTAA | 42954 |
| 9329 GCTTTGCGGAGGGCCTTCAA | 20987 CCCTGCCTGCCTAGTTCTGTTT | 31971 GCACATGCTGGGTGGCTTTG | 42955 |
| 9330 GCATTCACAGCAATCTCAGCCATTT | 20988 ACCACGCTGGGCTCCAAAG | 31972 GGGAGGATGGCATTCACAGCAA | 42956 |
| 9331 TGCCAGAAAGGTCTCCTGATACA | 20989 GGTGGGTTGCATTCCCCTTT | 31973 TGAGGCCAACAGTGCCAGAA | 42957 |
| 9332 GAGACTGTTAGGTAATCCTGTGCTA | 20990 CTGACCTGTAAAGCTTCTCTGTCT | 31974 GTCACGCAAGAGACTGTTAGGTT | 42958 |
| 9333 GGCACATGTTTGCTCTTGGCTTT | 20991 GGCTGCACCATGACCATCTGTT | 31975 GGGGAGCTAAAAGGCACATGTTTG | 42959 |
| 9334 GGGTTTACTGCCTTTGAGTGCTTAC | 20992 CGGGAAGGCAAGGGAAAGAGT | 31976 ACAGCCCCTACCAGGGTTTAC | 42960 |
| 9335 GGACCGACTGCTGTTGTCCTAAAG | 20993 GCAGCTTCTTTACATGTCTTGGTTCA | 31977 CAGTGGACCGACTGCTGTT | 42961 |
| 9336 CCTCTGTGGCTGAACAAGAATAGAAG | 20994 CTGAGATCTATGGGAGCAGTGAGAA | 31978 GCTCTAATCCTCTGTGGCTGAACA | 42962 |
| 9337 GGGCATCTCTGAAAGTTGTCCAAA | 20995 GCAAAATTGCCACTCATGTGGATTG | 31979 GCTTGAATCAATGGGCATCTCTGAA | 42963 |
| 9338 GGTAAACCAATAAGCCCAGAGAGGAA | 20996 CCTCCAGCAAAGGAGTCAGTCT | 31980 CATTGTCTGCACAGGTAAACCAAT | 42964 |
| 9339 GCCACATGTCTACTGTTAGCCAATC | 20997 ACATGTGTAGGGTAGGAAGTCTGA | 31981 AGACCCAGCCACATGTCTACT | 42965 |
| 9340 GGGGACCAATCAGGGGTACTTTC | 20998 CAGAGGCTACTCCTTTTACACTGCATA | 31982 TTGGTTGCAGGAGGGGACCAA | 42966 |
| 9341 CAGAGAGGAACTTGGGAACATTCAGT | 20999 TCTGAGCCCCAGCTTCCTTA | 31983 GCGAGCTTAGAGCAGAGAGGAACT | 42967 |
| 9342 AGGACTCTGGGCTGAACTGA | 21000 CCACACCCCATAGCCACACA | 31984 AGACTGGGAGAGAAAGCAGGAA | 42968 |
| 9343 CACTCACTGTCATGGCCCAGTT | 21001 GCAGAGAAGGTGGAAAGGAGATAGA | 31985 GCAAAGCAGACTACACTCACTGTCAT | 42969 |
| 9344 TGCTTGCCCTCGGAATGATG | 21002 CCCAGAGTCGACCCACATTTTG | 31986 CCACATGTCCACACTGCTT | 42970 |
| 9345 CAGCCCAACCTAATTCACCACAA | 21003 CGGCTCTGGCGTATTGTAGCAT | 31987 CCTTTCACCTCAGCCCAACCTA | 42971 |
| 9346 CCACTGTCCTCATAGTGTGCTTCT | 21004 GCCCTGAAGCTCATCAATTCATTC | 31988 CCTGCACCATACCACTGTCCTCATAG | 42972 |
| 9347 GGACTGAACAAGCACAGACGGTAAC | 21005 TTGTCCTTGCCTTAGGACTGAAGT | 31989 GGACCAGCTATAACTTGATGGACTGAAC | 42973 |
| 9348 GGTCAACGGGCTCTGACTTTTC | 21006 GCCAGGCCTGCTTCATTGTCTA | 31990 GCAGTATGTCTTCGCTGGTCAAC | 42974 |
| 9349 GGAAGCTTCTGATCCTCTTAAGTGCTA | 21007 TGGAGGAAGTGAGGCTTATGCTA | 31991 AAGCAAGGTGGAAGCTTCTGAT | 42975 |
| 9350 CGTCTGCCTGTCTGTAAGGGTAT | 21008 CAGGCAAACTATCCCTGGTTGT | 31992 GAATTTCTCACGTCTGCCTGTCT | 42976 |
| 9351 TCTGTCTGGAGGCGGAGTTG | 21009 CCAACCAGGTGTCTCCAGAACT | 31993 AAAGCACCTGCCGTCTGTCT | 42977 |
| 9352 CCTGTGAGTAAGTGTCTCACCAAGTCT | 21010 GCAGGGCTGGTGTGTGAAT | 31994 GGCTCACCTGTGAGTAAGTGTCT | 42978 |
| 9353 TGGGGTACCATCAGGGCAATTC | 21011 CTGCGTTCTGGAAGCTCGTTTG | 31995 TGCGCCAACTGGGGTACCAT | 42979 |
| 9354 TGCTTATGACAGGAGTGGAGAGA | 21012 GGATGTTTCCCTGCAGGATGT | 31996 GGCGACCAAGCCTTGCTTATGA | 42980 |
| 9355 CCCGATTCGCCACCTTTTCA | 21013 GGAGAGCAAAAGAACGCTTTTCAATG | 31997 ATGCGGCAGGGACCCGATTC | 42981 |
| 9356 GTGCCTCCATTCCAGGAACAAGT | 21014 CGGGGAAGGTGCAGGACAT | 31998 CCCTGAGTGGTGCCTCCAT | 42982 |
| 9357 CCTACTTGAAACAAATCAGGTGTGCAT | 21015 CGACCAGCCAGGGTGATAAGAA | 31999 CACTCCCATCCTACTTGAAACAAATC | 42983 |

FIG. 36O4

| | | | |
|---|---|---|---|
| 9358 CAGAGAACTGTGGATCAAGACTGA | 21016 ACAGGAGGTGCTGATGTCTCA | 32000 GGCAGAGAACAGAGAACTGTGGAT | 42984 |
| 9359 GGATCAGTCTGGCTTCTGATTTCT | 21017 GCTCCATTGTCTTCTGGTTTTGAA | 32001 GGGCAGGTAGGTAAAAGGATCAGTCT | 42985 |
| 9360 GAAACCCAACTCTGACACACTGA | 21018 GTGCTGAAGAGGCTCTGAGTCAT | 32002 TGCTCTGAATGAAACCCAACTCT | 42986 |
| 9361 CCCATAAGACAGGAACTGAGCTTTGA | 21019 GAGAGCTGCAGGGTGTTTGAGA | 32003 CAAGGTACACTTTCTCCCATAAGACA | 42987 |
| 9362 CGTGGGGTAACTCATGGTCTCT | 21020 GTCAGGTATCGCGCTGGAAGTT | 32004 TGAGTCTAATTTAGCGTGGGGTAAC | 42988 |
| 9363 GACCAAAGGCAATCCAGAGTGTA | 21021 AAAAGAAGGCCTTGGAGAGTTCTAA | 32005 AGGAAGCCGACCAAAGGCAATC | 42989 |
| 9364 GTTTAATGTTGGTTCTCTGCCTAGACT | 21022 AGGTGCCTCTGTAGCTGAGT | 32006 CCCCGAGAGGAGCAGAGTTTA | 42990 |
| 9365 CCATAATTGCTAGCCACAGTTTGCTTAC | 21023 GGGAGCCAAAGGTTTTCAGGAAT | 32007 ACTCAACCACTGCCATAATTGCTA | 42991 |
| 9366 GCACAATCATTGCTATTGGCCGTAA | 21024 GCTGATGCATCCATGAAAGACTACA | 32008 CTGATCCAGAGTAGGTGCACAATC | 42992 |
| 9367 TCCACACATCAAACTTGGAGCAT | 21025 ACCTCTGGACAGGCAGATGA | 32009 AGGGTGGCCTCCTGTGTCTA | 42993 |
| 9368 CCTCATCTCAGACTGCCGTAGAA | 21026 GCAGAATGGATAGAGCTTGGTACT | 32010 GACAACAGGGAACCCTCATCTCA | 42994 |
| 9369 GGATGTGATAGCTGGATCCTGAAG | 21027 CCACCCCACTCCCATTGTTTGA | 32011 GGCTTGCCAGAGAAGGAAGGAT | 42995 |
| 9370 GTTCCAAGGCCTATTTTAGCAGTTG | 21028 AGGACCAGTGCTCCAAGTCA | 32012 CTGGTTTCAAATGTTCCAAGGCCTATT | 42996 |
| 9371 GCCCTCTCTTCCTTTGAACTTTGT | 21029 AGCCCAACACATTTGAGCATTACTA | 32013 ACCCGCCCTCTCTTCCTTTG | 42997 |
| 9372 GGATGACAGCATAAAGTCCAGACCAA | 21030 CCCTTCTTCGCGTGTGTGTT | 32014 GGCTCTGTGGGATGACAGCATA | 42998 |
| 9373 GTCACCACCCATTGGATTGTGT | 21031 TGCTGTCCTGGAGGTGTTGAAG | 32015 TTGGCTGTCACCACCCATTG | 42999 |
| 9374 CCACCCCATTCTCTGACCAATC | 21032 GGAAGGGCAGTGGTACCTATTCA | 32016 GCTCAGCATTCCACCCCATTCT | 43000 |
| 9375 CCAAACAAAGTGCCTCTTCTTTCA | 21033 GAGGGTTTTCCCCACAACCTCTA | 32017 CCAAGACTCCTGCTTATTTTCTCCAA | 43001 |
| 9376 CACCTAAGTCAGCTTGTGCTCTTC | 21034 GGACACCCTTCCAAATGGTTTTCTTC | 32018 CACTAGTGGACACCTAAGTCAGCTT | 43002 |
| 9377 GTGTTGTTTGGCCCATAAGGTATGT | 21035 GGAAGCTGGTGGTCACCATTTTTG | 32019 CCCGTGCACATGTGTTGTTTG | 43003 |
| 9378 CACCACACATGCCAATGCTCATATTC | 21036 GCACTCATGTGCTATGAGGGAGTT | 32020 CGTTCACCACACATGCCAATG | 43004 |
| 9379 ACTGTGCATTCAGGCAAGGTT | 21037 GGCTGTAGCCTGAGTCTCTGTTTG | 32021 CCAGTGGCTGAACTGTGCAT | 43005 |
| 9380 GTGTTTGTGTAGAAGGTTTGAGTGCTA | 21038 AGCCCACTGGTGGTCATTTAAG | 32022 GGGAGTTTACGTGTCTTGTGTTTG | 43006 |
| 9381 CGACAACTGCACTCCTCTGAA | 21039 GTGATGAGGATCATGGGAAGGGAATAAA | 32023 CTGCTCATCAAGCACTCGACAA | 43007 |
| 9382 CCATGCCCTGGGCTGATTGTT | 21040 GAGCTCCACCCTAGAGCAATGAAG | 32024 GCCTGAAATGCAGCCACCAT | 43008 |
| 9383 GCTTGGCTGATGTTAAAGCTTACTCCTT | 21041 TGGAGAGGACACCCCTCAAA | 32025 TTCTGTCAGCTTGGCTGATGTTA | 43009 |
| 9384 GGTTTAGTTCCTGGATCTCACACTGA | 21042 GCCCTATTTTTAGTATAAACCCTGGAGCAT | 32026 CTGGTTCTTAGGTTTAGTTCCTGGAT | 43010 |
| 9385 GCATCTCAGGACTGAGTGACTCTAC | 21043 CCCGCAAATCAAGCATCAGCTTAC | 32027 CACGAAGCAAAGACTAGCATCTCA | 43011 |
| 9386 GACATGGGTTATGGAATGAGGCAAAT | 21044 TCAGAGCCTCACGCCTGAAT | 32028 CCACGTTAAAACTAGAGAAGACATGGGTTA | 43012 |
| 9387 GCAGTTTCTCTGTTGTGGGAAGA | 21045 CCCCACCCATGATACGTTGTTC | 32029 GCTCCTGTCTTGCAGTTTCTCT | 43013 |
| 9388 CCTCCCACAATTTTACCCATGTCTTC | 21046 CTCATAAAGTAAGACACACCGTACCAATG | 32030 CCTGGGCTTCCTCCCACAATTT | 43014 |
| 9389 CCCGTCACAAGTCTGAGTCTAAGT | 21047 CCTAGATTCTGGAACGCCTTGTTC | 32031 GGTGCTAAATTTTTCCCGTCACAAG | 43015 |
| 9390 TCCCACATGAAGGCAAACTTTCT | 21048 GGCCAGTGCATTTTTCTCCATAG | 32032 TGTTCCCCATCCCACATGAAG | 43016 |
| 9391 AGGGTGAGAAGGAGTTATCCAACTT | 21049 TGCTCACCTCCAGGAAGACT | 32033 CCAAAGTCAAAAGGGTGAGAAGGAGTT | 43017 |
| 9392 CCCACACTGGTTGTCCACAT | 21050 GGAGTCCTAGGCTGTCAGAAAC | 32034 TGTCTGTCCACTTCCCACACT | 43018 |
| 9393 CACGTCCACCTACATCTCCCTTAC | 21051 GACACAATGACTGGAATTTGCTTCA | 32035 GATCTGCACGTCCACCTACAT | 43019 |
| 9394 GGTTTTCAGATGGTAAAGTGGTGTCAA | 21052 CATTGTGCAACCAGAACTGAGATT | 32036 GCTGCAGCCAGAGGTTTTCAGA | 43020 |
| 9395 CCAAAGTTGAGGCAAGCATGACA | 21053 CAGAGTAGGCACCACCATCTATC | 32037 CCTCAAGCATGACTCCAAAGTTGA | 43021 |
| 9396 TCTAGGTACAGCCTGAGCATTCA | 21054 TGCAGCCACCCGAATGAGAT | 32038 CTTCTAGAGTGTGGAGAATCTAGGTACA | 43022 |
| 9397 GGCCTGACTTTGTCATGGAAGGAT | 21055 CTTTGTGGTGCAAATCTGATCTTCT | 32039 CTGGCAGGCCTGACTTTGT | 43023 |
| 9398 CTGTGGCTTTAGCTGAGAGTTCA | 21056 CACTGGAGTGCTTACTGAATGAAAACA | 32040 CCTGGTTCTCAGTCTGTGGCTTAG | 43024 |
| 9399 GAGGAAGAGTTGCAATACAGCCAAT | 21057 AAAGCTGAGGGGTGGAGAGA | 32041 AGGAAGGGGATGAGGAAGAGTT | 43025 |
| 9400 GGGTAATCCCAGCATGAAATGAGGTAAA | 21058 GCAGGTGCTAAGGACTGTAAGAAGT | 32042 CCTCAAAGGGTAATCCCAGCATGA | 43026 |
| 9401 GGACAGCCACTCCTTAGTTGTTTGA | 21059 CACCCCTTTAGAGCTAAGGAAACAAG | 32043 TTAAAACTGGACAGCCACTCCTT | 43027 |
| 9402 GGGTCATGTCTCCATCCAGTGA | 21060 GAGACAGAGGTCCAGAGGTGTT | 32044 CCCATGGGTGGGTCATGTCT | 43028 |
| 9403 CCAGGAGTGTCAAATCAGCTCTT | 21061 TGTCAGTCATAACCTTGGATGCTAA | 32045 GGTTCCTTTCCAGGAGTGTCAA | 43029 |
| 9404 CTCCTCTCCCTCATTACCTCTCAA | 21062 GGAACCAGAGCTGAGGCTGTTA | 32046 GCTCTTGAAACTCCTCTCCCTCATT | 43030 |
| 9405 CGCATGTCCCTAATGCGTGGAT | 21063 ACTCTGGGTGTGTCGGCATT | 32047 GGCAGTGAACGCATGTCCCTAA | 43031 |
| 9406 GCACAGCCAGCATTCCCATAGT | 21064 ACCCTCGTGGCATCAGAGATGA | 32048 ACCTCTCTGCACAGCCAGCAT | 43032 |
| 9407 CGTTGCCTACAGTTCTCCTCTATC | 21065 AGTGGGCCCAGTGGAGGAA | 32049 CACACTTGAATTCGTTGCCTACAGTT | 43033 |
| 9408 CCGAGAATGTCACTTCTGCTGTATC | 21066 GTGGGCTGGGCTTAATGGTATG | 32050 CCATAGAAGTCCGAGAATGTCACTT | 43034 |
| 9409 GCCAAGTCTGTGGCTAGAGGAAGT | 21067 CCCAGTACGCTAGGCAGAAGA | 32051 CCCAAATAGCTCAAGCCAAGTCTGT | 43035 |
| 9410 GGCTGCCCGATTCTTAAATCATTC | 21068 CTGCCAAGCTCACTAGAGGTAAC | 32052 CCATCTTGGCTGCCCGATTCTT | 43036 |
| 9411 ACCGGAAGCCTTAACCAATTTTTG | 21069 GCCAGGTCGACACGTAACAT | 32053 AGGCACCGGAAGCCTTAAC | 43037 |
| 9412 CCCTGGAACCCCTACCTGTCTTAT | 21070 CCACCCTCTTTCTCATCACAGTT | 32054 CCCATGAGCTTAACAGCCCTGGAA | 43038 |
| 9413 GCCCACAACCCACTGAGCAT | 21071 GGACATAAGACCCATCCACCAATG | 32055 GGTTTTAGCCGAAGCCACAAC | 43039 |
| 9414 GTATTTACCCCAGATGGGATGTTTCA | 21072 GGTCTGTAAAGTTGCCATGAATACTGA | 32056 GACCAGAAGCTGTATTTACCCCAGAT | 43040 |
| 9415 CAGGGCTGGAGTTGTGATGAGT | 21073 TGTCCTTGGGAAGAAGTGAGTTTAAG | 32057 ATGGAGGGCAGGGCTGGAGTT | 43041 |
| 9416 TCCCACTATCAGAACATTACCTGGAT | 21074 CCCTGAAAATAATACCCAGCTTTCATC | 32058 CTTCTAGCATTCCCACTATCAGAACA | 43042 |
| 9417 GTGGAGCTTCCACGTGATCCTT | 21075 CATCTGAGCTGAGGTCATGTTCTTC | 32059 CTGTGGAGCTTGTGGAGCTT | 43043 |
| 9418 GTTCCTACCCCATAGGATCAAGATG | 21076 GGGCAGGTGTTTCAGGAAGT | 32060 GCCTAAGCAGGTTCCTACCCCATA | 43044 |
| 9419 CTGAATGGTGAACAGGACAGTCT | 21077 AGTAACTATCTCAAGTCACAGGAGTCT | 32061 GTCCTAGCCTTACTGAATGGTGAAC | 43045 |
| 9420 TCAGCCTTCGACATCTTTCATTGT | 21078 CATAGTTGCTAAATAACGGGAGCTACT | 32062 GAGTCATAGAATTTTCAGCCTTCGACATC | 43046 |
| 9421 GGAAAGGGCTCACAGAAAATTAAGAGA | 21079 GGTCATTCAGACCAGCTCCAATAA | 32063 TGCCTAGGAAAGGGCTCACAGA | 43047 |
| 9422 GGGCTATTTCCATTGTAAGCACTTT | 21080 GGCCAGTGGCACATTAGCAAAC | 32064 AACAGAAGAGGGCTATTTCCATTGT | 43048 |

FIG. 36O5

| | | | |
|---|---|---|---|
| 9423 CTTGGTATGGTCAAGAAAACGGAAAC | 21081 CAGTCACCCTGGGATGAGAGTA | 32065 GGAGCTTAACATCTTGGTATGGTCAAG | 43049 |
| 9424 GGCTGAGACTCTAGGACAGGTAATG | 21082 TGGTGCTGCTTAGCATTTCGTA | 32066 GCATTGTTCAAGGCTGAGACTTA | 43050 |
| 9425 GCATCGAAAGGGATGTAGTCACTTA | 21083 AGAACAGGCAAGCCCACTCA | 32067 GCAGTAATTTGCATCGAAAGGGATGT | 43051 |
| 9426 CCTCCCCAGAGGTAATAACGATGTAG | 21084 ACAACCTGTGGTCTACCTGAGT | 32068 AGCAGCCTCCCCAGAGGTAATA | 43052 |
| 9427 CAAAACCACACACAACACACCAT | 21085 GATCTCTGGAGAATTTGGGAGTATGT | 32069 CGCATATGCATCAAAACCACACACA | 43053 |
| 9428 GCCAAAGACCAAAACCACCTAGA | 21086 GGCCAGAGCACCTGTTCTCTAAA | 32070 GTCTGACAGTTGCCAAAGACCAAA | 43054 |
| 9429 CATCTCAAGCATTCACACCCAGAT | 21087 CAGGGAGTCTCGCCATCTGTAAC | 32071 CCGACCAGCTAAGCTCATCTCAAG | 43055 |
| 9430 ACCACTCCTTTCACACAAATCCTATG | 21088 CAGGTTAGGGAGATTATCTTGCTTTTC | 32072 TTGGAACCACTCCTTTCACACA | 43056 |
| 9431 CCACGTTAGATACCTGACAACCTCAGA | 21089 GCCCTAAAACCCTGCTGAGATG | 32073 ACCTATTGCTTCATTCCACGTTAGA | 43057 |
| 9432 CCCTGCCAAATTTTCCCTGGTT | 21090 CCTGAATCAGCCAGCATAGAGTT | 32074 ATCAGTATGACATCCCTGCCAAAT | 43058 |
| 9433 GGAGTCAAGCCCAGCCAAGTTT | 21091 CTTTCTTCCATGGATCAGCTGAGAT | 32075 GACCTAACATGCAGTTTGGAGTCAAG | 43059 |
| 9434 TGAGAGGCATTGGGAGATAGCAA | 21092 GTTGCAGTCTAGGTTTTGTTGGTT | 32076 CAGCAGTGTTTTTGAGAGGCATTG | 43060 |
| 9435 GGAAGATCCTAGCAAGAGGTGAAA | 21093 GGCTAGGGTAGGAGTAGAGCAGTATC | 32077 GCCAGAAAAGGAAGATCCTAGCAA | 43061 |
| 9436 CCTTGCCATAGCAGGTAGTAGAAG | 21094 CCGGAGGCCCAAACGTTAAA | 32078 GATCAGTTTGTTCCTTGCCATAG | 43062 |
| 9437 CACAACCTGAGTATTCCCCTGTATTC | 21095 CCTTGGAGATTCATTCGATAGCTACTTGT | 32079 TGTCTATCCACCACAACCTGAGT | 43063 |
| 9438 CCCATGCTCATCACTGCCCAAT | 21096 TGACAGCCCACTCTCACCTT | 32080 GCCTCTGTCCCATGCTCATC | 43064 |
| 9439 CTGAAGCAAGGCACCTATGAACTCT | 21097 ACCTGGTCAGCACTGGCTTCT | 32081 ACCCTCCTCAACAGAAGTAACTGAA | 43065 |
| 9440 GCATGTCCCAAACACTTCCTGTGT | 21098 GGAGAGAACTGGGCTCTGAAAAC | 32082 CCACACAGGCATGTCCCAAA | 43066 |
| 9441 CTGCATTCCATTCGCTTTTCCAAAT | 21099 GAGGCACAGAACATGCTACCAAAG | 32083 AGGAACTGTGCTGCATTCCAT | 43067 |
| 9442 AGGGGAGCAGAGATCTAGGGATTC | 21100 CCCATGCCATAAGTAGGATTGTGACTTC | 32084 AGCCTACAAGGGGAGCAGAGAT | 43068 |
| 9443 GGCTGCCGTTAGGATGTAGAAC | 21101 ATGAGGAAAACGAGGGTTTCTGT | 32085 AGACAGTGGGCTGCCGTTA | 43069 |
| 9444 CACACAAACCTGAGCAGCCATT | 21102 AGCAGCCCCACAGTGCAAA | 32086 GCCTGAACCCAGACAGATCACA | 43070 |
| 9445 CACTTGCCTTACAACCACCTGATG | 21103 GGTAGGTTCAGGGAGCTGGAATGA | 32087 CTCTTTTCTTGACACTTGCCTTACAAC | 43071 |
| 9446 CACTTCCACTTCCACCCCTTGA | 21104 GGTACTGTTTCTTCCATAACCAGGAT | 32088 TGAGTGGTGCCACTTCCACTTC | 43072 |
| 9447 TGTTGCCAGTAATATACGCCATCT | 21105 TGGTTTAGCAGTGCAGATAAGGAA | 32089 CCATCTGAGACATGTTGCCAGTA | 43073 |
| 9448 GCCCATAGCTTCCTAAACCTCCAT | 21106 AGCAGAATGGGGTGAAAAAGGTT | 32090 GACTGTTTAATTGGCCCATAGCTTCCTA | 43074 |
| 9449 CCAAACCTGTAATTTGCTGAGGTACA | 21107 GAGGGCACCCCTGAAAAATGT | 32091 CCCAATAGGACTTTCCAAACCTGTA | 43075 |
| 9450 GCCATTGTGTGGAAGACATAGTGTGA | 21108 ACTCAATAGCTGCCCTTCCTACT | 32092 ACTTTGAGCCATTGTGTGGAAGA | 43076 |
| 9451 GATTCAGACCCAGACTCCAGATTT | 21109 GATGTCTGGAAAGATGTTGGATGATG | 32093 GGAGGCAAAGCCAGGATTCA | 43077 |
| 9452 CTCCTGCGGTGTTTTTGTCTCT | 21110 GAGGGTGTCCTGGGCATTAC | 32094 TGGGACTCCTGCGGTGTT | 43078 |
| 9453 CCTGGTTTACATCTACTCCCAACTTTC | 21111 CAAATGCAATGGTAGGTGATGAGTT | 32095 CTCACACTGTACCCTCCTGGTT | 43079 |
| 9454 GCTAAGGAGGATTCTAAAGGTGCTAA | 21112 AGCCGCAAGGAGTGCATTT | 32096 CCTGGACTCAAAAGCTAAGGAGGATTCTA | 43080 |
| 9455 CAGTCACTGCTTGAACACCATGT | 21113 GGACATTTGGGTTTAACCAGCCTAATTC | 32097 ATGATGGCCTCGGTATTAAACAGT | 43081 |
| 9456 GCCAGGAGCTTTGAGAGCTTGTA | 21114 CCTGTTGCACCAAATCAATGTGTCT | 32098 GGCCAAATTGCCAGGAGCTT | 43082 |
| 9457 TGACTTGGGAGACCATTCATTTCAA | 21115 CAAAATCCCAAAGTAGTGCCTGAGT | 32099 GGAGAATTTATGACTTGGGAGACCAT | 43083 |
| 9458 GCATTTAAGGGGTATTCGTGGGACTA | 21116 GGGTAGTCCTGATGGGTAACAGA | 32100 TCTGTTGCAAGCATTTAAGGGGTAT | 43084 |
| 9459 GGGCAGTTTGTGTCACAGTCTTT | 21117 ACCAACAGCATCTCTCTCAGT | 32101 CCGTCCAAAGGGCAGTTTGTGT | 43085 |
| 9460 CTGCAAGCTGTGGTTTTCAGTTTC | 21118 TGGTTTGATCTTAGACCGTGACAA | 32102 GCCTTCTGCAAGCTGTGGTT | 43086 |
| 9461 CAGATTCCAGCCACAAATATCTCATC | 21119 GTCTTCACAGTAGGGCTTTTGCTATG | 32103 GGGAAGTTCAGATTCCAGCCACAA | 43087 |
| 9462 TTGGGAAACCAGGGTCCAGAGA | 21120 CCTGGATCCCAGGCCTGTTTATAG | 32104 GGCCTCCATGCAGATATTGGGAAA | 43088 |
| 9463 GCAGGAGGTAACTGGGGCATA | 21121 GTTTTCAAAAGCTGTGGTTGCTGAA | 32105 TGCTCCATTGGCAGGAGGTAAC | 43089 |
| 9464 GCTGAGCATTTTACACTGACCCTTTG | 21122 GGAAGCTGTACTGTAGAAACTAGCCTAA | 32106 GCTGTTAAGTGGTAGGGCTGAGCAT | 43090 |
| 9465 AGGGTAAGCTGAGGCAAGTTTAG | 21123 CTCAGACTGTGGCTTATGATGTCT | 32107 GGATAGAGTATGGGAATGAAAGGGTAAG | 43091 |
| 9466 GGCTTGTTCTTATGGTAGGGTTCCAAA | 21124 CCTTAAGGGGCCTTGGGTACATC | 32108 GGCTAGCCCAGGCTTGTTCTTA | 43092 |
| 9467 GGTGGAAGAATGAGGCTGTACCTT | 21125 GCTCAGCTGTAGGAGATTTGTTCT | 32109 AGAGAAATCAAGGTTTGGTGGAAGA | 43093 |
| 9468 GGTAGGCAATGGCCTGGTATT | 21126 TCCGTGTCCACCTGGTAGGCAAT | 32110 CAGTGGTGTTTGTTAAGGTAGGCAAT | 43094 |
| 9469 CTGTGGACTCTTTCATCTTGCATGT | 21127 GCCAAAGCCAGTGCATAATTAGTTG | 32111 TGTTTAAGAGCTGTGGGACTCTTTCA | 43095 |
| 9470 CAAGAGGGGAAAAATCCTCTTTAGACA | 21128 CTCTGCTTTAGCATTTGCCACTAATAC | 32112 CAGTAATCCTGATTCAAGAGGGGAAA | 43096 |
| 9471 CCAAGTAACACTGCAGCTTAAGAA | 21129 CACAGAAGTCCAGCGGCATTGA | 32113 CCACCTTGAGGCTCCAAGTAAC | 43097 |
| 9472 GCTCTGTCATCCCCAGCTGAAA | 21130 GGAGTCAAGAAAGTCGAGCCTGTAAAA | 32114 AAAACAACTGCAGCTCTGTCATC | 43098 |
| 9473 CTGCCAACAGCACTTGTCATAC | 21131 GAAGGTTCCAGCAGGTGTAGAATG | 32115 TCCAGGGCTTCTCTGCCAACA | 43099 |
| 9474 CTGGGGTAAAAGGAGGTTATCAAGCAT | 21132 GAGTGGGAGCTCTAACTTGACACTA | 32116 AGGATTCTGGGGTAAAAGGAGGTT | 43100 |
| 9475 CTCTCTCCCTGCTTAGATGTTTGT | 21133 CCCAGGCTTGACTCTTTTTACACATTG | 32117 GGATGCAGGCCCTTCTCTCT | 43101 |
| 9476 CGGCTAAGCTAACGATATTCCATCTCT | 21134 ACTAATATTCACTGGCCAACTGTGA | 32118 GCCAACGGCTAAGCTAACGAT | 43102 |
| 9477 GGCTCCCATTTGTTGTCGGCTAA | 21135 GGACAGGCTGGGATGGAAAATG | 32119 ACAGTAACGGCTCCCATTTGTT | 43103 |
| 9478 CCGCTTAGCCAATATGCCCTTTG | 21136 CAGTCAGACAAGGATCCTGAGTAAGAGA | 32120 TGCCTCTCCGCTTAGCCAAT | 43104 |
| 9479 GAACACAGGTCAGTTTCAGGTAGATG | 21137 AGGCTGCGACCTTCTTCAGAGA | 32121 GGTAGGATGAACACAGGTCAGTT | 43105 |
| 9480 CAGTGTTCTGTTTAAGGTCACCTCTTCT | 21138 GTGGATGCAGCTGCCAATGA | 32122 GATCTTACATGTCCCAGTGTTCTGT | 43106 |
| 9481 GCTCAGACAGCACTCGTTTTG | 21139 ATGCACCCCAGGCCCCACTT | 32123 GATCCATCCCAACAAGCTCAGA | 43107 |
| 9482 CCACAGCTCAGATTGACTCACA | 21140 CCAGAAACAACCTTAGTATTGCAACCTTTC | 32124 TGTCCACCCACAGCTCAGAT | 43108 |
| 9483 CCCTCAGCAATGTCGCTAGTAGT | 21141 TTCCTCGGTCACCTCCACAATC | 32125 AGCCAGAGGTCCCTCAGCAAT | 43109 |
| 9484 GGAGCACATGGTGACTCTCTGA | 21142 GAAAATAGTCTCTCTGAAGGAGCAAGTAG | 32126 AGTTGGCCTCTGGAGCACAT | 43110 |
| 9485 CGGTGGGTCCTACACCTGAGAATA | 21143 TGGTGATCGCAGCAGAAACAA | 32127 GCTTAATGACGGTGGGTCCTACA | 43111 |
| 9486 CCCCAATCTGTGCCTTCATGTT | 21144 GTGGGCAGAGGCATGCATATAA | 32128 GGATGTGTTGCCCCAATCTGT | 43112 |
| 9487 CCTCAGGCATAAAGCCAGGTCAGT | 21145 GTGAGCCTCAAGAGACGGGAAA | 32129 GGGCAGAAAATGTCCTCAGGCATAA | 43113 |

FIG. 36O6

| | | | |
|---|---|---|---|
| 9488 TCATCCAAGAGTTCTACCCTGTCT | 21146 GCCTACTAGTGCTATTCCCCTGAGA | 32130 GCCCTCACCTTTTCATCCAAGAGTT | 43114 |
| 9489 CCTTTCTACACATCCAGCCTAAGTTC | 21147 GCTTGGGTAGGATTTATGCCTGTCAA | 32131 CCTGCTCCTTTTCCACCTTTCTAC | 43115 |
| 9490 GACAGTCCCTCACTGAGTAGGTTGA | 21148 GCTCCACTAAAATACCGAGTTGGTTCAT | 32132 AAGGCTGACAGTCCCTCACT | 43116 |
| 9491 GCCTCAGGATACTTTTAGCAGAAGA | 21149 TGATCAGAGGTCTAGGCACAACTT | 32133 TGATTGCTGCCTCAGGATACTTT | 43117 |
| 9492 GAACCCAGGCATAGAGAGTCTGA | 21150 ACTTTCTGGCAGGAGTGAGTTTC | 32134 AGAGTGACGAACCCAGGCATAG | 43118 |
| 9493 GTAGCTGGAATGCACAGCCTTA | 21151 AGTAGCCACTAGATGGCAGAATTG | 32135 CCCATCCTGTTTGTAGCTGGAATG | 43119 |
| 9494 CCCGTGACGAAAGCTTCCAA | 21152 TCCAGGGCCTCTGATTCCAA | 32136 TGCACTGGCCCGTGACGAA | 43120 |
| 9495 GCAGACAGTGACACACCTGTAAG | 21153 GGAACTGTTGTGCTGAAAATGTCT | 32137 AGTCTGGGCAGCAGACAGTGA | 43121 |
| 9496 CCCTGACTGCCTAAGCTGAAGA | 21154 TGGCCTTATATAACTGTAGGGTTGACT | 32138 TGCTCAACTTCCCTCCCTGACT | 43122 |
| 9497 GGGTCCTCCTATTGTGGTGCAA | 21155 GCTTCCCAGCACAGATGGAATC | 32139 GCTGCATTTTGGGGTCCTCCTATT | 43123 |
| 9498 CCAAGCCTCTCCCCAAGCTAGA | 21156 GCGGAGGGAGAGCACTTTGTTT | 32140 TTCCCCTACAGCAGCTCCAA | 43124 |
| 9499 GCCTGAACCTATCCTACTAAATCAGTCA | 21157 GCTGAAATCTTGCAGAAACCAGAGTT | 32141 GCCTTCATGCCTGAACCTATCCTACT | 43125 |
| 9500 CAAGGAGAATGTGCCCCTTCTAAA | 21158 TGGGTAAGCTCACATGCTCTCA | 32142 GGGTTTCCACATAGAAACAAGGAGAA | 43126 |
| 9501 CTGTTGTTCCCAGGTTGGAATGAAATG | 21159 GCGTATCACAAGCCAATGCTAAGTT | 32143 CCTGCTGTTGTTCCCAGGTT | 43127 |
| 9502 GTTCCCTCTTTCCCCTGAGTGT | 21160 GATGAGAATTTGCAGGGCATGGTA | 32144 AGGTCCCTGGAGTTCCCTCTTTC | 43128 |
| 9503 TCCAGGTAATGTGTGAAGGGTTTATG | 21161 GGGAAGGAAGGTGTGTTCCCTAAG | 32145 GTGTGATACTTCCAGGTAATGTGTGAA | 43129 |
| 9504 GGCTGATGGCTAAAACTTACTGTTTCCTA | 21162 GCAGAGACCAGGTAAGCAGACA | 32146 CCTTCCTCAATTGGCTGATGGCTAA | 43130 |
| 9505 TCTCCTCCTTCCATCCTCTTTTGA | 21163 GTCAGTTGAGTGGTGAAGGCAAA | 32147 GCCCCAATTTCTCCTCCTTCCAT | 43131 |
| 9506 CTGACACTGGCTTTTGACTGGAA | 21164 AAGGTACAAGAGGCATTTCTGACA | 32148 GGCTAACATCTGACACTGGCTTT | 43132 |
| 9507 GCATGATTCCCAGTTCCTAGATGT | 21165 TCCAGAAAGATGCCTTTG | 32149 TGGCTGCATGATTCCCAGTT | 43133 |
| 9508 GCTGTGAACTGTGGAAAACACAGA | 21166 GACTCTTTGGAGGACCAAGGTCAAG | 32150 ATATCTACTGTGTGCTGTGAACTGT | 43134 |
| 9509 GGCATTGGGAAACTTGAGCTATGTACT | 21167 TGCTCAAGGACAAAAATGGTCACT | 32151 ACAGTAGGCATTGGGAAACTTGA | 43135 |
| 9510 GGCTGTGTGTGTTCTCTGGTCAT | 21168 CCATCTTCTGTATTTGACCCGAATCT | 32152 ACCGAAAAGGCTGTGTGTGT | 43136 |
| 9511 GGTGGCAGAGAAAGCCTAAAATTC | 21169 TGCAGGGATGCTGGGACATCA | 32153 ACAAAGGTAAAAGGTGGCAGAGA | 43137 |
| 9512 CCCAGCACACACTTAAAAGAACAA | 21170 GAGCAAAGACCATGCTTTACACATC | 32154 AGTTGTTTACCCAGCACACACT | 43138 |
| 9513 GCTCCTGTACTTGCCAATAGCAT | 21171 AGAGCGCTTGGGTAGAGAGA | 32155 GTGGGAATGGAGCTCCTGTACTTG | 43139 |
| 9514 CCCCTTATGTCCTTCCTTACCACAT | 21172 CCTAATGGAACCCAGGTGAGTGAT | 32156 GCTGGAACCTGTTTCCCCTTATG | 43140 |
| 9515 GCTGCCTTGCTTTCTTGGTGACA | 21173 ACACTGGGGCTCACTCACT | 32157 CTTTCTACTGCTGCCTTGCTTTC | 43141 |
| 9516 ACACTCCAGTAAAACGTTCCTTACA | 21174 ACCACAGACCACAGGCTGACTA | 32158 GGGTGAGGGTACACTCCAGTAAAA | 43142 |
| 9517 TTCCTTGTGGTGGTCCAAGATG | 21175 CTGAGGCTTGGAATTAGATGTGATACTGA | 32159 GGCATGGCCCTTTTCCTTGT | 43143 |
| 9518 GTCACCACAGAAACACACCTTTAAC | 21176 CCTATAAGAGGAGAAACAGAGCATGT | 32160 ACCAGGACGTCACCACAGAAAC | 43144 |
| 9519 CTGCCCTGAATCCTACTGTGTT | 21177 GGGCCATGGTACCTACTCTCTTCT | 32161 GGCTAGTAACTAACTGCCCTGAATC | 43145 |
| 9520 GGTGCATTTTGGACTAGCAGAAGCAT | 21178 TGCACAGTCCTGTGACTCTGTAT | 32162 GCCTCACTCTGCCTATGGTGCAT | 43146 |
| 9521 TCCTGAGGCTATTGGCGGAACT | 21179 GACAGCAATTCCCAAAGTGTTTTTG | 32163 ACAGCTGTTTTATCCTGAGGCTATT | 43147 |
| 9522 GCTGTTGGTTTCATTTTGGAGAAAC | 21180 GCCTCTTCCTCTCCACATTGGATT | 32164 CTCTCTGGTAGTTGCTGTTGGTTTC | 43148 |
| 9523 GAGATGCTATTTTTGGTGGATGGCAAAG | 21181 CCAAAGGACAGCGTGTGTGA | 32165 GGTGGGGAGAGAAGAGATGCTATTTTTG | 43149 |
| 9524 GCCATCCTTCATGGTAGAGACACT | 21182 GTGGACACTGGCCATCCACATT | 32166 GGTCTATAACCTCTGTGAAAGCCATCCTT | 43150 |
| 9525 GGAACAGCAAGGTTGCTAGTCTGTA | 21183 ACCTCACCTGTCATGACTATTCTTC | 32167 TTTACTCTGAGGAACAGCAAGGTT | 43151 |
| 9526 GTGACAAACCCACTTCCAGGATTG | 21184 GGTGCGGTGAGTGGAGATGATT | 32168 GTGCAGCCAGAAGTGACAAAC | 43152 |
| 9527 GCTGTTCTCACAGACACACTGTT | 21185 GTTGCAAAGTGAGCTTTGTTGATTG | 32169 CCGAGTGTGCTGTTCTCACAGA | 43153 |
| 9528 CTGCCCTTCCTGTTTTCCTGCTA | 21186 ACCGCAGACAATCTGCAAGTA | 32170 TTCTCCCTGCCCTTCCTGTT | 43154 |
| 9529 GCAGCCCAATAGCAGAACTGTGT | 21187 TGATACCTGAGATAGGGAAAAGGAAGA | 32171 AGAGACCTTTGCAGCCCAATAG | 43155 |
| 9530 TGCTGGAGTAGACCAAGAGTCA | 21188 GCCACTTTTACTGTTGCAAACACATC | 32172 GCAGCTGTCATTTTGCTGGAGTAG | 43156 |
| 9531 AACGTGGGCCATTCCTCCTA | 21189 GAGTGGGAGGGAAAGGAAGTCA | 32173 TGCCTAGAGCCGCCTTTAAC | 43157 |
| 9532 CACTTTCTGGCTCACAGATGGTA | 21190 GCTGTCTTGCCACTTCCACTA | 32174 TGGTGGGTGCCCACTTTCT | 43158 |
| 9533 GTGTTTTGGCTGTACTATCTCTAGTGCAAA | 21191 GCTGAAGACCAGCAGTCTGT | 32175 AGTGAGAATGTGTTTTGGCTGTACT | 43159 |
| 9534 CACAAAACCAGTGTCCCCAGTATTC | 21192 GCATGCAGCAAGGAGATTGACT | 32176 CTCTGTCCTCACAAAACCAGTGT | 43160 |
| 9535 GCTCTTCCAAGCCTTTCATTGTT | 21193 CCTTGCTCTCTGCCTACCATTG | 32177 GTGTCTTTCCTTGTTGCTCTTCCAA | 43161 |
| 9536 GGGACTATCCTGAAGCATGTAAAAGT | 21194 GTGCTCAGAATAGAGCAGAAGTAGCTTT | 32178 CACAGTCACAGTTTGTAGGGACTATC | 43162 |
| 9537 TCTGGACTTGACAGTGACAGATG | 21195 TGCGAAGCAGCGAGCACAT | 32179 GCAAAATCGATGTGAATTCTGGACTTG | 43163 |
| 9538 GTAAGAAAAGCTTCACTGGAACACA | 21196 CACAAAAGCAGCCATCAGAGACAA | 32180 CCACCACCTGTTTTGTAAGAAAAGCTTCA | 43164 |
| 9539 CGGCTCATTTGCAATGGGCATCA | 21197 CCGGCCCTGGGTTTACTTCTTA | 32181 ACTGCAGCACTCGGCTCATT | 43165 |
| 9540 GGGAACTGCAGGCCATAGACA | 21198 GGGCTTGGCAGTCCCAAATACA | 32182 GAGGAATGAACAGTTTAGGGGAACT | 43166 |
| 9541 CCCTGCCTCTAATCCTCCAGTGT | 21199 CTGACAAAGGGTGCCAGCTTCT | 32183 ACAGGTCTCTCCCTGCCTCTAATC | 43167 |
| 9542 TTTCCCTGCCCTGGGCTCACA | 21200 CACTAAGATGGATAAGGCGGAATGT | 32184 CAAGCTCTTTGTCCACCTGTTTC | 43168 |
| 9543 GGCTCTGCCTCACTGTGACT | 21201 TGGCCCAGAGTTCCATAAAACAT | 32185 TGTGCTCCTCTGGAGGCAATC | 43169 |
| 9544 TCACCCTCTTACTGCCTCCAA | 21202 GCTTATCTGATTTCCCAGCACACAGAA | 32186 GCCTGCCTCTAACATCACCCTCTTA | 43170 |
| 9545 GAGCCAGAGTGTAAAGAGGGATCCTA | 21203 CAGCGGGTGAGCTTTCGTTT | 32187 GACGCAGAGCCAGAGTGTAAAG | 43171 |
| 9546 CAGGAGGGATTGTGTGGTCTGA | 21204 CCCCTAGAAACTCCCTTCTCTTGT | 32188 CCCATGTTTTTGAGCAGGAGGGATTG | 43172 |
| 9547 GCTCCAATCCCGGACTAGCCTTA | 21205 CCCGGCTGCTCTCACTACAATAGA | 32189 TCCGGACTCCTCTGCTCCAAT | 43173 |
| 9548 GCCACGTTAAGGGCCCAAGT | 21206 CCATCCCCACAGCTCTCTTTTC | 32190 GAGTTATGATTGCAGGCCACGTT | 43174 |
| 9549 GAAAAATAGTCTGCCCCATCCATCT | 21207 TGAGTCCCTGAGGCATAATCAGT | 32191 AACTGTCACAGGAAGGAACAGAAA | 43175 |
| 9550 CCTTTGATAGCACCACTGGCAAGA | 21208 CGACGGGTCAGTGGACTCTACA | 32192 GTCAGAGCCTAACAGCCTTTGATA | 43176 |
| 9551 GAGGTGTGTTGATTGTGCTACCTA | 21209 CCTGGGAGCACTCCTTGTCTTT | 32193 ACAATGTGGTGAGGTGTGTTGA | 43177 |
| 9552 GGTGCAGATCGGTGCTCACAA | 21210 AATGGGAAATAGGCAGACATACACA | 32194 CGGACATAGCTGTGGTGCAGAT | 43178 |

FIG. 36O7

| | | | |
|---|---|---|---|
| 9553 CCAAGGAAGGTGGTGAAGTATTATTCAGT | 21211 TGTTCCTCTCTAAGAACCTTCTAGTCT | 32195 TCACAAGCAGGTGTCCAAGGAA | 43179 |
| 9554 GGACATATGTTGCAGGTAGAGCTAGGAA | 21212 CTTTCCTACACCCTCATTCAGTTGT | 32196 GCAGGGACATATGTTGCAGGTA | 43180 |
| 9555 GCTAGACCAAGGATCCCTCTGATG | 21213 AAGAGCGTGAGCCTTCTGTTATG | 32197 GACGCTGACGTTACTGCTAGA | 43181 |
| 9556 TGGAGTGGATTCAGGCTTGCTA | 21214 TGCCATTCTTTAATCCCTTGGAGTTAG | 32198 CCCAACGACATATGTTGGAGTGGATTC | 43182 |
| 9557 CCTTCAACAAAGGTTAGGCCACAAA | 21215 TCTAGGAGGCCCGTCACACT | 32199 GTCTGGTAGGACAAAAGATCCTTCAAC | 43183 |
| 9558 AGCCAAAGAAGGAGGAGCTTATG | 21216 ATGCAGCTCCTATGTAATTGCTACT | 32200 GAGACCTGGCTTCTAGCCAAAGA | 43184 |
| 9559 GGTCCTGGGCATACAGTGATTT | 21217 TTCCTCCACTGGGTGGTAATTG | 32201 GGGCCTTTTAAGGTCCTGGGCATA | 43185 |
| 9560 CTGAACACGTACACTCTATCTTCCCAAA | 21218 GCGGCAGCTAGCGTATTTTGA | 32202 GTGGCTTCCTGAACACGTACACT | 43186 |
| 9561 GTGCCTGCTGATAAAAACTCACTAC | 21219 GTGGTATGGTGTTTGCATTATGCTGTA | 32203 GTCAGTAAATGAAGTGCCTGCTGAT | 43187 |
| 9562 GGCAGTGCATCAGTTCCTCTT | 21220 AGCCCAGCTCAGGTTCAACT | 32204 ACAGAGCAGGCAGTGCATCA | 43188 |
| 9563 GACCAGGGAGCATATTACTGGATCA | 21221 TGGGCCATAATGGGACAAAGATG | 32205 CAGAGAAGGACCAGGGAGCAT | 43189 |
| 9564 GCTGGGAACAGGGTTTCACA | 21222 GGAGGCCAAAGGAGCTTATGGTTAC | 32206 AGCCAGTGCTAGCTGGGAACA | 43190 |
| 9565 CAGCTGTGGTAGGGGCTATAGAA | 21223 CACCATAGTCCACAAAGCACTCT | 32207 TGAGCCTGGACAGCTGTGGTA | 43191 |
| 9566 CCAAAACCTCCAAAGTCGTGAAG | 21224 GCCTTCGAACACAGACTGAAGA | 32208 AACAAGGAAGCCAGTTGGAGTT | 43192 |
| 9567 CTAAGCTCAGAAGCCATCCAATCT | 21225 AGAGCTCTTTTGCCTAAACTTGTTC | 32209 AGCGGGATAATAAACTAAGCTCAGAAG | 43193 |
| 9568 CTGAAACAGTAGGAACTCAAGGTGCAA | 21226 CCAGGGCCCTTGGATTTTTGA | 32210 CCTGGAAGCTTCTGAAACAGTAGGAA | 43194 |
| 9569 AGGACAAGGCTGTTCTGGTACT | 21227 CAAGAGGACGTAAGTCCAATGTTAAGT | 32211 AGCTTTAAGGACTCAAGAAGGACAAG | 43195 |
| 9570 GGGGAAGGATAGAGCAGTGCAA | 21228 GCCTTCCCTAGCCACCCATCTAA | 32212 GGAAAACATGACGGGGAAGGATAG | 43196 |
| 9571 GTGTGTAGGTGAGCCTGACCAAAG | 21229 TGTTCGGTACCGTTGTCTTTTCT | 32213 TGCTGGGAGCTGTGTGTGTA | 43197 |
| 9572 GGCTACCAACTAGCCAGTGCTT | 21230 CAGAGATGCCTCAATCTCATTGCAT | 32214 GTTGTCAGTGAGAAATGGCTACCAA | 43198 |
| 9573 AGGGCAGAACGATGTAAAAACAAC | 21231 GGTACAAAGGGCAAACGTGTTCAT | 32215 TGTTTTACATCAGGGCAGAACGAT | 43199 |
| 9574 TCCTACCTAATCTAACCCTCATGCTA | 21232 GGCTCCTGATTCTTAAACAGAGCTT | 32216 GCCCAGCAAGAAACTATTCCTACCTA | 43200 |
| 9575 GCCGTGAACAGGCTTACTCTCA | 21233 GGTGGCTCTGATGCTCCCTAAAG | 32217 AGCCGTCCAGCCGTGAACA | 43201 |
| 9576 CCTCTAGGAATTTAACTCCACCCACAAC | 21234 AATGTGGGAAGGGTCTACTTTCAAT | 32218 GCCGATGACAAACAGACCTCTAGGAA | 43202 |
| 9577 ACGGTCCTACCAGTGTTGATGA | 21235 CTGGTTAGGAATCTGCAGGAAAAACAAC | 32219 CCCACTGCAGAAACGGTCCTA | 43203 |
| 9578 GGGAGGTGGAAGACATGATGGATA | 21236 CGTATAGTCTTCCATGCCATCTTCACTA | 32220 CAGAGTTGGGAGGTGGAAGACA | 43204 |
| 9579 GTTGAGTGATGGCAAAATGGGTGAA | 21237 TCTCAGGCTCAGGGAGAGTCAT | 32221 GGCAGAAATCTTTGCTGTTGAGTGA | 43205 |
| 9580 CCCAGTCCCCTTTTCCACTAGA | 21238 AGAGTAAGCACTTTGCCATAGGTT | 32222 TTGGGCTTCCCAGTCCCCTTT | 43206 |
| 9581 GCCTGTTTGCTCTCTATACCCATACCTA | 21239 CAGGGTCAGGATGAATTCTACACA | 32223 CCAGTAAAGCCTGTTTGCTCTCT | 43207 |
| 9582 GGCTTTGCCACTTGTCATGCTAAC | 21240 GCAGCAGCACTAAGAATCACAACTTT | 32224 CTGCTGGCTTTGCCACTTGT | 43208 |
| 9583 GCTGTGGATAGCAGTAGCAACACT | 21241 TGGCCCCAGAGGCATCTAAA | 32225 TGGCATGGACGCTGTGGATAG | 43209 |
| 9584 GGAGCCTCTCTCTGGGTTCTATCT | 21242 CACAGGAAGTCACCTGCAAGGAA | 32226 AAAGCCTCTGGGAGCCTCTCT | 43210 |
| 9585 GCCCAACCCCTAAAGACTGACA | 21243 TGGCTGTTTAGGGTGCTTTCAA | 32227 GCATCCAGCCCAACCCCTAA | 43211 |
| 9586 GTGGCTGCTGTTAGACGTGTTAG | 21244 CTCATCATACGAGCTCAAGAGAACAAGA | 32228 CCTGCAAATGTGGCTGCTGTTAG | 43212 |
| 9587 GCCTCACACAGGGAATGAGAGA | 21245 GTTGGAGAAGGCAGTGAAGTCT | 32229 CCAGCTGAATTCTAAGCCTCACACA | 43213 |
| 9588 CTGGGTTCAAAGCTAATTCTGCCATT | 21246 CGAGTAGTCTGGCCAAAATTACATCT | 32230 GGACCCTCTGGGTTCAAAGCTA | 43214 |
| 9589 AGCCTCTGAACTGTAAGATGCAAA | 21247 CCATCAACCTTCCTTCCACACA | 32231 GGTGGCAACTTTAGCCTCTGAAC | 43215 |
| 9590 CACACAGCCAGCCAGTCCTATT | 21248 CCTCGTCGACCTCAAAGCAACA | 32232 GAGGCCATGTCTCAAAACACACA | 43216 |
| 9591 CCGGATCCTCAACCCAAGAAG | 21249 CCCCATTCCACGGACAGAATC | 32233 CACGTTTCCCGGATCCTCAA | 43217 |
| 9592 AGTGGAATGTCTTGAAGGAGAGATG | 21250 GCTCTAGATAATCTGATGACACGGTGATG | 32234 CTGGGTACCAGAAAAGTGGAATGTCT | 43218 |
| 9593 GGGAGAATGAGTGACTGCTGACAT | 21251 GCCACTGGACCTGGCACAA | 32235 AGGTCGGAGGGAGAATGAGTGA | 43219 |
| 9594 GTTCTGGCCAACCTTACTGTCTTC | 21252 TGATTGACATCCTTTTCCCTGTGA | 32236 GTGAGGCAACGCCTAAGTTCT | 43220 |
| 9595 CCGAGTTCCAGGCTAGGAGTAT | 21253 CTCCAGCACCTACACTACCCTAA | 32237 GCCTCATTCTCTTTCTTTCAAACCGAGTTC | 43221 |
| 9596 CCAGTGGAGACTTTCACCCCATA | 21254 CCCCAGAAGGCAGCAAGTCAAT | 32238 ACCCCGACCAGTGGAGACTTT | 43222 |
| 9597 CCTCAATGTAGACAAGGAAGATGTCA | 21255 GCTTTGTCACAGCTGTTTAGGAA | 32239 CAGTCACCACAACCTCAATGTAGA | 43223 |
| 9598 GTGAAGCCTGGGTGTAGCTTTG | 21256 GGGTCTCTCAGGTGTGTTCAGTAGA | 32240 GCTTATGGCACAGGGTTTTGTGAAG | 43224 |
| 9599 TGTACCAGGTGGCTGCTCTTG | 21257 GCAGGCCTAGGACTATTTCTCTGA | 32241 AGCGTCCCTCCAACCTTAGTGT | 43225 |
| 9600 CGGTTTAAGTTCAGCAGGAAAAAGT | 21258 GAGAGTGAGCAAGGAGAGTGTTTA | 32242 GACAGCAGCTGACGGTTTAAGTTC | 43226 |
| 9601 TGGCTCAGAGATCGTCCCTTCT | 21259 CTGACAGAATATTGGAGTGGGTGATG | 32243 GAGAGTGCTTTTGGCTCAGAGA | 43227 |
| 9602 GGTTCAAAGACAACTGTGAAGCGATGA | 21260 TGAGACCAGAGGTCTGTATGTATGA | 32244 CCCAGGGAAACTGGTTCAAAGACA | 43228 |
| 9603 GACCTATGGGCTTTACAATTGGAGTAGA | 21261 GACCAAGTGTGCTTGTAGCTCAT | 32245 TGGGGAGACCTATGGGCTTTAC | 43229 |
| 9604 CCAGAAGGCTTTGAGCCATCACA | 21262 CTCTGTGTCCACCTGCTACACT | 32246 GGAGTGAACCCAGAAGGCTTTGA | 43230 |
| 9605 CTCTCTGAGCAGCTGAAGTTCTGT | 21263 GGCATCCATGCCACCTTCT | 32247 ATGCCCACTGCACTCTCTCT | 43231 |
| 9606 CACCGGCATATGTGCCAAGAA | 21264 GGTAGGTCCCAGTCTTCACCAT | 32248 ATTTTCTTCCTAACCACCGGCATA | 43232 |
| 9607 GAATCCTTTGAACCCAGGACTTTG | 21265 GGAGGACAGTGGCATGAACA | 32249 AAGGGGCTGAGGTGGGAGAA | 43233 |
| 9608 GGTGTAGCCACGTCCCAATTCT | 21266 GCAGAACAGATGCCTCATTTGCTTA | 32250 GGGATGTACTTCGTGGGTGTAG | 43234 |
| 9609 CCAAACGGATGTATGTAGGACACCAA | 21267 GTGTGTGCCATTTGTGTTTGAAAAG | 32251 TGAGCAAACCAAACGGATGTATGT | 43235 |
| 9610 CTTCCTGTGATTGCTTTCCCTTTGA | 21268 GCTCCACAATGGGTGTTGCATGT | 32252 GCTGTGTGATTGACAGATCTTCCTGTGA | 43236 |
| 9611 GACAGTTGGCTGACGATATTCTCCTT | 21269 GCTGTGCTCCTTGAAGTGGCATT | 32253 GTGATGACAGTTGGCTGACGAT | 43237 |
| 9612 CCCCTTGAAACTGCTTATACTCT | 21270 GGAAAATGAGGGCATTCCAGGTA | 32254 TGATCGTCTCTACCCCTTGAAACT | 43238 |
| 9613 GGTGACCAAGGGTAGGTATGACA | 21271 GCCCCGTGGCTTCTGTTCT | 32255 CCTCTGCCACAGGTGACCAA | 43239 |
| 9614 GGAAGTGACCAAGCTGACATGGAA | 21272 GCTGTGATCCTCTCAATGCTGTAACT | 32256 AGATCTGAGTAATGTCTCTGGAAGTGA | 43240 |
| 9615 CCGTGGAGTTGGTTTGAGGGAGAT | 21273 GGGACGTAAACTAGAGAAGGCACCAT | 32257 CCTGGCCGTGGAGTTGGTTT | 43241 |
| 9616 CGCCCAGGTACAGAGAATAGCAT | 21274 AGGGATGGAGAGGGGAAAGCAT | 32258 TCCCATCGCCCAGGTACAGA | 43242 |
| 9617 CCACCTGGTGAACTTGAGCTTGA | 21275 GGTCATCACAGTTGGTATGACACTCT | 32259 CCATCTGGAACCACCTGGTGAA | 43243 |

FIG. 36O8

| | | | |
|---|---|---|---|
| 9618 GATCCCAGTTGTGTGCCCTTAG | 21276 AGAGCTCTGCTGGCACCTT | 32260 CCCAGTTTTCAGATCCCAGTTGT | 43244 |
| 9619 GGGTGGTGAGGAGATCAGACTGTA | 21277 CTCATCTTCCTCCTGGCCCTTA | 32261 GGGTGGGTGGTGAGGAGAT | 43245 |
| 9620 CACACACAGAGAAAAGGTCACTTC | 21278 AGGGCCACCCTCTCACTATG | 32262 CCAGGGCTTTACACACAGAGAA | 43246 |
| 9621 GCAAGCCTAATCGGGATTTTAGCTCTT | 21279 GATAAGGCCGCCATTTTCTGAAC | 32263 TCAGTGGTCTATGCAAGCCTAATC | 43247 |
| 9622 GGAGAACAGAGCCACATGCTAAC | 21280 AGCTGCTTGGGATGATTATGTTGA | 32264 CGATGTAAGGGTGCAGGAGAACAGA | 43248 |
| 9623 GCTCCTCGTGGAATCCTGAAATG | 21281 CATGAGGCAGGACTTGGAAAACA | 32265 TCCTCATGCTCCTCGTGGAAT | 43249 |
| 9624 GCCCTCTGAGAGTAGTCAGGAAACTA | 21282 ACTTTGAGGCCCAATAACCATGT | 32266 CTGCAAATGACGCCCTCTGA | 43250 |
| 9625 GCTGGTATGGAGAACAATTCCTGACA | 21283 GCGTGCCATTTGCAGTCTGT | 32267 GCTTTGAGCTGGTATGGAGAACAA | 43251 |
| 9626 CCCTCTCTTGCCTGGTCTATTTT | 21284 ACAAACCTAGACAGCCCTTGTTC | 32268 GACCTTCCAGAAGACCCTCTCTTG | 43252 |
| 9627 CCCTGCATTCCTTCTTCTTGGAT | 21285 GGGTACAGAAGCTTCAATCACATCA | 32269 GCCGATCACCCTGCATTCCTT | 43253 |
| 9628 GCAAGGAATCTTGTGTCTCTATGATTG | 21286 ACCAGCCTCAGATTTGTCTTTTACT | 32270 GCCTGAAGAGGACGAACTGTTG | 43254 |
| 9629 CTGGAGGAATACCAATCAGACGACAA | 21287 TGGGGTGGTCTGTGCAGTT | 32271 GGGTGCCTGGAGGAATACCAATC | 43255 |
| 9630 ATGCAAGGGTGATGAAGAAGGAA | 21288 CTGTAACAGTGTCTGGTAGCAAATG | 32272 GTGCAAGCTATGCAAGGGTGATG | 43256 |
| 9631 GGAGTTAAGAGGGAGTTGAAGTCAAAG | 21289 GATGGAGTCCTGTGAAGATGGTAAC | 32273 ACAGAAAAGGAGTTAAGAGGGAGTTG | 43257 |
| 9632 ACTCTGCCTCTGAGATTCTAGATAGT | 21290 CACTAATTGGTGCCATTATGCATCT | 32274 GAGCTTAGAAAACTCTGCCTCTGA | 43258 |
| 9633 TCCTCATTCCTCAGAGCTGACA | 21291 TGAGTACACCTAATGGCAGGTTTT | 32275 AACAGACTCCTGCTTCCTCATTC | 43259 |
| 9634 GACGGGTACTACGGGTCCAT | 21292 CACCATGCAGCACCAGTGA | 32276 AAGCCACGGACGGGTACTA | 43260 |
| 9635 GACTGCCTCTATGAAGCCATTTCCTA | 21293 CCCTGAGGAGGGGTTGATTGT | 32277 TGTCCACTCTTGACTGCCTCTA | 43261 |
| 9636 CAGCCACAAGGAACAATCTCAAAA | 21294 GTGTCTGCAGGTGTGGTTGT | 32278 GCATGCAGCCACAAGGAACA | 43262 |
| 9637 TGCCAGCTCTGCCTCTCTAA | 21295 ACGAGACTCATCCTTATCCCTAGAA | 32279 TGATCCTCCTCAGCCTCTGTTTG | 43263 |
| 9638 GAGTAGGACTTCTTACATGGCAGTTG | 21296 TCCAAATTGGCCTTCCACAACA | 32280 GCTGGTTCCAGAGGAGTAGGACTT | 43264 |
| 9639 ACAGTCACCTCTGCCTGTCT | 21297 AGATCGGGCTCCAGCTTCTA | 32281 GCAGGCTGGCTGATTTCCAACA | 43265 |
| 9640 GGGTCTGATCACCCCAACATTC | 21298 AGAGTGACTACCTCCCCAGCAA | 32282 GCCTGTTAATAAAGGTGTTGGGTCTGA | 43266 |
| 9641 CCCAGGAACTTAAATGAAATGGGCATAC | 21299 TGCAATAGGCTGAGTCCACAATG | 32283 CTCCAAGGCTCTTATCCCAGGAA | 43267 |
| 9642 TCGGAGCTGTCTGGGAAGTT | 21300 GCAGTCGCTTCTCCACCATGT | 32284 CCCCGATCTCCGAGTACAGAT | 43268 |
| 9643 CCACATGCCTCCTATATGCTTTGT | 21301 GCTCAGTCTAAAACAATAGCCTCCCATA | 32285 TCCAGTTCCACATGCCTCCTA | 43269 |
| 9644 CAGCACCACTTTGCACTACTTC | 21302 GCTACAAGCCACTGTTACGTTTC | 32286 GACAGCACAGCCACCACTTTG | 43270 |
| 9645 AGTTCTCTCCAGTCTCTTCCAGTT | 21303 ACTGAAGGAATGTGGTCATGAAAGA | 32287 CAGATCACTCTAGTTCTCTCCAGTCT | 43271 |
| 9646 GCCCTGAGTCCATTCCAAGTCT | 21304 AGCGTGGCCATTGGCAACACTAAC | 32288 CCAAGGAAGCCCTGAGTCCAT | 43272 |
| 9647 CGCAAACTGGTATCCCTGGTCAAC | 21305 GCAGCCAAGCAGGCTATTCA | 32289 GCACATCCACCGCAAACTGGTA | 43273 |
| 9648 GACCAATGGAAGCAACTACAGAAACTTTG | 21306 GGCCCTTTTCCTCTGAGTCACTA | 32290 GGTGTGGGCGTGAATATAGACCAA | 43274 |
| 9649 AGCGCTCTTGGCCTTTGTT | 21307 GCACATGCTCTTTGCAGGACAA | 32291 CCTCACCGCCGTGTCATTTGAA | 43275 |
| 9650 CCTCCAACATTCCTCCTCTACAAC | 21308 CACTGAGGTAATAACCAGCAGACA | 32292 GGCAGTTACCTCCTCCAACATTC | 43276 |
| 9651 AGGGAAGTCCCTGGCTCCTAAAG | 21309 TCAGGAGGGGAGTGGTGGAGTAT | 32293 GGAACCACAGGTGAAATAGGGAAGT | 43277 |
| 9652 CAAATGGCCCAGCTATATCTGATTG | 21310 TTTTCTGCTGCTCATAGGGGATAG | 32294 GCTTTGTCAAATGGCCCAGCTA | 43278 |
| 9653 CACCCAAGGAGGGCTGTAATGA | 21311 AAGCCCTCCCTCTCCAGCAA | 32295 GGAACATCCCTCAGCCAAACA | 43279 |
| 9654 CCAAAGAGATCTAGGACACAGACATAACT | 21312 CCATCCTTCTTTCAAAGTGGCAGATA | 32296 GCTTTCCAAAGAGATCTAGGACACA | 43280 |
| 9655 TCCAGGTGCCATTCCCCATTG | 21313 GTCTTGCTCTTACTACCTTGTTGAACT | 32297 GGTTCTCCACGGGACCCTTC | 43281 |
| 9656 CCAATTCTCTTGTTCCATTAGCGAGAA | 21314 AGCCCTAGATTAGTGCTGAAAATGA | 32298 CTCCAAGGAGGACCAATTCTCTTGT | 43282 |
| 9657 GTGGCTCTTCCCATTGGCTTT | 21315 AGCAGTGTGGACAGAGGCTAGA | 32299 CAATGACTGGATGTGTGGCTCTT | 43283 |
| 9658 GCACCTGACCATACTTGCTACACT | 21316 CAGTGCTTAGTGTTCACACTGGAGTTAT | 32300 GAGAAGACTGCACCTGACCATAC | 43284 |
| 9659 ACCCAGATCTCTGCTTCTAAAACTTG | 21317 GTCCCTGGAAGCAGCTAATCTAATG | 32301 GCAGAGCCAACTTTTAAACCCAGAT | 43285 |
| 9660 CAGAGCTCTATACTGAGCTTTCCCTCTAT | 21318 CTCAGCCATACAAAGTGACTGTCTT | 32302 TGCATGTCCCAGAGCTCTATACT | 43286 |
| 9661 CCATGCCTGCTATTGCCACTAT | 21319 GCCCACTGCACCTCTGTTTG | 32303 CCCCACATTCCATGCCTGCTA | 43287 |
| 9662 ACATGCAGGAGCTTAGAGACTGA | 21320 GTGAGGATTATTGAGAGGCGATTGT | 32304 CCAGGACATCTACATGCAGGAGCTT | 43288 |
| 9663 ACTGGACCCTTAGTTCCATCCATAG | 21321 GACCACGCCACACTTGGTATGA | 32305 AACAAGAGAACTGGACCCTTAGTTC | 43289 |
| 9664 GCATGGCAGAAAAACTACCTTTGTCA | 21322 GCTCCTGAGAAGCAAACACA | 32306 GTTAACTTCAGCATGGCAGAAAAAC | 43290 |
| 9665 GCATGTACACAGTGCATACCTCTGA | 21323 GGAACAAAAATCTGCTGTCTGCATTTC | 32307 TTATGGAGCGCATGTACACAGT | 43291 |
| 9666 GTGACTCACACCAATGACAGTTACA | 21324 GCCAAATAGAGAACTAACAGGCACACT | 32308 GCCCCAGTGACTCACACCAAT | 43292 |
| 9667 CCGACGTTGTCATCTCACATTATC | 21325 CTCCTGCCCTGAGTCTGAAAC | 32309 CCAGGACCGACGTTGTCATCT | 43293 |
| 9668 GCTCTCTGCAAATGGGAGGATGGTA | 21326 TGTGCCAGACTCAATGCTAAAGT | 32310 GCCTTGGTTTGCTCTCTGCAA | 43294 |
| 9669 CTCTTGGTTTCCAGGCAGACA | 21327 GCCCATCACGCCCTTCAGTA | 32311 CGGTCAGGCCTTCTCTTGGTTT | 43295 |
| 9670 GGTGGTTTGTGTGGGTCTGA | 21328 GAGGGAAGCCGTGTTCTGATTG | 32312 CACTTTCAGTGCAGGTGGTTTG | 43296 |
| 9671 CCTTTGTGAATGCCTGATGCAA | 21329 GCTGTCCCCTTGTGAATGAGT | 32313 GGAGCAGCCACAGATCCTTTGT | 43297 |
| 9672 GGCAAACTCCACTTCAGCAGGAT | 21330 ACATGTACACTGGGTCAGAATTTGT | 32314 GTCTTTCAAAGGCAAACTCCACTT | 43298 |
| 9673 TCCACTCTGGATTCCTGAACAAC | 21331 GCTCTCCATGTTTCTGCTGCTTGT | 32315 GGTCAGCTTATCCACCTTCGGATTC | 43299 |
| 9674 AGGGAACCAGCAAAACCAATGA | 21332 CTGGTTCTTGGGCCTTCAA | 32316 TGCAAACTAGGGAACCAGCAA | 43300 |
| 9675 GCGGCAGTGTTTCCTCTGTT | 21333 TTCGTGGGAGAGAGAAGTTGATAAG | 32317 CCCTGAGAACCGGCAGTGTT | 43301 |
| 9676 GTCTAAGGAAGTCTGTAGGCTGAATAC | 21334 TGGAACAATAGCCACAGCAGTT | 32318 GGAGTCAGGTCTAAGGAAGTCTGTA | 43302 |
| 9677 AGCACTTCCCCTTTGATCCATTC | 21335 CCAGGGCCAGAGTAGCAAGT | 32319 GGCCAGAAGAAGCACTTCCCCTTT | 43303 |
| 9678 GGGGACATAGGCAACAGGACAA | 21336 GCCCACACGCCATGTAAAGA | 32320 AGGGCAGGGTAGGGGACATA | 43304 |
| 9679 GAGCTTCTCACTGTCCCCTGTA | 21337 GTGTCCCAGAAAGGAAATGAGACA | 32321 TCCCTTTCCCTGGTTGAGCTT | 43305 |
| 9680 TGTCCAAGGAATGGGAAGGGTAA | 21338 GGCACCTGTCAGATAGGGTTGGAT | 32322 TGGCAAGTGTGTCCAAGGAAT | 43306 |
| 9681 CGCCCAACAGAAGAGGAAGTT | 21339 CTGGAGTGACCCTTTGGTGACTTA | 32323 TCTCCACCCTCGCCCCAACA | 43307 |
| 9682 ACGCAATGCCTTTTCAGAGCTA | 21340 GGTCATGATGCATGGGACTAACAGGTA | 32324 GTTGTTAGCCCAGAAACGCAATG | 43308 |

FIG. 36O9

| | | | | | |
|---|---|---|---|---|---|
| 9683 | CTCCATTGCCCTGTCTTCAGAGT | 21341 | AGTGACAGGGATCCTTTTTCATGT | 32325 | CCTGTTGGACTCTGCTCCATTG | 43309 |
| 9684 | GGAAACCACAACAATCTCACTGAAG | 21342 | CTGGTTGTGGGGAACTATGTCTCA | 32326 | CAAGGTTCTTGGAAACCACAACAA | 43310 |
| 9685 | CACCCTCCAGTTTCTGGTTTCA | 21343 | GTGTTCCATGCCAGACAGACATC | 32327 | AGTAGAGAGACACCCTCCAGTTT | 43311 |
| 9686 | GGCTCACTCCAAAGCCCATATTC | 21344 | TCTGGGCTCCACACTCCAAA | 32328 | GAACCCTATAGGCTCACTCCAAAG | 43312 |
| 9687 | GTTGGCATCAGACAACTCTTACCTAT | 21345 | CAGTTTATCCTGCCAGCCCATA | 32329 | CCCAGCCATCTTGGCATCAGA | 43313 |
| 9688 | CGCATATTGCAGGAACCAGGTAGT | 21346 | GCCTGCAAATTAATTATGGGTCAGCAT | 32330 | CAGGGGAGGTTTTACTTTCGCATA | 43314 |
| 9689 | CGAGGAGGGACCAACCAAGATTAACA | 21347 | CCGTAGCCTACAGAGTGTTGTCATC | 32331 | TCGACCCGACGAGGGACCAA | 43315 |
| 9690 | AGGGCTTACCAGGGTGAGGTATC | 21348 | TGACAAACCAAGCACGTTCAGT | 32332 | ATCGCTGAGCCCAGGGCTTAC | 43316 |
| 9691 | CTGTGACACCCGTTTTCCTGAGA | 21349 | GGGGAAGGGAGGTGAGTTAAAG | 32333 | AAGCAGGGAGACAGGCTGTGA | 43317 |
| 9692 | GTCTTCACTAGACTAGCCCTGCAGTA | 21350 | CCTAGGATTATGCTGCCAACAACT | 32334 | CAACGGCAGCGTCTTCACTA | 43318 |
| 9693 | CACAGGTCTATTTAGTGCAGGGAACT | 21351 | CCCCTGCTTGTCTGAGTTCATGT | 32335 | GGCATTGCCGACACAGGTCTAT | 43319 |
| 9694 | ACTGATTGCATATGGGGTTTGACA | 21352 | CGTCAATGCCAGAAGGCTAGAAG | 32336 | CTCCTGTAGTCAACAACTGATTGCAT | 43320 |
| 9695 | AGCCTGCAGTACCCCTCTTGT | 21353 | CATGGCTGGCACCTTTCTGT | 32337 | CCCGGGTAAGCCTGCAGTA | 43321 |
| 9696 | TGGGGTTCTTTCATGCTTTGTGT | 21354 | CGGCAGTGTGAAAATGGACTGA | 32338 | CTCCATGGTTTCTGGGGTTCTTTC | 43322 |
| 9697 | CTGAGTAGGACAGTGATCCCAGAGT | 21355 | GCCAGCCTGGACCACATCA | 32339 | AGGCCACTGAGTAGGACAGTGA | 43323 |
| 9698 | CCAAGCTGCAAAGTAAACTTGGAT | 21356 | GGATGGGTTTTGAGAGCACTAATTTTG | 32340 | CATGCCAACCAAGCTGCAAAG | 43324 |
| 9699 | GCCCACCTCTTTATGGAACGTA | 21357 | CCCAGGCACAGGCAGAATTG | 32341 | GCCCTGTAGCCCACCTCTTTA | 43325 |
| 9700 | CAGCAGAGCTGGTATTTAAGTATTCTGGTT | 21358 | AGTCTTGTAACGGACAGACCTCTA | 32342 | CCAGTACACAGCAGAGCTGGTATTTAAG | 43326 |
| 9701 | GGTCCAAGATGGAATGGGTTCT | 21359 | CTCCTGTTTCAGCCCCTTCTAC | 32343 | CTCAACACAGATCTGGTCCAA | 43327 |
| 9702 | GAGCTTAGGCTGTTTCTATCCAGTCA | 21360 | GGTGAACCGTAGGCAACTGAAC | 32344 | GGGCTCAAGAGCTTAGGCTGTTTCT | 43328 |
| 9703 | CCTGAAACTTGCAAAGCCTCACAGA | 21361 | GCTAATTTTAAAAGCCAGCCGAACT | 32345 | GGAGCACACACACCTGAAACTTG | 43329 |
| 9704 | TGCAGTGTCAAGCTTTGTCAGA | 21362 | GGAAGGAAAAACTTCTCCCTGAGGTAT | 32346 | TGCCAGCCATGCAGTGTCAA | 43330 |
| 9705 | GCCAGCACTCACAACTAGACTT | 21363 | GGTTCGGTCTGGGGAGAGATTG | 32347 | TCAACAATGCCAGCACTCACA | 43331 |
| 9706 | TGTGTGGGCTTTCACTCTCAAG | 21364 | CGGTGGCCCAGAGGAATGAAATAGT | 32348 | AGGAACCAGCAGGCATGTGT | 43332 |
| 9707 | TGCATGGATCTTCATAGTCCTACTCT | 21365 | GGTGTTAGAAAGAGTTCAAGGCACTTTTG | 32349 | CAGAGAGGATTGCATGGATCTTCATAG | 43333 |
| 9708 | GAGTTCTTCTCTTCCTCCACCTAAAA | 21366 | CCTCTTGAGCTGGGTCTTGGAA | 32350 | CCTGTGGTTTCTACTGCTTAGAGTT | 43334 |
| 9709 | CGTGAGCATTAGTAGCAGTGACA | 21367 | GCACGTGCTTACTCTCTGTGCTT | 32351 | GAAACCTGAAAACGTGAGCATTAGT | 43335 |
| 9710 | GACTGTCAGCAAGCAAACAATACAAG | 21368 | TCCCCGGGGTGTCATTTCTTGA | 32352 | CAGTACCCTCGACTGTCAGCAG | 43336 |
| 9711 | CTGAGATCCAAGGAGCTGTACAAAG | 21369 | CTCCTTTCCTGGTCCCAATTCTGT | 32353 | GTGAAAACGAGGAAACTGAGATCCAA | 43337 |
| 9712 | GGAGGTTTGGAACTGGTAGAGAGA | 21370 | GCCTCCATAGCAGTCTGTGAATC | 32354 | CTGTCATTGGGGAGGTTTGGAA | 43338 |
| 9713 | GGCTGTTAGGTTGGGAGAGGAT | 21371 | CTCCAATGCAGGACAGGAAAACATC | 32355 | GGGACAGTTCGGCTGTTAGGTT | 43339 |
| 9714 | CTGCCTTCCATAGTTGCCACCAA | 21372 | CAACATATGGCATGCCTGAGAAC | 32356 | AGAGCTCAGCTGCCTTCCATAG | 43340 |
| 9715 | CTCTGGAAAAGGCTGAGAAAACTCCTA | 21373 | CGTGTGTCAGCAACTTAACACTTTG | 32357 | CACGTCCCCAGTTTCTCTGGAA | 43341 |
| 9716 | GTTGAGGGCTAGAGGGCTAAGA | 21374 | CTGTTGACAAATACTCTCTCCACCTA | 32358 | GTCCACTGATTGTTGAGGGCTAGA | 43342 |
| 9717 | AAGGCTGGAGCTAGGAGTCACA | 21375 | ACTGAGAACCAGTTGATGAGAGAGT | 32359 | CCACACCATAAGGCTGGAGCTA | 43343 |
| 9718 | GCCATGACAGTTGAGTCACACAT | 21376 | GGGAAGAACCAGAATCACTGGAA | 32360 | CCTGCCTGAAAAATTAAGCCATGACAGT | 43344 |
| 9719 | ACTGCATTCCCACCATACCAAA | 21377 | TGGGGCGATAGCGAGTCT | 32361 | CCCCAATACCACACACTGAT | 43345 |
| 9720 | TGAAACCTCAGTAGGGATCTTCCAT | 21378 | GCTGGTGTATTCCCTGGACAGAA | 32362 | CAGAGGAACAGAATGAAACCTCAGT | 43346 |
| 9721 | GGTTGTGAAGCCGCACTTGGTT | 21379 | GCGGGTAGTGGTGGTGTTTTC | 32363 | TGAATCGTGTCCTGGTTGTGAAG | 43347 |
| 9722 | GCAAGAGGATTGGGCATACTGGTAA | 21380 | CAGCACTGAGAAACCCGCTCTT | 32364 | GGCTGCATGCAAGAGGATTG | 43348 |
| 9723 | GCGCAGCCAGAAATGATGAAC | 21381 | GCACCACACATGGAGAGGAGAAG | 32365 | AACAGAAGCCAGCCAGAA | 43349 |
| 9724 | CCGTCTGCTTACATCTCCATTTAGGTT | 21382 | GTCCAGCCTAAAGGTTTCTCTGT | 32366 | CCTCAGTTACCGTCTGCTTACATC | 43350 |
| 9725 | CACTCTTCACTATCTGAGGCCATGAA | 21383 | CTGACAACCATCTAACTGGGAACACA | 32367 | CTCCATTACAGATAGCACTCTTCACT | 43351 |
| 9726 | TCCCTTCAGCAGAGCAGTCA | 21384 | GGCCATGCAGGCTGACAGATT | 32368 | CCACAACCCACAGTCCCTTCA | 43352 |
| 9727 | GACAGAGATGGTGCATGGATGT | 21385 | GTACCCATTTGTGAGTGTGAATGAAG | 32369 | GATTTGGACCTGATCAGTCTTGACA | 43353 |
| 9728 | GTGCCTGCCTGTTAATGAGTGT | 21386 | CAGGAACCAGAATAGCGGTGAT | 32370 | TGGACTAGTCCCTGCCTGTT | 43354 |
| 9729 | CCCTCTTGGTGAATGTCCTCTAGT | 21387 | CCATGCGATGGTGTGGACAATGA | 32371 | CCATCTGTCCCTCTTGGTGAATG | 43355 |
| 9730 | GTGGTAAGTTTGGAAGGAGGCTTA | 21388 | CAGCTCATACAGATACGTGGTTATATCTTG | 32372 | GCATAGCAAAGTGGTAAGTTTGGAA | 43356 |
| 9731 | GCGCAGGAATGTGTGCATGA | 21389 | AGACATAGGGTGTGACGTGTCT | 32373 | CAATCCTTTATGGCGCAGGAATG | 43357 |
| 9732 | CACCTCCTTTGCTGCTACCATA | 21390 | TCAGTGAGGTGGTGATGGAAGA | 32374 | CTCCAAAATCTGGTCACCTCCTTTG | 43358 |
| 9733 | GGGGCCCAGATACACTCTTCTTC | 21391 | TGTGCTCTCACTTGTCACCATT | 32375 | ATCTGCAGGGGCCCAGATACA | 43359 |
| 9734 | CCTGTCTTTGGAAATCCGACCACTA | 21392 | CCAGGTGGAGCCACACGAA | 32376 | CCCATCAAAACTCCTGTCTTTGGAA | 43360 |
| 9735 | GCTTTCCCGAACAAGGTTCACT | 21393 | TCTCCTGTGCTGTTTCCTTTGT | 32377 | GCCAAGCAAGCTTTCCCGAACA | 43361 |
| 9736 | GGGGAGAGGATGAAGTGGGTTT | 21394 | CCAGTGAAATTTTCTGCCTCCAAGA | 32378 | CCTGCACTGTGGGCTGGAA | 43362 |
| 9737 | GGGCCTGGGTATCCTAACCTCAT | 21395 | GACTGGGTACAGATGTGATATTGGAAGAA | 32379 | AAGTCCAAAGGGCCTGGGTATC | 43363 |
| 9738 | TCAGCGCATTACCAGTCCTTTAG | 21396 | AGCGGGGAAGCTCCAGTCA | 32380 | GGAATCACCTTCAGCGCATTAC | 43364 |
| 9739 | GGGGATTGTTAGGACTTATCACACT | 21397 | GCCCCTTGGGCTTCAGTATGT | 32381 | GGAGCAACATACAGAGGGGATTG | 43365 |
| 9740 | TGGGGCTGAAGGGTTGACTGTA | 21398 | GCTGAGCTCCCAACCATGTGA | 32382 | AAATGGTGCCTGGGGCTGAA | 43366 |
| 9741 | CCTTTGCCATTCCTGGACACTCT | 21399 | TCTGAAACCTGTCAGGGGACTT | 32383 | GCCCACACCCACTTCACCTTTG | 43367 |
| 9742 | GGAACACCTACCCTTTATGTGTAACT | 21400 | GACAGGGCAGAGTGAAAGGTATTC | 32384 | AGGGGAGCACGAAATAGGAACA | 43368 |
| 9743 | GCCTGAGCAAAGTAAGTTTAGGGTTCT | 21401 | TGCCTTTTGCTATATGAGCTGGAT | 32385 | CAGGAAGCCTGAGCAAAGTAAGT | 43369 |
| 9744 | TCCTAGGGCTGAGTTTTGAGATTTG | 21402 | GCTTACCAGGTGTATAATACCTTGAGTTCT | 32386 | GTGCAATGTCCTAGGGCTGAGT | 43370 |
| 9745 | GGATGGAGGGTCCTTCATTTTCT | 21403 | GCTAGGCACGATGAGTAGTGACTT | 32387 | AGGTGGGGTCTGGAAGGAT | 43371 |
| 9746 | GCCTGGAAACCAAATGATTGTCAAAGA | 21404 | TCCTTTGCTGTGAGCTGTTGTA | 32388 | CCCCAGAGATAGCCTGGAAACCAA | 43372 |
| 9747 | GTGGGACTCAAAGATCTTCCAGAAT | 21405 | GGCTGTCACAAATTATATCCCAATCCCTTT | 32389 | GGATACAGATGTGGGACTCAAAGAT | 43373 |

FIG. 36O10

| | | | |
|---|---|---|---|
| 9748 GCCCAGGGTTCAAGTTTAGTGTTTG | 21406 GCATGGAAAGCAGGGCTTTAG | 32390 TCAGAGCCCAGGGTTCAAGTT | 43374 |
| 9749 CCACCCTCCAAAACAAGTCACTCT | 21407 AGACAAGTGACGGAGGTCTCA | 32391 GGCTCCCACCCTCCAAAACA | 43375 |
| 9750 GCCAGAGCATGTACCTAGCAAAC | 21408 CAAATGTCTTCCCTCTATCCTGATGTTG | 32392 CAAGCAGTGCCAGAGCATGT | 43376 |
| 9751 GCACCCTTGGAATAGGGATTGA | 21409 CCTAGGTAGTCACAGAGGCAGTTC | 32393 GGGGACATAAATGCACCCTTGGAA | 43377 |
| 9752 GACATTGGCTGTCAAAGTTCCATT | 21410 CAGTGAGAGAAGGGAAAGAGAGCTTA | 32394 CTTAGTACTTGAGACATTGGCTGTCA | 43378 |
| 9753 AGCCATACCTTAGGGCCAGAAC | 21411 TCTTTGAGCTGGAGGCTATGTTG | 32395 GGGTACCAGAGGCATGATTAGCCATA | 43379 |
| 9754 CACCCTGCAGTTGACATGGGAAA | 21412 ACCTCCTCTAGCTCATGAAGAACAA | 32396 GGGAATTTACACCCTGCAGTTGA | 43380 |
| 9755 GGAAACTCAGGTTTAAGCCCATAAGGAAA | 21413 GGTGTACTCCAGCAATGGACAGA | 32397 AGGCTGGGAAACTCAGGTTTAAG | 43381 |
| 9756 GGCTTGAGTTGGCCTTTCTCAGAT | 21414 GGATGGGTCCATACTTGTCATTAGGTT | 32398 GCTTCTGCCAATGGGCTTGAGT | 43382 |
| 9757 GCTTAATTGCCAGATTCCGTATTCAAG | 21415 CCCATGTGCTTCTGGTCTTCT | 32399 CCTGGGAGTTGCTTAATTGCCAGAT | 43383 |
| 9758 GGCTGGGATATCAAAGGAGCTAGA | 21416 GGTGATCACTGACGGGGTAAAAC | 32400 TTCTCTTTCTGTTTTGGCTGGGATA | 43384 |
| 9759 CAGTTGGTCACCACGTGTGTTT | 21417 GGAAGATGAACTGAGGGAGCTGCTA | 32401 GCCCCATCAATCCTAGTCAGTTG | 43385 |
| 9760 TGCCAAGGTAGATCTCGTTCATTTC | 21418 CGTGGCCAGCGTTCCACAT | 32402 GGCATCCGTCATTGCCAAGGTA | 43386 |
| 9761 AGGCCAGGGGCTGTGTCAT | 21419 ACCTCCCATCATTCAGCAGTTTAG | 32403 TGGCTTGAGGCCAGGAGTTTG | 43387 |
| 9762 GCACACTTGCCTGAAATGAGACACA | 21420 GTCCTGAGAATAGGCCAATCCAATTA | 32404 CAAAGCCCATTTGTAGCACACTT | 43388 |
| 9763 GGGCTAGAACAACAAGCCAAGT | 21421 ACAATGTCCCACCTTCTGATTTGT | 32405 CAGAAAACACAGGGGCTAGAACAAC | 43389 |
| 9764 GTGACGTGTGTCACCACTGGAA | 21422 GGGTAAACATGCCCCTGGTCAA | 32406 TGCAGCCTGTGACGTGTGT | 43390 |
| 9765 GTCCCAACCAAATACTGCACAGA | 21423 AAAAGAACAAAGTGGATGCCAGTAG | 32407 GCAGTTAGCATTGTCCCAACCAA | 43391 |
| 9766 GGCAGGACTGGTTGAGAACATC | 21424 AGGCAGACCCTCTGAGCACTT | 32408 TAGGGCAGGCAGGACTGGTT | 43392 |
| 9767 AGAGCCTGAGCAACGTGTATAAG | 21425 ACAGTGGTCACTCGGAATTTGTTGT | 32409 TGTGCTTAAAGAGCCTGAGCAA | 43393 |
| 9768 TGATGGGCCCTAGTTTTCTACTTTTG | 21426 AGGATGGCTCAGGTTAATAGAGTAGT | 32410 CCCTGTGATGGGCCCTAGTTTT | 43394 |
| 9769 AGGCTAAGGTTAAGGCACTGAAG | 21427 TCCTGGCCATTGCTCTTTTGT | 32411 TGTTGGGCTAAGGCTAAGGTTAAG | 43395 |
| 9770 CCTGCTTCCCTGCCACTTTTG | 21428 CCCAACTGAGAAAGGCTTACCTTCTAC | 32412 CTGGAGGAAATTGCCCTGCTT | 43396 |
| 9771 CGTGCGGTGACTTCTTTCTGTGA | 21429 AAGGAAGGTGAGGAAAGGGAAAG | 32413 TGTGAGTCGTGCGGTGACTT | 43397 |
| 9772 TGCTGAAAGGCTGCCATATTTGT | 21430 AGATAACGAGGACAGAGCTTATCTTAC | 32414 GTCTGCATTTGCCTTTTGCTGAA | 43398 |
| 9773 CCCTCTCAATGTCCATTTGTGTAGA | 21431 TCTATTGACTCTAGGTGCTGTCCTA | 32415 CACAGACGAGTCCCTCTCAATG | 43399 |
| 9774 GCAAAGAGAGCCCCTCGAACTT | 21432 GTCTCCAGTCAGCCTCCAATGT | 32416 GGACTCTTGCAATTCTAGGCAAAG | 43400 |
| 9775 GGAAGGAACAACCTCATTATGGTTTCA | 21433 GGGAATACAACCACTGCTCTCA | 32417 TGACAAAAGGAAGGAACAACCTCAT | 43401 |
| 9776 CCCCACAATGAGTCTCTGCAACT | 21434 TGACCTCAGACAGTTTGCTTTTAAC | 32418 CTTCCCACAAACCCCACAATGA | 43402 |
| 9777 CAACAGGACTTGATCACCAAGCAA | 21435 AGCGAGACCCTCTGCTCAGTA | 32419 TTTCCACTCTTCAACAGGACTTGA | 43403 |
| 9778 TCCACAGTGACACGGAGCTA | 21436 AGGATCCTACTGGAGATCAATCAGAAA | 32420 CACTGGAATCCTATTTCCACAGTGA | 43404 |
| 9779 CACAGAATCTCTCTGCCTGCATCA | 21437 CCTCCTTTTTGTCTCTGTCCCATAG | 32421 GGAGCAGGATTCAGGGAAGACA | 43405 |
| 9780 GCTGGTTGATAAATTGCCACGACTTC | 21438 GCTCCACACAGGTTGAGGAGAT | 32422 GCTGAAACATCTGTGCTGGTTGA | 43406 |
| 9781 GCTTTGGGGCTACTCCCTTCCTA | 21439 GTGGCTCTGATCCCTGTCACTAAG | 32423 CTGTCCTGTCCCAAGTGCTTT | 43407 |
| 9782 GCCAGGGATAAAGCTGGCTTCAGA | 21440 CTCCTTGGCACCTTTGAGCTACT | 32424 AGTGGGAAGGCCAGGGATAAAG | 43408 |
| 9783 CTCCTCAGTGCAATTAGAGGACTTC | 21441 GAATTTCAGGCTAAGGGAAGATGTGT | 32425 GACAGGAAACTCCTCAGTGCAA | 43409 |
| 9784 GCTGCAACAAGGGATCAGACTCA | 21442 CAGGTCCCTGGTGTCTTGGTTT | 32426 GAGGTAATGCCTAGCTGCAACA | 43410 |
| 9785 GCTTCTGAATGTCTCTGGAATGACAA | 21443 GCCAGAGGTAGGGGTGGAAGT | 32427 TCGAGCCTATCCATTCTAGCTTCT | 43411 |
| 9786 TGCCAGGTAGTGGGTGAGTCAA | 21444 CGGATTGACAAAACACGCAGTGA | 32428 TGTGTGCCTGCCAGGTAGT | 43412 |
| 9787 CTCGTAGCCGCAAGTAGAAATGAAG | 21445 CCATAACTTTCTTCAAGCACCACTTTG | 32429 TACCCTCGTAGCCGCAAGTA | 43413 |
| 9788 AGATGGAGGCTCCTCCTTGACA | 21446 GGGGCATGTGGGACTTTAGTTCT | 32430 GAAGACTGCTTCAAAAAGGCAGATG | 43414 |
| 9789 GATTGCCCAAGGAACATATAGAGGAA | 21447 GGCTTCTTGACCTCCATGGGAATG | 32431 ACTGCAGGAGTGACTGAGATTG | 43415 |
| 9790 CAGACATGTGTGGAGCGACTGT | 21448 AATGATGTACCTACTGCACTCTGTT | 32432 GCAATCCCTGGTTCAGCAGACA | 43416 |
| 9791 CCCTGGAAACAGTACCTACCCAAT | 21449 ACAGGAGCCCTGATAGCCATA | 32433 GAGCAAGCCCTGGAAACAGT | 43417 |
| 9792 GGCCAAATGCCTGCAAAAGA | 21450 AACCTGTAGCTAGTGCTTTATGTCA | 32434 AGTAAGGGAAGGAAAGGCCAAATG | 43418 |
| 9793 AGCCAAGAGCTGGTTTTTAGAAGA | 21451 GTTTTGCAACAAAGCTCCACTCT | 32435 CAGCAAGCCAAGAGCTGGTT | 43419 |
| 9794 TGTCTTCAAACACTCAGCACTTT | 21452 TCAAGTTAAGGAGTGGCTTGAGT | 32436 CACATGACCCCATACTGTCTTCAAAC | 43420 |
| 9795 CCTTTGTGTCCCTCCCCTTCT | 21453 GAGGGAAAGCCCTAAGCCAAGAT | 32437 ATGGCTGCCCTCCCTTTGTGT | 43421 |
| 9796 GGTGGATCTTTTGTTAGGGCTACATTTCTA | 21454 CCCCTGAGGGTAAGTGGTACCTAA | 32438 CACTTTTAGGGGAACTTGGTGGATCT | 43422 |
| 9797 CCAGATCTGACTTCATGGAGTGTTG | 21455 TGTCCAGCAGGGGACTGAGTAT | 32439 CAGTACTCCATCCAGATCTGACTTCAT | 43423 |
| 9798 GTCCTGCTACATCTAACCTTCCTTT | 21456 AACACCCTTCAAGCTTCCCAAT | 32440 CACTCTGTCCAAGTCCTGCTACATC | 43424 |
| 9799 GCTCAGAGAGTCCATGACCACTT | 21457 GCGGTACTGATGCTGCTCTGTT | 32441 GTGATAGAAATCCTTGCTCAGAGAGT | 43425 |
| 9800 GCTCTGCTTCCATCTCAGTCACA | 21458 AAGCCGGTGGACGTGTCTT | 32442 GGTCTCACAAGCTCTGCTTCCAT | 43426 |
| 9801 GTGGTGTAAAGGTTAGAAGCACAAA | 21459 CCAAGTGCTGGACCCAAATCT | 32443 TGATAGATCGTGTGGTGTAAAGGTTAG | 43427 |
| 9802 CAGTGCCCAGAAATTGCCAACA | 21460 TGGCGGGCATAGGTACACA | 32444 CAGCTCACAGTGCCCAGAA | 43428 |
| 9803 CGCTCTAGGAGTTTGCAGTACA | 21461 GCAGCTAGCAGGAGTAGAAAAATTG | 32445 CAGGCACAGCCTGGAGAAC | 43429 |
| 9804 AGAGCAAGGCCCACTCAGAGA | 21462 GGGTGCTGTTCAATAAAGCTGTGTA | 32446 AAACTTCCCATGGACAGAGCAA | 43430 |
| 9805 GGTGGAGAGTGAATCTGGCAAATG | 21463 GCTGTGATTCAAATTCAGTTGGGTCTGT | 32447 GGCACTGAAGTTAGGTGGAGAGT | 43431 |
| 9806 GCCCCAATAAAGTGGTGCTTGACT | 21464 CCCAGGATGGAGAGGGGATGAAT | 32448 TGGCACTGCAGCCCAATAA | 43432 |
| 9807 CAGTGTTGGCAGCCAGGATACA | 21465 CTTTAGATAGTACCTCCAAAGGCTGAT | 32449 TGGGCACAGATGCAGTGTTG | 43433 |
| 9808 ACTCCCAACCCCAGCAGTCT | 21466 CCCCATAGCTCCTGGTGTCACT | 32450 CTAGAATACTCCCCAGGCTCACT | 43434 |
| 9809 CTCTGGGGACTCTTTCCATCAGA | 21467 CTCAAAGCATGCAGCCTAGATGA | 32451 ACCTTGCCTCTGGGGACTCT | 43435 |
| 9810 GCCTGGAACTGCATGGCTTAGA | 21468 CCCTGCTCTCCAAGGTCCTA | 32452 GGAACACAGAAAGCCTGGAACT | 43436 |
| 9811 CCCAACTGTCACCTCCTTCTATG | 21469 GTCTCTGCTAAGAAAGATGGAACGATGA | 32453 GTTGTAATTCTCCAATCCCAACTGTCA | 43437 |
| 9812 CGGGGTGGGAAGAAGTAGGACAT | 21470 TCAGGCCCAGAGAGGCATTA | 32454 TCAAGTCGGGGTGGGAAGAA | 43438 |

FIG. 36P1

| | | | |
|---|---|---|---|
| 9813 GAAAGCAAGTCCATTGCTCCAAA | 21471 GCATTTTTCTGGAGAGCAAGTCTATTG | 32455 CAGAAAAGTGACTGGAAAGCAAGT | 43439 |
| 9814 GCACAGGATGAGGCTATTCTCTGAA | 21472 CTCTTTAGCAGGCCCAGTTTCT | 32456 GTCTTTCCCAAAGCACAGGATGA | 43440 |
| 9815 GCTGCTTGGAATAGTTTGTTCTCATCTTAG | 21473 CTGAGATGTGTTAGCGTCATTGCTT | 32457 TCTGATGCTGCTTGGAATAGTTTGT | 43441 |
| 9816 CAGGGTGTAGCCATCTGATTTACA | 21474 CTGTCACTTGTCAGCGTGGAT | 32458 GCACGCTTTTAATCAGGGTGTAG | 43442 |
| 9817 CAAGGTGGGCAAGGAAACTGA | 21475 CTCTTTCCTATCGAGGTGGGTTTCA | 32459 TGGGAGGAGGACAGCCACAA | 43443 |
| 9818 ACCCACTCCAATTTTGAAGCAAAC | 21476 ACACCTGGTCAGGTCGTAATAGT | 32460 CCCAGCACCCACTCCAATTT | 43444 |
| 9819 CAGGCTTGGAAAGGGAGTGATAG | 21477 CAGGGGATCTAGAGGCAGCTTT | 32461 CACAGGTTACCTTAATCAGGCTTGGAA | 43445 |
| 9820 GACAGCCAAAAGCCAGGTGTTAG | 21478 CCTTACAAGGTGTGTCTGTGCTTCT | 32462 GGTGGCAATGACAGCCAAAAG | 43446 |
| 9821 GGTTGTTGGCTGTTAGAGCGTATTTC | 21479 GCTTTGTTAAGCACTTGTCTGTTGAGA | 32463 CACTCACATGGTTGTTGGCTGTTAG | 43447 |
| 9822 TGGGTGGTAGGGCACATTCA | 21480 GTCCAGGATAAGGAGGTGGTGGTAT | 32464 CTTTGGCCTGTATATTGGGTGGTA | 43448 |
| 9823 GGGTGTTATAGCCAGACCAGAAAACA | 21481 CCTGTCAATTATGAAAACTGGGCCTTTTGT | 32465 CTCCAAATGTCAGCAGGGTGTT | 43449 |
| 9824 CCAGGTAGCTAAGCAGTGAAGACA | 21482 GAGGTGAATGATGAGGAGATACAGAGAT | 32466 CTTGGCTTCAGAGTTTCCAGGTA | 43450 |
| 9825 GGCAAGGCAATTTGGATTATGCTTCA | 21483 GATGACAAGGGTACAGAAAGATCAACT | 32467 AGCTGGCAAGGCAATTTGGAT | 43451 |
| 9826 GGAATGTCTGCTTTCACTGCTTT | 21484 ACCTGACTGCACTAACTAGACTCTT | 32468 AGAACAACACAGGAATGTCTGCTT | 43452 |
| 9827 CCTGTACAGCATCTGTCGCTAT | 21485 GGGGCAGTGTACAGGCAAAT | 32469 CGCTTGTGCTACCACCTGTA | 43453 |
| 9828 GAACAGGCCAGATTCGCCTAAG | 21486 GGCCAGGCTGAGTTTCTTCT | 32470 CCAAGGAACCTGACAATTGCTGAA | 43454 |
| 9829 GTTTCTTTTCACCTCCAACATGGAA | 21487 GTGCAGCACACAGAAAATACATCACT | 32471 CACTGTGTGTGTCCTTCATCTTGT | 43455 |
| 9830 CCCTACTTGGGTACCTTGTTGCTA | 21488 GGCTTTGCAACCTGCTAATTCCTA | 32472 CCACAGCCCATTTTAACCCTACTTG | 43456 |
| 9831 AGGTTGAGTCCATGAGTACAGACA | 21489 CACGATAATGCCACTTAGGTATGATG | 32473 GGAAGGGAAGGTTGAGTCCATGA | 43457 |
| 9832 CCGAACTTCAGGGAATAGCCAAGA | 21490 CCCCACAGCCTAGGGTAATGAA | 32474 ACCCATAGGGTGCCGAACTT | 43458 |
| 9833 GCTCAAACCCCACCTACTTGTCT | 21491 GTGCCAAAGAAATGGCTAGGTAATGTTG | 32475 AGCAGGCCCAGCTCAAAC | 43459 |
| 9834 CCTCCCCAAGAAGTAGTCTTCGAT | 21492 GACATGGTGAAGTGCCTCCTAACA | 32476 CTGTGTGAAATCCTCCCCAAGAAG | 43460 |
| 9835 GCAATCTCCTCACCCTCTGGAGAA | 21493 ACTGATTCATGTGCCACCCATT | 32477 GAGTCCTGATGTGTGGTGCAATC | 43461 |
| 9836 AGCAACAAGCTTGGTATGTTCAAG | 21494 TGCTCTGCACATTTTTCACTCTGA | 32478 ACTGCTGAGGCAGCAACAA | 43462 |
| 9837 CCCCAGTGTTTGAGTGAGTACTTTG | 21495 TGGTGTAGCTGGGAAAACTGAAG | 32479 GGATTTGCTACCCCAGTGTTTGAGT | 43463 |
| 9838 CCCACTGGGAGAAAAGGGAGTGA | 21496 TGGTCAGGCAGTGTGGAACT | 32480 TCCCTTGCCCACTGGGAGAAA | 43464 |
| 9839 GGCTGAATAGACAACCAGCCTTGA | 21497 TCCTCAGGGGAGTGGGTTTTGA | 32481 GCAAGCTGTGGCTGAATAGACAAC | 43465 |
| 9840 CTCTGTCACCAACTCTGTGTCAT | 21498 GAGTAATCTGAGAGCTCAAGGAGTCAA | 32482 GTGCTCTTCACTCTGTCACCAACT | 43466 |
| 9841 CTCTTCATGGAATGGGTCATCCTT | 21499 CTGAAGGGTCTGTGCCTTGGTAAG | 32483 TCCACAGCTTCGAAACTCTTCAT | 43467 |
| 9842 CCTTCTCACTCCCTAGCTTTGTT | 21500 TCTCTCATCTCTTGAGTGTGGAATG | 32484 GGGATTTGCTACCCTCCTTCTCA | 43468 |
| 9843 GGCTGTGCTGAAGTTTTGTCTCT | 21501 CTGTGCAACCTTCATGCTCACAAC | 32485 GCCTCCTAGGCTGTGCTGAA | 43469 |
| 9844 CGTAACCTCTACATGGCCAATGACT | 21502 CGGCTCACCCCTAGCTTCTTG | 32486 TGTGCTCCCGTAACCTCTACA | 43470 |
| 9845 GTCCTCTCCTTGCTGTCTCCAAAG | 21503 GCTGACGGGCAGAGTTGTTCA | 32487 GGACTCAGCGTCCTCTCCTT | 43471 |
| 9846 GTCTGCTTGGATGTAGACAGGTCAA | 21504 AGGCTGGCTCTTGGTCTCAAC | 32488 GCAAGTTCATGTCTGCTTGGATGTAG | 43472 |
| 9847 CAGGGCTACCAAGGTTTCCATT | 21505 GCACAGTTAGATTTAAGGCGTGAAC | 32489 CTCTTGAAAATCTATCTACAGGGCTACCAA | 43473 |
| 9848 GGAGACGATTCCCAATGTCAATGTT | 21506 ATGAGCAAGGAGAGGATTCAGCAA | 32490 CACATGGCTTTTGGAGACGATTC | 43474 |
| 9849 CAGTTACTTTACCCAGACATTGTCATC | 21507 CACTGAAGCAGTCAGGTTGGTT | 32491 GGATTGACCCTTCCCCAGTTAC | 43475 |
| 9850 CCTTGGGTGGGAATTTTTGAAGAGAAA | 21508 TGTGGACACTGGGACCTCTCT | 32492 GCATGTTCCTTGGGTGGGAAT | 43476 |
| 9851 AGGCCCAGTGATGCACAGAT | 21509 GACCCATCTGTGAAGGATGCAA | 32493 ATGTGGCAGGCCCAGTGA | 43477 |
| 9852 GGCGGATAAGCCCAGATAGTTTC | 21510 GGATGCTTGAGGGAAAACTGGAT | 32494 GCCTGAGTTGACAGGCGGATAA | 43478 |
| 9853 GGGCAGAAACCATATCTTTGCATT | 21511 TTTCCTGTGCTTACTTCTGTGCTA | 32495 GCTCTGTTAGGGCAGAAACCAT | 43479 |
| 9854 GCACCTTGGATGATTCTTGAGAAAA | 21512 TGTAACCTTCTGGGATTGGCTTT | 32496 CCCATTGATACAGCACCTTGGATGA | 43480 |
| 9855 CCTCCGACCTACAAAACTACTGAA | 21513 GGAAACGCAGCTAGCCTTAGA | 32497 CTACTTTTCAAATCCTCCGACCTACA | 43481 |
| 9856 GCAAGGATGGGTTCAGTTGCATTT | 21514 AGCCCAGGTCACCAAGAGACT | 32498 GGTGGTTTGCAAGGATGGGTTCA | 43482 |
| 9857 CCACTCATAGCATTGAGCGCCAAAG | 21515 GGAAGCAAGGCCCACACATCA | 32499 GCTCCAGATCCCACTCATAGCATTG | 43483 |
| 9858 CCAGCAGAAGTGGGGATCTGA | 21516 CCTCCCCAGCTGACAATCAT | 32500 ATTCCCACACGCCAGCAGAA | 43484 |
| 9859 ACAATTGTGATGCCGTGCGAAT | 21517 GCCCATTTATTCTCTGCCTAAAACAACAAG | 32501 GTCAACATACATAGGGCCAGAACA | 43485 |
| 9860 CAGGGCTTGATCTTTGGTAGAGTGA | 21518 ATTCCCCTAAACCATCCAGGATTC | 32502 AAAACTGACAGGGCTTGATCTTTG | 43486 |
| 9861 GGGGCTTTTGTAAGGCTCGAAGTATTTAG | 21519 GCAAATACCTGTGTAGCCAGCATCA | 32503 GGAAGGCACATGGGGCTTTGT | 43487 |
| 9862 GGAGACCTGTCAATCCCACAGAAG | 21520 AGCAGGCCAGTAGGCAGAGA | 32504 CCAGCCTTTGGAGACCTGTCAA | 43488 |
| 9863 CCAGGTGGGTCAGAAAACATCACA | 21521 GGGAAAACTCTTCCTAAGCTTCAGTT | 32505 TCAAAGTCCAGGTGGGTCAGA | 43489 |
| 9864 GGCGCTCACTCAGGAAAATTAACCAT | 21522 TTCCCTTTCAGTGTAAACCTGTGT | 32506 AAGCCAGGCGCTCACTCA | 43490 |
| 9865 CGTGTTCTGAGGACCTACAGTTATT | 21523 GAAGTACCAGCGGTGCATCTTC | 32507 CCTGGGCTTCCGTGTTCTGA | 43491 |
| 9866 TGACAGTGCACACAGTGACTT | 21524 CTCACCCAGGGATTCAATGACA | 32508 GGGCATGGGTGTGGAATGACA | 43492 |
| 9867 ACCAGATGGGCTCCACACA | 21525 GCAGCTCTGCTGAGTGAAAAC | 32509 CACGTAACCTCTGCCACCAGAT | 43493 |
| 9868 CCCAACCTCAGCATAGCTTTTGA | 21526 ACAGGTTGTTTGTGATACAGCTTCT | 32510 CCACCATACCCAACCTCAGCAT | 43494 |
| 9869 GGGCTTTGCTCAGTCTTCCTGTTC | 21527 CCATGGCATAGGCATGCAGGAT | 32511 TGGAGTGCTGGAGGGCTTT | 43495 |
| 9870 GCAGATCCAGTAAAGCAACCTGTCA | 21528 GCTTGGACAGCTTGATTCTGAAGTT | 32512 TGGTCCATATGCAGATCCAGTAAAG | 43496 |
| 9871 GCACCAGTTCCCCTTTTCTCCTT | 21529 AGCCCCAGAGGCCCTAAAG | 32513 CCATGCATTTTAGGCACCAGTTC | 43497 |
| 9872 CTGGTTTCCCACATGCTGTGTCT | 21530 TGCTATGCCTCCCTCTGGTAGT | 32514 CCAACAAAAGCTGGTTTCCCACAT | 43498 |
| 9873 CCAGATTCAGTCCTCACCCTTGT | 21531 GATGACTGTCTTTCCTCCGTAATAAAC | 32515 GGGGATAAAATAGGAGCAAACCAGAT | 43499 |
| 9874 CTGATAGCTTGTGACCTAAGCCTAGTA | 21532 CAGATGAAGAACCGTAGACTCCAACT | 32516 CAGAAGTTCCACTGATAGCTTGTGA | 43500 |
| 9875 GCTCTCCTCCCTCCCAGTCT | 21533 GCAGGAGCCCGTGCATTTG | 32517 TAGGCGGCCAGCCATCTCT | 43501 |
| 9876 GAGGAAGACAGCTTGGAAGTTTGA | 21534 GGGGCAGGAATGGGAATCAAGGTA | 32518 TGGTGGTGGGTGCAGAGA | 43502 |
| 9877 CACTAACCCTAAACCACCTCCTGAA | 21535 TTAGGGGCCCATGGCTCACA | 32519 TGGGGCTGCCGATCTCACTAA | 43503 |

| | | | |
|---|---|---|---|
| 9943 GAGTGTTGAGGACGGAAAGTCA | 21601 ACCTAACCCTCACATTCATTTGCTT | 32585 GCCCAGTGATTAGCACAAAGTGA | 43569 |
| 9944 CCCTATGGGAGGCAACCCTTCT | 21602 ACCCTGACCACTTGTGACTCT | 32586 TCGGGCCAGCTTACCCTATG | 43570 |
| 9945 TGAGGATCGCATTGAGCAACA | 21603 GTGCACGGGAGCAAGAAAAAC | 32587 TGCCCCAGGCTGACCATGA | 43571 |
| 9946 CCAGGCTGCTAAACATTTTCCAGAGA | 21604 GCTCTGGTGCACCCTTGACTTA | 32588 CAAGGATGTTTTTCCAGGCTGCTA | 43572 |
| 9947 GGAGTCATGCCTTCTGCAATTTT | 21605 ACACGTGCTGAAATCCAGGAA | 32589 CAAACAGCAGGTGTAGGAGTCA | 43573 |
| 9948 GAAGTGGGTAGAGATGGAAGAAGGAA | 21606 AGGAAGACCAGGATACAGACATAAGA | 32590 GGAGGAGGAGAAGTGGGTAGAGATG | 43574 |
| 9949 CTTGACTGATAGTTCCCGGCTTT | 21607 TCCTTGGCTTGGGACCTCCTT | 32591 GAAGTGTGAGAGGAACTTGACTGA | 43575 |
| 9950 GGAACACTGGGGACTTGTCTGA | 21608 CCACACTGAGCACTTGCCTACT | 32592 GGACCCAGTCAAAGAACTGGAACA | 43576 |
| 9951 GGAAGTCCAGGAGTGGAGATGTCA | 21609 GTGCTTGCTGCAATTCCCCAAA | 32593 CGCTCTGGGACACTGGAAGT | 43577 |
| 9952 TCCTTTGGGTACCAGGAGATGA | 21610 TGTTGGATGCCATGATGAAGAGA | 32594 TCGCCAGTCACTGCTCCTTTG | 43578 |
| 9953 GGCTTCATCTCCACCCATGAA | 21611 CCTCAGTCCCTGTCAGTTAGTGT | 32595 CCTTTCCTCAGACAGGCTTCATC | 43579 |
| 9954 GCCTCCCAATATAACTGACTGCTTTC | 21612 GGGGCTCCGAACGGAAAAAC | 32596 GCCTCCTCCAGCCTCCCAATATAA | 43580 |
| 9955 GACATGAGGCAGACAGCTGTTCTCA | 21613 GCCCTCAGAGAGGCACTCAAT | 32597 ACCCTGTGACATGAGGCAGACA | 43581 |
| 9956 GGAGACACTACCTGTAGGTCAAAAG | 21614 TGAGAACCAGGAGCCAGAGAAT | 32598 GAGCTGATTGCAGGAGACACTAC | 43582 |
| 9957 GCTATCACTGGGTTCTCCGAACT | 21615 GTCCAGAGCCAGGAGAGAGA | 32599 GGCCAAAGGCCCTGTGCTAT | 43583 |
| 9958 GGTCTTATTAACCCTAAGAAGCTGTGAAC | 21616 CTCTTCTTCTCAGAATTCCACCCTGAA | 32600 CCGGCTGGTCTTATTAACCCTAAG | 43584 |
| 9959 ACTTCTCGCAGCTTTCCTAAATCA | 21617 AGGGCCTCAGACCCATTGAACA | 32601 CCCCATAGTATAACTTCTCGCAGCTTT | 43585 |
| 9960 GACAGCCTTACAGAGACTGCTT | 21618 AGGATTTGTTACTGGGCTACACAA | 32602 CTGGCATTAGATGAGTTGACAGCCTTA | 43586 |
| 9961 AGTGAGTGGCTCCTGCATGT | 21619 CACAGTCCTTCATAAACGGAGTTAGT | 32603 GGGTGCTTTCCCTTGAGTGAGT | 43587 |
| 9962 GAAGCTGTAGCAAGGAGGAGAAATG | 21620 GAAGGTTGCTTTCTGTGTTTGAGA | 32604 GCATGATTGTTCCTTAGAAGCTGTAG | 43588 |
| 9963 AGGCTCACCTTGCATCCACTTG | 21621 GCAAAGATGAAAACTGGAAGCTACAAC | 32605 CCCATTGGAGAGGCTCACCTT | 43589 |
| 9964 ACTCACCAAAGTGTGCCCTAAAC | 21622 TCTCGGAGACCAGAGGGAGATAC | 32606 CCCCGACCTTGAACTCACCAAA | 43590 |
| 9965 AGAAGACATGGAGTTGGGATTTGT | 21623 GAAGCTGAAAGTGGCAGCTAGT | 32607 CCTGGGCTGGTCCAACAACTAAG | 43591 |
| 9966 GCGTCACTGTTGGCATCACA | 21624 TCTTCTGCCTTAGCAATTGAACAGT | 32608 GGCTCTAACATAACACACGCGTCACT | 43592 |
| 9967 ACTGCCTGGCCTGCTATTTC | 21625 TGCTCTTGTGTACATATGTCTGCTT | 32609 AGCGGAGCCCAGTGAGTTA | 43593 |
| 9968 GGATTGTGACAGCACAGTAACAGTTG | 21626 CAGGAATAAGGATTTGGATCTCTGGCTTT | 32610 GTCTGACCCCACTGGATTGTGA | 43594 |
| 9969 TCACAATCTGGAGTCACAGACATTATC | 21627 CACATGACGTCCCTGTCTGTGT | 32611 GACATTCAGTTCACAATCTGGAGTCA | 43595 |
| 9970 GGAGTCAGTGGCCTGAGTTCTA | 21628 TGAGGCTCAAAGTGATACAGCTATT | 32612 GAAAACACTGGACAAGGAGTCAGT | 43596 |
| 9971 CGCCACCAGACAAATGGTGTTG | 21629 CTGCTCGACTCTTCAGTAGGTGAT | 32613 GCCATCACGCCACCAGACA | 43597 |
| 9972 CCCAGTTTCTGCTTCAACTCACTGT | 21630 CCTGAGTATGGGAGAAGGGGATTTG | 32614 CCACAGACCCCAGTTTCTGCTT | 43598 |
| 9973 CCTTGATCTGTCTGACTGAGTGGATTT | 21631 GGCAACAAGAGCGAAACTGCAT | 32615 GCCCAGATCTCCCTTCCTTGATCT | 43599 |
| 9974 GGGGTTGAGAATGAACTTGTCACT | 21632 CCACAGCTGCCAGTGGTCTT | 32616 GCAAAAGGCTGGGGTTGAGA | 43600 |
| 9975 CCTGCAATTCTTGACTGAATGGTTTG | 21633 CCCCAGAAGCTGACCCTGAAGATA | 32617 GTCTCCTGGTGTTACCTGCAA | 43601 |
| 9976 GAGGGAAGAAGGTTCAGGTCAGT | 21634 TGGCCCCACTCCATCTCTAAG | 32618 GTGGAGTCAGCAGGAGATGTGAA | 43602 |
| 9977 CCCACTGTGCCCCATGTTGTTT | 21635 CCTGAGCTACAGGAGTGAGACA | 32619 AGTGCCCACTTTCCCACTGT | 43603 |
| 9978 GGTGGAAGGCTACCCTGACATAC | 21636 CCAAGCCGCAAGGTGGTTTTATG | 32620 GGCTCTGTGCTAAAGGGTGGAA | 43604 |
| 9979 GCCTGATGTGATGGGAGGTTGT | 21637 CCAGGAGCGCAGCTACAGA | 32621 CATGCTGTGAGCCTGATGTGA | 43605 |
| 9980 TGCGGGAAATTCCAGTGATTAGA | 21638 TGGGAGCCAAAGAACTTGTGT | 32622 CACAGGAGCATATGCGGGAAA | 43606 |
| 9981 CCCTCCACACAGATTGGTAAGCAAA | 21639 ACGCTGTGCTCAAACACTTCT | 32623 ACTCTATGCCCTCCACACAGAT | 43607 |
| 9982 GGTGTGTCTGAGGATAGACGTTAC | 21640 TGGGCAAACATGGGAGATGATAG | 32624 AGCTCCTGGTGTGTCTGAGGAT | 43608 |
| 9983 GTCAGCGTCTCTCTCCCTGATACA | 21641 GATGTGCTGAGAAGGGTTCAGA | 32625 GCTTTCAACAGTCAGCGTCTCTCT | 43609 |
| 9984 CTCTCCATGTCTGGTCCCTTGT | 21642 AAGAATTCAGCTGCCAGGAACA | 32626 GGTACCATCTTAGCCTCTCCATGTCT | 43610 |
| 9985 CTCCACCATGCAACTTGTGAAAG | 21643 GCTTAAGGCCAGAAGTTTGAAGGTT | 32627 CGATATCTCACTCCACCATGCAA | 43611 |
| 9986 GCCTGGTCCACCCTAGAAGGAATA | 21644 GCCATGGCCGACAAAAAC | 32628 CTTGCCGGGCTGCTGTATTG | 43612 |
| 9987 CAAGACTGAGCTGGTCTGCAA | 21645 GGCTCACCCAAACCTTGGAA | 32629 GGTCACTGCTTTGCCCAAGACT | 43613 |
| 9988 GCTTCAGGGGAAGTTTTGTCCATAC | 21646 CCCCGTCCCACAGTAGTCTTATC | 32630 GCATTCTGAGCTTCAGGGGAAGT | 43614 |
| 9989 CTGGGTGCTCTGAGAAAGGTGAT | 21647 ATGGTCTTTGGGTTGGCAAAATAC | 32631 GGTGAATAGCTGGGTGCTCTGA | 43615 |
| 9990 GCCCGCTGAAGATGAGATTTCAAG | 21648 CCATAACAAGAGAGACTAAAGGCCGTATC | 32632 ACTGAATGAATAAGCCCGCTGAA | 43616 |
| 9991 CCTGCCAAAAGAGAAGGGAACT | 21649 GCTGCTGGCCCCAGTAACATT | 32633 GCCAGAGGAAGAGATCCTGCCAAA | 43617 |
| 9992 GACCTTGCTAGGCACTGTGATTTG | 21650 CTTAGGCAGAAACTTGCCCAAAG | 32634 GGCTTGAATTCCTGCCTAGACCTT | 43618 |
| 9993 CAGGATGCAGTAAATGGCAAAGACTAC | 21651 TGGTTGCAAATTTGGCAGTGAA | 32635 GCTAGGTAGGCTACAGGATGCAGTAAA | 43619 |
| 9994 TTTACAGGCATAGATGCGGAAACA | 21652 GGTAATCACCCAGCCATAACCAATCA | 32636 GGTGAGCAGCGAGCTTTTACA | 43620 |
| 9995 TGAGGACGAGGGATGAGAAGATG | 21653 GCAGCTGCCTCTGAGTGTTTG | 32637 CGCGTGAGCTGTTTTTAATGTTG | 43621 |
| 9996 GGTTTGCTCTGCAGTCTGGTCAA | 21654 AAGTACTGACAATACAGGCAGGTTT | 32638 AGGGTCAGATGCGTGGTTTG | 43622 |
| 9997 TCCATGGGACTTGAGGTGGAA | 21655 GCAGAGGGAGCCTCTAGTGTA | 32639 GGAAATAGCCTCTTCCATGGGACTT | 43623 |
| 9998 GCCAAGCAGATCTCCACTGT | 21656 CCCACAGCACTGCTCAAGATG | 32640 TGGGGTCAGAGCCAAGCAGAT | 43624 |
| 9999 CATACCCACCTCAGGCTACTGT | 21657 ACTCCTCGCAGACATCAGTCTT | 32641 TGTCAGTCAGGGCCAATCATAC | 43625 |
| 10000 GGAGTCTCAATCCCTGCAATAGAACAGT | 21658 GTCCAAATTTTCCTGGCATGCTTAGT | 32642 GGCAAGGAGTCTCAATCCCTGCAA | 43626 |
| 10001 CTCCCTCCTTCATTGGTGAAGACA | 21659 ACCTCCTGCTTCCCTGAACA | 32643 GCAGGGTCTGATCTCCCTCCTT | 43627 |
| 10002 TCAATGCGGTAATGGGTCCTAAG | 21660 CATCCGCAGCACTGAGAGAA | 32644 GAGCCTTGTCAATGCGGTAATG | 43628 |
| 10003 CAGCTAACACAGTATCTCTTCACTCA | 21661 CCCATTGTGGGATGCACATTGATT | 32645 CACGCAGTCAGCTAACACAGTATCT | 43629 |
| 10004 CGACAAAGTTTGCAGGCAGTAAC | 21662 CCGGCTGAGCACACCATCT | 32646 AGGGCAGGGACGACAAAGTT | 43630 |
| 10005 CCTTGTCTGTCACCCTGGTTCA | 21663 TTCCAGCTGACTGTCCTCAGA | 32647 CCAAGACATGGGCTCTTCCTT | 43631 |
| 10006 CTGCCTGCAAGTCAGGATGAGA | 21664 GATCAGTGTGGTGGTGAATTGGAT | 32648 AAGCTGGCTGCCTGCAAGT | 43632 |
| 10007 CTCTCCTTCCCCTTTAAACCTTGTGA | 21665 GGCAGAGTGGGGACACACA | 32649 CTCAGAGCTCTCCTTCCCCTTT | 43633 |

| | | | |
|---|---|---|---|
| 10008 GGTCCTGGCCCAGTTCCAATTT | 21666 ATGCAAGGGAGCAATTTGCATAG | 32650 CCCCAATGCAGGCGATGA | 43634 |
| 10009 AGCAGGTTGGGGCCAATGA | 21667 CCTGAAAACATGTAGAGGAGCTTTGATG | 32651 GCAGGAAGGGTGAAGTAGCAGGTT | 43635 |
| 10010 AGCTGGAGTGAGGATGGAGTTC | 21668 CCGAGGCCAGACCTGCTACATATT | 32652 AGACCAGGGTAGCTGGAGTGA | 43636 |
| 10011 AGTGCGAGGAAGCCACCATCTA | 21669 GCAACGAGCTCCTTCTGATGA | 32653 CCTGAGTAGTTGACAGTGCGAGGAA | 43637 |
| 10012 GACCTGGTATTGGTGACCCTAAGA | 21670 CCTAGCTCAGCCACAGTGGAATA | 32654 AAGGGCCCAAGACCTGGTA | 43638 |
| 10013 GGCTGGGACATGAAATCCTTGACT | 21671 GGAGCAGGGGCTCAGAAAAGTT | 32655 CAGTTGTCTGGCTGGGACATGA | 43639 |
| 10014 CGCTGTTGGTTAAATTTGCAGTTG | 21672 TTCACATATTAGCCTACACTCCTCTTC | 32656 AGGCAATCCGCTGTTGGTT | 43640 |
| 10015 GCAGCCACAGACAACACAGA | 21673 AGTTTCTTGGACCCCAGACATTC | 32657 AGCACAAAAGCAGCCACAGA | 43641 |
| 10016 GGTGACATGGTGGGTAGTGGATGA | 21674 ACGCAGCTGAGTTCCACGTT | 32658 CCTCAGCACTTACACGGTGACA | 43642 |
| 10017 GGTTTTGAGAGGGTAGGTAGGTTTG | 21675 TGTCTTGGCCCCATCTCCTT | 32659 GGGAGGATTACCCACCTAGGTTTTG | 43643 |
| 10018 GCAGTGTCTTGGAAAGGAAAGGGATA | 21676 GTTCACCTTCAAGCAAACCCTATAC | 32660 CAGAGTCTGAGCAGTGTCTTGGAA | 43644 |
| 10019 CTGGTGTTAGGCTCCTGGATATG | 21677 CCCCTTTTTGGTCTGTTTATGGCAAGT | 32661 TTCTGCTGGGGCTGGTGTTA | 43645 |
| 10020 TGCCTGGTGCCTTCACACTT | 21678 GCTCAGCTTATAGTAGCCAGAGAAA | 32662 ACACTCGCGTGCCACTGAT | 43646 |
| 10021 CAGCCTCTTAGTTTTTCCACCCTTCT | 21679 TTGCAGTGTCACCTGGGATAAG | 32663 GCAAGTCTCCACCAGCCTCTT | 43647 |
| 10022 ATGTGTAGGGACTAGAGGTCGTT | 21680 GCAGAGAGAAGCAACTCAGCTTAC | 32664 CCCACTCCTAAATGTGTAGGGACTA | 43648 |
| 10023 CTCCAGAGAGTGACCTCTCCAT | 21681 GCAGACCATAGTGGCTGAGGTT | 32665 GAGTAGTTCCTCCCTACTCCAGAGA | 43649 |
| 10024 TCCCAGCTCCAGGCTCCAA | 21682 GGAGGTGGGGCATAAGGTGATTC | 32666 TTCCTGGCCACCCTCAGT | 43650 |
| 10025 GGGATCAGTGGAAACATTGAATGCCTTTT | 21683 GCCAGCTGCAACAACCATTAG | 32667 GCCTGAGGGATCAGTGGAAACATTG | 43651 |
| 10026 GCAGAGGGTTTATCCCATTCCAAAC | 21684 GCATCTGAAGACTCTCCTTCTTGT | 32668 CGTGCTCAAGGCAGAGGGTTTA | 43652 |
| 10027 GCTTGTTACACAGCTGCCTATTATTTC | 21685 GCAGAGGAGCTCAGCTGTTT | 32669 GTTTTGGAGGGAGTGTGATGCTT | 43653 |
| 10028 GTGCACTGAAATTCCTCAGTGGTTAC | 21686 CGGTTTTCAGATTTCAAGACGGTGTGT | 32670 GAGTCTTAGTCTGGTGTGCACTGA | 43654 |
| 10029 GCAAAGCTGTCTTTTGTGAGGAAGA | 21687 GGTGCACCGATGCAGATTCTCT | 32671 GCCAGTAAACAGAAGTTGTCCTGCAAA | 43655 |
| 10030 TCTACCTGCAAAGGTCCACTCA | 21688 AGGGACGTAGAGGGGACAACTAC | 32672 TGAATTCGAACCATCTACCTGCAA | 43656 |
| 10031 TGGTGGATGAAGGCGACGTT | 21689 CCACTTGGACCAGAGAGACGTT | 32673 GTGGGTTAAAAGAGGATGGTGGATGA | 43657 |
| 10032 GCCATATTTGCTGTTTCACAGCCTTAG | 21690 CCCTAGAGCCCAAAGGCAACAA | 32674 GCAGGCTGCCATATTTGCTGTTTC | 43658 |
| 10033 GCACGGTTTCATCACTAAGTTGAGATT | 21691 TGCTCTTCTGCTGGAATTTACCAA | 32675 CATTAAAGAGCACGGTTTCATCACT | 43659 |
| 10034 GGCTGCATGAAACCCACTCT | 21692 GCAGGAATTCAGAGGAATTGGACTT | 32676 GGCCTCTTAAGTTCTAGGCTGCAT | 43660 |
| 10035 GCCATCACCTAGGTCCAACTAC | 21693 TCTCTCTGAATCACCTGCTCTTA | 32677 AAGGGCCTTAGCCATCACCTA | 43661 |
| 10036 GTCAAGCTCAACTGTCATCTGCTT | 21694 TCGGACAATCACCTGAAATGAAAAC | 32678 GGACGTGACCTCAGTCAAGCTCAA | 43662 |
| 10037 GCCTTCATCGAGGTAGGATAATTTGT | 21695 GTCAGAATTAGGCCTCTCTCAACCTA | 32679 AGCTTGCTAGCCTGCCTTCA | 43663 |
| 10038 GTGTGCTCATCCATCCCACCTT | 21696 GTGTGGGTGGGTACTGAAGGAA | 32680 AATCCCAGCGTGTGCTCATC | 43664 |
| 10039 CCCAAACTGCCTATTCTAGGACGAA | 21697 GGTGTTGAACGCCATTTTCACA | 32681 TCACAAGACCCAAACTGCCTATTC | 43665 |
| 10040 ACAGGCTCTTGACCCCTAAAGT | 21698 CCTTTTCTCCCATTAATCCATCTGCCTTAT | 32682 TAGGGGCCACAGGCTCTTGA | 43666 |
| 10041 CGTGGCAGAATTTGTTTGGAGAGA | 21699 CTTTGTCTGTCTGCATCTGACATTT | 32683 CCGGGAGAACGTGGCAGAATTT | 43667 |
| 10042 AGCCCTGTGAAAGGGAGATTG | 21700 GAGAAGAGCCTGGGCTATATTTCAA | 32684 GTTTGGACTGAGCCCTGTGA | 43668 |
| 10043 AGCCTCTGGAAGAGCCAGGAA | 21701 GGCTTGGCAAGGTTTCAGGTTTG | 32685 AAGAGCCACCAGCCTCTGGAA | 43669 |
| 10044 GCCATACCACCAAGGGCTATTTG | 21702 ATCGCGGGCATCTGTGTAAC | 32686 GTCTCTGCAGCCATACCACCAA | 43670 |
| 10045 GGGCAGCGTGTTAGACCCTAAA | 21703 TCACAGGGTTGGCAGGAACT | 32687 GTGTTTTCAGGGCAGCGTGTT | 43671 |
| 10046 CCCAGTGACCTTTCCTCACCAT | 21704 GACCATTTCATGCTCACTGCTTTCTTG | 32688 CGCTGGTTCCCAGTGACCTTT | 43672 |
| 10047 CTGCTGAAATTAGAGGTTAGGCTGAGA | 21705 AGCTGCTGCAGACCCATGT | 32689 ACACACCCCATCTCTGCTGAA | 43673 |
| 10048 ACTGTTCCCAGATTTTCAGCAAAC | 21706 TCTGGCTCAGCATGGTCACT | 32690 GGCTTTGAGCTAACTGTTCCCAGAT | 43674 |
| 10049 GGGGATTAGGGTGCTAATGGATTC | 21707 GGCCCCTCTGTAAAAGTGCAT | 32691 CACACACTCCTTGCTAATGGGGATT | 43675 |
| 10050 GCTGGGAACACGGTGCATGTAAG | 21708 AGCTGCGGGCAAGGTATCA | 32692 TGCAGGGCTGGGAACACA | 43676 |
| 10051 GACCCTGTTGTGAGGCTGTT | 21709 CCTATTGCACACGGTCACAATTT | 32693 CCTAGAGACCATGACCCTGTTGT | 43677 |
| 10052 CCGTAAAACACCAATGACTACCTTTG | 21710 CCCTACTCCCAACTGCACTTGAAC | 32694 CGTGCATCCGTAAAACACCAATG | 43678 |
| 10053 GGGCTGCATGAAACAGAACGTGTA | 21711 CCCCAGACCTGTGATTCACCAA | 32695 CAGGTGGGCTGCATGAAACA | 43679 |
| 10054 CTCAACCCAGTAGCCAGAGTGA | 21712 GCACAGGAGGTAATACGATCTGACATCT | 32696 CCTGGGGTCTATTCTCAACCCAGTAG | 43680 |
| 10055 TGGGCATCTTACATGGGTGTTG | 21713 CCTGAGGGTGCACCTGCTTAG | 32697 TGAACCCCTGGGCATCTTACA | 43681 |
| 10056 CAGCCTTCATGCTTTCTGAACTTG | 21714 GCAGGCAATAACGAATGAGAGTTTA | 32698 GTTGACCTCAGCCTTCATGCTT | 43682 |
| 10057 GGAAAGTCAGCATTAGCAGCAAGT | 21715 GCCAGTTCCCTCTGGGACGTT | 32699 GGCAGCTCATGGATGGAAAGT | 43683 |
| 10058 GGCTTGTTACTCACCCCAGGAAGA | 21716 CCTCTTCCCTCACCGTGTTGA | 32700 GACTCCAGGGGCTTGTTACTCA | 43684 |
| 10059 TGTCTGGGCTCTTGCATCTTTG | 21717 TTCTGAGTTCCAGAGACACTACAAG | 32701 GCTTCCTAAAATGTCTGGGCTCTT | 43685 |
| 10060 CAAACCTGCATGTGATACGTTTAGA | 21718 ACGCCCAGCCCCAACTTTTA | 32702 GGGTGCGACACACCACATAACA | 43686 |
| 10061 GCAACATACCCAAATGCTAATGCTAGT | 21719 GCTCTCCTCCCCAGGAACCAT | 32703 GCTGGGAACACTGTGCAACATAC | 43687 |
| 10062 CCAGCAGTGGCTGTTCTCTGAA | 21720 CGCTGGAGACTGGTCTGAGTTCAA | 32704 GGATGGGACGCCTGACTCT | 43688 |
| 10063 TCGCCTCTACGGACCAAACTTC | 21721 GGGTGCCAGGACTTCCTCTGA | 32705 TCTCGTGCAGTTCGCCTCTAC | 43689 |
| 10064 GGGCTTGTTTCGAGGGTCACT | 21722 ACACGGGACACGGGAGATGAA | 32706 GCAGATGTCTGGGCTTGTTTC | 43690 |
| 10065 CCCAGTTAGTAACAAAGAGTGGTTTC | 21723 GTGTGACCTATTTTAGGAGGCACTGT | 32707 CAGAGTGTTCAGAACCCAGTTAGT | 43691 |
| 10066 GGCCACGCAGCTAGTAAACAGA | 21724 GACCCGGTCAAGTTGGTTTCA | 32708 ATGTCAGCCACCCGTCCAA | 43692 |
| 10067 CGTCACATGGCTTGGGCTTTC | 21725 TCTTGGGAACAGCCACTCTTAAAC | 32709 CACCTACAAATGGCCTCGTCACA | 43693 |
| 10068 AACGTGCTCACAGGGAGAAAA | 21726 GCTTCATATCCAAGGGGTCTAGATG | 32710 TCCCTTGCAACGTGCTCACA | 43694 |
| 10069 GCCAGCTCCATGGCCTTTGT | 21727 GCACACACTTTGTTTCCATAGCAGTTC | 32711 ACACACGGCCAGCTCCAT | 43695 |
| 10070 GGACTCAAAGACATTGATTTCCCTTCA | 21728 GGCCTCAGCACTGGAAGTCT | 32712 GGAACCAACTGATGGACTCAAAGACA | 43696 |
| 10071 CAAGGTCTATATCCCTTCCCCTTGAAC | 21729 ACTCTTGGTCGAGGAGATCACA | 32713 GCCTCCTATTGAGAGTCAAGGTCTA | 43697 |
| 10072 GGAGGGCTTTGGTGTTCTGAATC | 21730 CCTGCCCCTCGCACAAACA | 32714 CGGTCCTTCAGGAGGGCTTTG | 43698 |

| | | | |
|---|---|---|---|
| 10073 | GCCTTTACTTTCCTAGTGGGATGA | 21731 GGCAGAGGCTTGGTGGATAGAAG | 32715 CCTGCCCACATGCCTTTACTTTC | 43699 |
| 10074 | CAGGAAATGGGAGCTTAGAAGGTT | 21732 CCCTTCTTCCAAGCCAAGTGA | 32716 CCCGCTTCATAGACCAGGAAATG | 43700 |
| 10075 | ACCTAGTTACAGACTGGGCTCTAC | 21733 GCATGTTCCTCTCCCCTCTTCT | 32717 GCCAACGAACCGAACCTAAAC | 43701 |
| 10076 | AAGAGCAAGAATCATCCGTATCTGT | 21734 CCGTGAGAATGAAGGTGCTTTG | 32718 CCTTCCCAACCAAGAGCAAGA | 43702 |
| 10077 | CCTAGAGATAGGAGCATCTACTTCTCACAA | 21735 CCAGGCATTAACTTAGCGAGTGGAT | 32719 GGCTGTGCCTAGAGATAGGAGCAT | 43703 |
| 10078 | TCCCCTGGCATATGGTGGTTCA | 21736 CTGAGAGGGCCTTTAGGGAAAGAATG | 32720 GCAGGATTAACTGTCCCCTGGCATA | 43704 |
| 10079 | TTCACCACATTGTCCTGATTACTGT | 21737 GGGTAAAGTTGGAGGAACTATACTACTTG | 32721 GTGTCTGTCCCTTCACCACAT | 43705 |
| 10080 | GTGGGTTAGGATGGTAGGTGCTT | 21738 GGCAGGCTCTGTGGAAGTCAA | 32722 GGCCACTACACTGTGGGTTAGGAT | 43706 |
| 10081 | CCTTAAGCGCATGCCAGACA | 21739 CAGGCCTGATTCATTCTCCTGCAA | 32723 GGGCAGAGAATCACGACTCCTT | 43707 |
| 10082 | TTGTCAGTGGCCACGCCTTTC | 21740 GGGGAAAAGCCCTGGCCTTATAG | 32724 CTCCTGAAGCGCAAATTGTCAGT | 43708 |
| 10083 | CCTAAGGAAGGGTCTCTCCTTCT | 21741 AAACTGTGGGTCACGCTGAT | 32725 ACGGCTGCCAACCTAAGGAA | 43709 |
| 10084 | TGCCTCACTCCAGGGCTTTAC | 21742 GCTCCATGGGGAAGGACTCTTA | 32726 TTTGGGGTTCCTGCCTCACT | 43710 |
| 10085 | TCCTTGGCCTCAGCGACCTT | 21743 CCACGTGGAGGGGCATTCTA | 32727 CGGTTGCCCAATCTCTCCTT | 43711 |
| 10086 | GGAGACCATGGCTGCTGTTG | 21744 CCACCCAGAAGGGGTTATCCAT | 32728 ACTCCGATGCTGGGAGACCAT | 43712 |
| 10087 | CCCCAAGTCTTTTCTAGAGGGATGA | 21745 GGTACTGGATTCAGTTCAGTCTAACTTC | 32729 CTTTGGGAACCCCAAGTCTTTTC | 43713 |
| 10088 | CCCTTGTGGGAAGTGAGAAACA | 21746 TGCCACCGATGCCAGACAGA | 32730 TGGAGAGTGGCTCCCTTGT | 43714 |
| 10089 | AGGACATGACCTACCCCAGATTC | 21747 GCAGCCAGGTCACAGAGCATT | 32731 GGGTCGCTTGTGATAGGACAT | 43715 |
| 10090 | CCACTTGGCTCTCATTTCTCTCTTTC | 21748 GGCGGAAAGCTAAAGGCATGT | 32732 ACCTCTTCCACTTGGCTCTCA | 43716 |
| 10091 | CGTTTCCACACTCCCCATTATACTTACA | 21749 GCTCTTTGGTGAGCTGAACTCTTTT | 32733 GCACGTTTCCACACTCCCCATT | 43717 |
| 10092 | CAAAAGTAGTCCTGGTGCTGATTG | 21750 CTTAGCCTGTGACCTCAACT | 32734 CCAGCAGCAGACCACTTCAA | 43718 |
| 10093 | GGTGACTGTGTACTGGGCTTCT | 21751 CTGCTGACCCCTTCACCTGTAT | 32735 GGAATGGCGTTGGTGACTGT | 43719 |
| 10094 | GCCTTGAATGACGGCTCTTTCCTT | 21752 CTTTAGGGGCTGGCACTTTTCA | 32736 CCACGCTGTGTAAGCCTTGA | 43720 |
| 10095 | AGAAACCGTTATGGTGGATTGCTT | 21753 CAGCTGTTTTGTGCCGCAAAGAT | 32737 GAAAGCCACCAAGAAACCGTTATG | 43721 |
| 10096 | TGGTCCCACATTTCCAAGCAA | 21754 GCCCAGCCTTGTAAAGTGGTT | 32738 AGCCCGTTGGTCCCACATT | 43722 |
| 10097 | GAGCAGAGATGGCTGTAAGTCAAAC | 21755 GGTGGATGGGCTGGTATACAAATG | 32739 CCTCTTTCTGTAGTGAGAGCAGAGA | 43723 |
| 10098 | GGCATATCCCACCAGAAATGGGTTT | 21756 AGTATACTGCGGGGCCATTTC | 32740 CTGTGGCACTGGAAGGCATATC | 43724 |
| 10099 | CCGGGGCCTATCCTAGCATGT | 21757 AAAAGGTTCGCTCTGGATGGAT | 32741 TCCACGGGATGACGCAGATG | 43725 |
| 10100 | TTCCTCCAATCCAGTTGTCTCTTC | 21758 TTTGAAGCCACTGCAGTCTGA | 32742 ACCGGTCTGTCCTTCCTCCAATC | 43726 |
| 10101 | GGAGGAAGGTGTGGGCTACATA | 21759 CTCAACAAGCACTGCAGTTGTAA | 32743 GGATCTCACATCCAGGAGGAA | 43727 |
| 10102 | GGGTTTGTAGTCGGAGCTCTTG | 21760 CGGCTGTGTTTGCTGCTTGT | 32744 CCCATCAGCACTGGGGTTTGTA | 43728 |
| 10103 | GCTCCACCTAAGTGTAAATGGAGTTCA | 21761 AGCAGAAGATCCTTAATGGCAGAA | 32745 ACTCTTCCCTTGCTCCACCTAA | 43729 |
| 10104 | CTGTTGTGGTCTTATGGAAACTTGATCTGA | 21762 GCTCAGTGCATCCCTTCTACCTAGT | 32746 GGCTTTCTGTTGTGGTCTTATGGAAAC | 43730 |
| 10105 | TCCCCAAAACCCAGGTCCATGA | 21763 GCTCTGGGCTCTGCAGGATTT | 32747 AGGACCGGGCACCTCATTTGT | 43731 |
| 10106 | GAGGAAGGCCAGATTGAGGGTAAC | 21764 CCACTTGTCAAGAACACGCAAGGATT | 32748 ACTGTCTGAGGAAGGCCAGAT | 43732 |
| 10107 | AGACAGTTGCCAGAAGTCACAA | 21765 GGGGACCTATTGCTCACAGGAAGA | 32749 GGCTTCCTCGGAAAAAGACAGTTG | 43733 |
| 10108 | GCATCTGCCAACAGATGTGTGA | 21766 GCAAAGGAATCAAGTGGTGTCAAGT | 32750 ATCTTGCCTTCTGCCAGCAT | 43734 |
| 10109 | GGTGCTACCCACTTCCAAGGTT | 21767 TGGCCCGGTTCAGACTGT | 32751 TGTCCCAGCAAAGGGTGCTA | 43735 |
| 10110 | TCCACCTCCAATCCACCTCAA | 21768 CCGAAAAATGAAGTTACAGGGGAAA | 32752 TCATCCACCTATCCACCTCCAAT | 43736 |
| 10111 | ACAGGTGGCCTTTTAGAGAGTTTC | 21769 GCGAAAATTCCTTCTTGCCTTCCTTAG | 32753 GGGTTCATGCTACAGGTGGCCTTT | 43737 |
| 10112 | CCTCCCCTCTTACCCTGTTCTTCT | 21770 GCATTCCTTGGTGCAGGCTTTAAT | 32754 AGCCCAGCCCTCCCCTCTTA | 43738 |
| 10113 | TCCAAGTGGAGTGGGGAGAA | 21771 GGTTGCAGTGGAGGAGTTCA | 32755 CCCTCATGGCTCCATTCCAAGT | 43739 |
| 10114 | GACCCTACAGAAGAAAGTTGTGAACAT | 21772 CCACACACTCAACCCACCTAATG | 32756 TGTTTGCAATTCTGTGACCCTACA | 43740 |
| 10115 | GGGCAGAAATGCCCAATGTGAAG | 21773 CACCCTGCAGTCCAGTCAAA | 32757 GGAGGACATTACCAGGGCAGAA | 43741 |
| 10116 | CACTCAGCAGATGAGGAGATGTGT | 21774 GGTCTGCTGTCCAGATTCCTACT | 32758 GCAAACAACACACTCAGCAGAT | 43742 |
| 10117 | ACACAGGTGCCTTCCACTATG | 21775 CCATGCCCAGTCCATACTTGCTT | 32759 TGACGTGAGAGGGGTACACA | 43743 |
| 10118 | TTGGCGGCGTCCACTGAGA | 21776 CCTCTCTTCCGTCTCCTTTCCATA | 32760 ACTTCCTGTGGGCCAGTGTTG | 43744 |
| 10119 | CGGGCCTCCTTGTTATGCTAGA | 21777 CTGTGGTAGCTTGTTTCGTGCAA | 32761 AGACACCACGGGCCTCCTT | 43745 |
| 10120 | CGAGGCAGGACTTCCCTTTGTT | 21778 GCTGTTTCCCAGCAGTATGGAAATG | 32762 AGGGAACGAGGCAGGACTT | 43746 |
| 10121 | CTTCCTGGATGGCTGGACTTAAA | 21779 GGGCCAGAATCTAGTTTAAGGAGAGTTTAT | 32763 CTTTGGAATCTGTGCTTCCTGGAT | 43747 |
| 10122 | CAAGTCCAGCCTACTCAATTTACGTT | 21780 AAGGCAGCCAGGGCACTA | 32764 ACACTGCAAGTCCAGCCTACT | 43748 |
| 10123 | CCACCTTTCCTCTGTTTCAGCCTTA | 21781 GAGAACCGAGACTCACAACATTAAGA | 32765 GATTTCGTACCACCTTTCCTCTGT | 43749 |
| 10124 | CAGCACATGGGAGCTGGTTTG | 21782 CTGGCCACATTCACCAACCAAAG | 32766 TGCAGCTGGGTGTTCTCA | 43750 |
| 10125 | CAGCAGCCATGCTTTCATCATTC | 21783 AAGCCAGCTCAGACAGGATTG | 32767 CACCTCAGCAGCCATGCTT | 43751 |
| 10126 | ACCTCCCGCCATATTCCTCTCA | 21784 TCTCCACAGCTCACGCTGGTA | 32768 TCTCAGAACCTCCCGCCATA | 43752 |
| 10127 | GCAAGGGAAATGTGCTTTATTCA | 21785 CCAGCACAGCCCATACACTAG | 32769 GGCAGAGAAGCATGCAAGGGAAA | 43753 |
| 10128 | CCTATGGTTTCCGGTCTGTGCAT | 21786 AGGAAACAGGTGCCCCTACA | 32770 GCGTGCCCTTCCACCTATGGTTT | 43754 |
| 10129 | GTGCTTATCATCCAAACCCAGTCAAC | 21787 CAAAGTGAGGCACGCATACTCATA | 32771 CATTGGGACCAAGTGCTTATCATC | 43755 |
| 10130 | GGGAGTGGATGCAGCTCAACA | 21788 GGGGAGGCAGCATGGAAAA | 32772 CTGTTGAGATCAGAGGGAGTGGAT | 43756 |
| 10131 | CCCGTAATCGTGTCTAAGCACAAA | 21789 AGAGGCGTCCAGCGTTTC | 32773 AGGCCACCCGTAATCGTGTCT | 43757 |
| 10132 | GCAGTTAAGTGGTTTAAGTGGTGTTAG | 21790 GCACCAGCCCTTCCTCACTTT | 32774 GCACAATGGCAGAATGCAGTTA | 43758 |
| 10133 | GGCGGCTCTTTAAACAAACTCGTTCT | 21791 GCCCGCTTAATAGCTGAGGTCACA | 32775 AGCCAGATGGCGGCTCTTTA | 43759 |
| 10134 | CAGTTTGACTTGTGATCCATTCCACTTTG | 21792 CACAGCTTTTACCTCCTAAGAACTTG | 32776 TGTGCTGATACTCAGTTTGACTTGT | 43760 |
| 10135 | GGAGTCTTCAGTGGTTTTTAGGTTCAAG | 21793 CTCTGGACCTCGGTTTCTTTGTTTC | 32777 CCTCCTAAGAGGAGTCTTCAGTGGTTT | 43761 |
| 10136 | GAGAGGTAACTATCACTCTTGCCTTTT | 21794 GCCACCTGCCATAGCCACTTA | 32778 GCAAAGAGCCCTTTTGAGAGGTAAC | 43762 |
| 10137 | CCACCAAAACTTGGACTGCCATA | 21795 CCCTAAGAACCAGCACCTTCTATTG | 32779 GGCCTGTTCCACCAAAACTTG | 43763 |

| | | | |
|---|---|---|---|
| 10138 CGGGGCTTCTGTGGGTCATT | 21796 CTCAAAACCGAAATGTGACCCTTTTC | 32780 GGCATAAAGGCGGGGCTTCT | 43764 |
| 10139 GACGCTGATCTTTACGCCCAAT | 21797 CGGTACTCGGCCACACCAA | 32781 CTGCATGGAGACGCTGATCT | 43765 |
| 10140 GCAGTGGGATAAGTGGCTTCAA | 21798 CTCAGTGGCCTGATAATTACATTGAGT | 32782 GCAGAAATCTTGCAGTGGGATAAG | 43766 |
| 10141 GGGATCTGAACCTCTTTGGGATT | 21799 CAGCCACCAGCTCTGTATAGTAGTTA | 32783 TGAGAGGAGCAGTGGGATCTGA | 43767 |
| 10142 GAGGAACAGGCTCTCACTAGACATTG | 21800 GGCCAGGAAGTCCACAATCA | 32784 GCAGGAAGTCTCCATCTATGAGGAACA | 43768 |
| 10143 GCCCAGTTTCATGGTCCTAGAGAA | 21801 GCTTCCCATACTGGTCTTGATGGAT | 32785 TGAAGAGGATTCAGCCCAGTTTC | 43769 |
| 10144 CCGAGGACTATAGAAGAGTGAGGTTTC | 21802 ACGGAGCCGGAATCTCTGA | 32786 CTCAGAAGTTTTACCGAGGACTATAGAAG | 43770 |
| 10145 GAAGGGGAATGAACAAGAGGAGAGA | 21803 CCCCTAAAAATGGGTGCAGGAATC | 32787 GGCCAAGAAGGGGAATGAACA | 43771 |
| 10146 GCTCAGCTCACAGTCCCTTACAA | 21804 GACCCTTCCTAATCATGGAAGTCTTT | 32788 ACCCCACCTCCATTCTCCTTAG | 43772 |
| 10147 GCTTTTGGTTGAGTTACAGTGGGTTAC | 21805 GTCTTACAAAGTCGTTGATCCCACAA | 32789 TGGTGGCTTTTGGTTGAGTTACA | 43773 |
| 10148 GGACTGTGTCCACATCTGGAGCTT | 21806 TCGGGCCATGTCATCTGAGGAT | 32790 CGGTAGGTGAAGGGACTGTGT | 43774 |
| 10149 GCTCCATCAGCTTAATCTACCCTACT | 21807 GGACTGGCTGCCTAAACTGTCA | 32791 GGTGAGGCTTCTGCTCCAT | 43775 |
| 10150 CTGGGAGTGTCTCTCTCTTGAGT | 21808 GCAAAGTGAATCTCCACGGAAGT | 32792 CAAGCCCCTCTGGGAGTGT | 43776 |
| 10151 GAGAGGGGAGAAGCAGGAGATA | 21809 AGAGGGTTGCGTGGATGGTTAC | 32793 ATGCGGGAGAGGGGAGAAG | 43777 |
| 10152 CCAGCCCAAGATGTTCTGTGGAT | 21810 GCTCACCACTGCTCTTGTTCCTT | 32794 CTGAACTCTGCCAGCCCAAGAT | 43778 |
| 10153 CCAGCATTCCCCTCCTCTCAAAATC | 21811 GCCCCAGGAAATGTAGCCCTAT | 32795 TGCCACCACGCCAGCATT | 43779 |
| 10154 TGGAAAGACAAGCCCCAGACA | 21812 AGATGCTTTGTCGCATGTAGTTTG | 32796 CTGGGAGTGGGAGGAATGGAAA | 43780 |
| 10155 CCACATTCCAAAGCCAGGGAAAA | 21813 TCCATTACTGGCCTTGACCTTTG | 32797 TGCTATTGCCTTTGAACCACATTC | 43781 |
| 10156 CCACTTTTGAGTGGAAAATGCATCCAA | 21814 AGCCACCACGTTGCTGTGAT | 32798 CCCCTGTAGCCACTTTTGAGTGGAAAA | 43782 |
| 10157 CTGCTGATTGCCTGACAATTTGGATT | 21815 AGTGACAGCTCAATTCTGATGCTA | 32799 GGAGTTACTGCTGATTGCCTGACA | 43783 |
| 10158 ACCAGGGACTGAGCATTACCAA | 21816 CTGCAGGTCCATGTCTCTCTTC | 32800 ACACTGGGAACCAGGGACTGA | 43784 |
| 10159 GCATCTCAACACTCACCTCCATTG | 21817 GAACCCAACAGAACCCAAGACT | 32801 TGGGGCAGCATCTCAACACT | 43785 |
| 10160 GCGTGTGGAAAACTTGGCTCTCA | 21818 TGATGCTTGGATGAAGTGATGCTT | 32802 GCCTGGTTTTCTGCGTGTGGAA | 43786 |
| 10161 ACCTCAGCCTCCAGCACCTTA | 21819 ACACAGCAGCTCCCTCTTGT | 32803 AAGCGGCTGCAGGCTGGAA | 43787 |
| 10162 ACCAGCACAACCATGAAAACTCT | 21820 GCCAACTACCAGTCACTGTATCA | 32804 CTCTTCCTACCAGCACAACCAT | 43788 |
| 10163 GCTGCAATGGAAGCCACTTGA | 21821 AGGAGCTAAACATACAATGGTGACA | 32805 CCACCTCTGCTGCAATGGAA | 43789 |
| 10164 GGCGGGACACATCAAAGGAA | 21822 GGGTTTGGGCTGTTTTCACGTCTA | 32806 ACAGCAGAGGCGGGACACA | 43790 |
| 10165 GGGTCAGTGGGAGTCCTGTCT | 21823 GCAGAAGAAGCATGGGGTTTAAGT | 32807 TGATGTAGGAACCAAGGGTCAGT | 43791 |
| 10166 AGGCTTCTCCTTCCCAGTGA | 21824 CCCCAAGCCTATTGAGACATCTGTA | 32808 AGCGCTCTCCAGCCTTGAA | 43792 |
| 10167 GCCTGGGTTCTAGGTAACAAAGCAA | 21825 TCTGCCTGGGCTCCCGAAA | 32809 AGAGGGCCTGGGTTCTAGGTA | 43793 |
| 10168 GCCCCAGACTGATTTGGACTT | 21826 GAATGCATGTGGGATCCATTACTCA | 32810 AAGGCCAGTTAGCCCCAGACT | 43794 |
| 10169 GAGAAGCTGGGACCAGATCAGT | 21827 TGAGGAGGGAAGGAAGGAAACT | 32811 ACCAGTTGGCCATCCTAGAGAA | 43795 |
| 10170 GGAACTGTCCCTGCTGGCAAT | 21828 TGATGGAAGATGAACACTCCACTTG | 32812 CTCCATTTGCACTTTGGAACTGT | 43796 |
| 10171 AACCCATCACACTGTCTTAACTTGA | 21829 GTTTCATGTGGGTTTTTGGCAGTT | 32813 CAGGCACAATTAACCCATCACACT | 43797 |
| 10172 TCTTGCTTGCCAGCATCAGTAG | 21830 AGAGCTGCCTAAAGCTATCCTCTTA | 32814 GCTCGCCCTACACTCTTGCTT | 43798 |
| 10173 CACCTCGCTTCAAAATCCTCTTC | 21831 ACTTGGCTAGGGCCTTCAGA | 32815 TCTTCCAAACACCTCGCTTCAA | 43799 |
| 10174 GCAAATACCGACCCCACTATGTCA | 21832 GTGTTCCCATCACATTTTTCGGTATG | 32816 TGTAGTCCACAGGCTGCAAATAC | 43800 |
| 10175 CAGGGTGGAGTGAAGGGCTTTT | 21833 GGCTGCAAAATCTCATTCTCCTTGAA | 32817 AGACTGCCAGGGTGGAGTGA | 43801 |
| 10176 GCAGGTGTTTCTTTCCACCTGTAG | 21834 TGAAGGTGGGGAGGGTAAAGT | 32818 TGAGTTTCTTCTCTGCAGGTGTT | 43802 |
| 10177 GCTCACACAGGCTATGGGTCCTA | 21835 GGTGAGTTCCTCGAATGGTGCAT | 32819 TTTGCCCCAGAGGCTCACACA | 43803 |
| 10178 TCCACTTGTCTATGTGCCTCATTC | 21836 AGCAGGCCCTGAGTTCTTGT | 32820 CTTGCTCATCCTCCACTTGTCT | 43804 |
| 10179 TCTGCAGCCCAAAAATCTCATCT | 21837 CAGGCTCATGGGCAGAAAGT | 32821 CTGAAAAGTCTGCAGCCCAAAA | 43805 |
| 10180 CCCAGCGATTGTGTATCTAGGTGTT | 21838 TGCCCGGCCTGTGAACAT | 32822 CCTCTTAATATGACCCAGCGATTGTGT | 43806 |
| 10181 CCTCCCTAGAAGGAACTGTAGTTAATCA | 21839 ATGCACGGAATACCTCTGGAAAT | 32823 GGTTTCTCCTCCCTAGAAGGAACTGT | 43807 |
| 10182 GCCAGCAGCTGAAGGTAAACCAA | 21840 CGTGGCCCATGAAGGGTGAA | 32824 CTCCATTGCCAGCAGCTGAA | 43808 |
| 10183 TCATGCGTGCTGGGCAAA | 21841 TCCTGCCACCCCTTCTCCAT | 32825 TCCTTGGGACCTGGGTCAT | 43809 |
| 10184 GCTTGGTTTACGCCCAGGAA | 21842 AGACTCCACCTTGCCTCTGATCT | 32826 TCCTCCATGGTTAGCTTGGTTTAC | 43810 |
| 10185 GGCCACAGTCTCTGCTGTTGAA | 21843 AGAACAGCCTGATTGCAAAGATGA | 32827 AGCCATGGCCCACAGTCTCT | 43811 |
| 10186 CTCAGATATGGGTATGTGACCATCAA | 21844 AAATTGGTGGGATACCATGTCCAA | 32828 ACACAAACAACAGTCCTTCTCAGAT | 43812 |
| 10187 CCCTCCATCCACTCGCTACT | 21845 TCCATGCCCACCTAACATCTCA | 32829 CAGGGTTCCAGCCCTCCAT | 43813 |
| 10188 CCTTATAGCTGCTTGCTAACCAAAAGT | 21846 GGATGGGCAAGTGGTTGTATCT | 32830 GGTCCACTTCCTTATAGCTGCTT | 43814 |
| 10189 GCTATCCTCCTCACCCAGTCA | 21847 TGAGTGTCCCTGACCTCAAGT | 32831 CCAAGTGTGCAAAAAGAAAGGCTAT | 43815 |
| 10190 GGAGCAGTCAGGTGAGAGGTAAGA | 21848 AGGCCAAGTCCACACGATCT | 32832 GCACTATGAGAAGGGGAGCAGTCA | 43816 |
| 10191 GCCCTGGGGAAAGAAAAGTCAGA | 21849 GGTGGGGAGCACTGTTCTCAAG | 32833 AGGGAATCTAGCCCTGGGGAAA | 43817 |
| 10192 CAGCAAGTCATGGCAGGGAAA | 21850 TGCAGAGCAGGACAGGGATT | 32834 CCGGGGATTAAGCAACAGCAAGT | 43818 |
| 10193 GTCAGGATCGCTATTCACGTCATC | 21851 CGGCTCTTCGTGGCTTCA | 32835 CCCTGATAAAACAACTGTCAGGAT | 43819 |
| 10194 GTGAGTGTGGCACCATGGATGTA | 21852 GCACTCCTGAAAAGTGGACCCAAAT | 32836 TACCCCGTAGCGTGAGTGT | 43820 |
| 10195 CCAGCCATGAACCTTCCTTCTGT | 21853 GACCCACAAAGCTGAAGATGTTTAC | 32837 ACCATGCCCAGCCATGAAC | 43821 |
| 10196 CTCTGTATGCCAGCTCCCTTTC | 21854 AGGGATTCAGGCTGTTTCCATTC | 32838 CCTCTCTTGCCACATGATCTCTGTATG | 43822 |
| 10197 GGTGGAAGGAACATAGAGTTGCAT | 21855 CAGTCTTTACTTAGTGGGCCCAAATC | 32839 GGGTATGGGGATAATGGTGGAAGGAACA | 43823 |
| 10198 GCATCCATTGCTATCTCAGCATCAGT | 21856 GGAAATCAGGAAGGTGATGTGTCA | 32840 CATGGTCATGCAAAGCATCCAT | 43824 |
| 10199 GCTATGCCACTTCCTCTGAGACT | 21857 ACAGCAGGGACAAAAAGGATCA | 32841 CTCTCCTTTGGTTTTCGATCTGCTATG | 43825 |
| 10200 GCACAGCACTGAGGACAGCTT | 21858 TTTCCCAACGGCCTCTCACA | 32842 CGTATTCTGTAGCACAGCACTGA | 43826 |
| 10201 AGAAACACCAAAGGGCAGACA | 21859 TGGTCCTCTGGCTAGAAACAGT | 32843 AGCTGGAAACCTAGAAACACCAA | 43827 |
| 10202 GCACTGTGAGCACAGGTTCTTG | 21860 GCTGTGCAGTGAGATACAGGTAA | 32844 TGCCACCCAGCACTGTGA | 43828 |

| | | | | | | |
|---|---|---|---|---|---|---|
| 10203 | GACCCTTCAATCTGGAGCTGAGTT | 21861 | CACAGTCCCAGGCTGACTTCATT | 32845 | CCTGCTGGAGACCCTTCAATCT | 43829 |
| 10204 | GCTGGGCCCCATAATTGAAGGTA | 21862 | CCAAGCCCTGCTGGTTCA | 32846 | AGGCTGTGCTGGGCCCCATA | 43830 |
| 10205 | GACCTTCTGGGAACCAGTTTTCT | 21863 | GGAGGAGAAGACTCATCCAGTCAA | 32847 | CAGCTGGACATACCAAGACCTTCT | 43831 |
| 10206 | CACTGGAGGATCACAAACTGTATTTTC | 21864 | CCATTAAGTCCAAGATAGAGGAGCCATT | 32848 | GTCTGGTATTACACTGGAGGATCACA | 43832 |
| 10207 | CGGAAAACTTGGAAGGAAGGAGAAG | 21865 | ACAACTCAGCGGCTCGTAAG | 32849 | ACTAGCAAGTCGGAAAACTTGGAA | 43833 |
| 10208 | GAACTCCCGGCTTTGAACAATTC | 21866 | CTCACGCTTGTGAAACCAACAT | 32850 | ACCCTGAACTCCCGGCTTT | 43834 |
| 10209 | GCGTCTCAGGGCGCATTTGTAT | 21867 | ACAGCTCCAGGGGCACTAAACT | 32851 | TGACATTGCACAGCGTCTCA | 43835 |
| 10210 | GCCACTGTGTCGAGTCCTTCAA | 21868 | GGCCCACCTCCTCAGGATTAGA | 32852 | AAGGCTGGGCCACTGTGT | 43836 |
| 10211 | TGAGGAAGAGCGAGCTTTCTTAG | 21869 | CTGGAGCTAGAGGAAAGGGTGAA | 32853 | GTGCATGCATGTGGTGAGGAA | 43837 |
| 10212 | CCTAGAGGCCACTGTTACTCTGAA | 21870 | GCAGGCACCACAAGCTTTCTTC | 32854 | CAGACGTTGGGCATCACCTAGA | 43838 |
| 10213 | AGCTGTCCAAATCCAGCTCAC | 21871 | GCAACCTTGGTGAGTGAGTCT | 32855 | GGTTGGCACACCTGCATTGA | 43839 |
| 10214 | GGAAAGGCTTATCGGGAGGTTGT | 21872 | ACCATGTGGGGCTCAGAATG | 32856 | GCCCTCCGTGGAAAGGCTTA | 43840 |
| 10215 | CAGGCACCAAAGATGTAACTACTAGA | 21873 | CCGCTAGAAAATTTCGCAGGATTAG | 32857 | GAGATCCTCAGGCACCAAAGATGT | 43841 |
| 10216 | CGTCCTCCTAACCTGGTGGTCTT | 21874 | CCCTTTCCCAAAACTAAACCACCTTTG | 32858 | AGGTGCCTCTCGTCCTCCTAAC | 43842 |
| 10217 | GCTGAGTTCTGGCAAATGGGAAA | 21875 | TCAAGAGGGCAGTCCAGGAA | 32859 | CCTGACCTTGGTGCTGAGTTCT | 43843 |
| 10218 | GCCATCTTCACAGAGTTCATGGTCTA | 21876 | ACGGACCCATGTGACTGTCT | 32860 | CCCCTGCTATGTGCCATCTTC | 43844 |
| 10219 | GCAAAGGCCCTGCTAATTTTCTCTGT | 21877 | GCTCCCTTCAGAAGCATGTACACTAA | 32861 | CTTGTGCAAAGGCCCTGCTA | 43845 |
| 10220 | CCGGAGTGAGAAGACAAGGAGTCT | 21878 | ATTAGGCCCAAGCTGGCCAGAAG | 32862 | ATGCCACCGGAGTGAGAAGA | 43846 |
| 10221 | GCTAAGAAGAAAGGCTCACTGAAAGT | 21879 | GTCAATGCCTGCAACAATGACAA | 32863 | CCCAAACATGGGTGGGCTAA | 43847 |
| 10222 | CCTTCAAACCCGGGGATGCTA | 21880 | TGGGTCTCAAAGTGGTTGGATTC | 32864 | ACCTGGCACACCCCTTCAAA | 43848 |
| 10223 | CAGGGCTTCTCTGCTTTTCCAA | 21881 | GAGAACTTCTAGAGAAACAGGGTAGTT | 32865 | AGTCGTTAAATCTTCAGGGCTTCT | 43849 |
| 10224 | CCCTCCACTACTCCCTGGATTT | 21882 | GAGTCCCAGGACTACAGATCTAGTGAAA | 32866 | CTCTTAACCACTACCCTCCACTACT | 43850 |
| 10225 | CAAAACCGTTCACCCACACATTG | 21883 | CCAGCTTAACTCCCAGCTGTCAA | 32867 | GGCAGCAGAGGACCATTTACAA | 43851 |
| 10226 | AAGCCTTCAGAACCTGAGACTTC | 21884 | AGCTCCCCTCTGGGTGAGTATT | 32868 | GCAGTGTGTAAAAAGCCTTCAGAAC | 43852 |
| 10227 | GGAGCCAGTTGTCAGTTGCGTTA | 21885 | CCCCACAATGGCAGGATCTACAAC | 32869 | CAGAGGGTGGGAGCCAGTT | 43853 |
| 10228 | TCGTAGCCTCACTCCTGCAA | 21886 | TGGTACCACAAAGTCAGAAACGTA | 32870 | CAGATGGCCACTAGAACTCTTCGTA | 43854 |
| 10229 | CCAACACCACAGTTACCAGGAA | 21887 | GGTCCCTCAGTGTTGCAGCTAT | 32871 | GGCCCTGGTGTCATTTTCCAA | 43855 |
| 10230 | GGCAGTAACCATAGTCCATGCAA | 21888 | GCTCTGTACCCACACTAAGGAAAG | 32872 | GGGAAGTAGGAGTGGCAGTAAC | 43856 |
| 10231 | GCTGTGGTTGGCTGGTAACT | 21889 | GCCAGACAAGTAGCCCACAGA | 32873 | CTCATTCCATTCTTGCTGTGGTT | 43857 |
| 10232 | CCTCTTCCACCCCTTTACTTTCAGT | 21890 | GCCTTCAAGAGACTCATCTAACACA | 32874 | TGATGCCTCTTCCACCCCTTT | 43858 |
| 10233 | GGAAGTCCCAGAATGAGGTTTCA | 21891 | GCTGCCAAAGTGAGCACAATTCA | 32875 | TGGGCAGGAAGTCCCAGAAT | 43859 |
| 10234 | CTGGGAAGGGTTACAGTGAGTCAT | 21892 | TTGCCAGTGCTTCCAACTCA | 32876 | GCATCCTCTGGGAAGGGTTACA | 43860 |
| 10235 | AGCTTGGAGCTCTAGGGTCTT | 21893 | CCCATCACTCCGCAAGAGACA | 32877 | TCTGGCACCCTGAGAGCTT | 43861 |
| 10236 | CCACCAAGACGGGTCTCTCTGTAA | 21894 | TGTCTGCCGGAGGGCTTATAGT | 32878 | CCTCTGCTTTTCTAGTTTCCACCAA | 43862 |
| 10237 | GCTGTTCACTCCTCCTGCTCTA | 21895 | GGACAGGGCACTATGTGGAAAG | 32879 | CCTGGTCACATTAGGCTGTTCACT | 43863 |
| 10238 | GTCACTTAGAAGCACCCATCTGT | 21896 | CAGATGGAATCTGTCTTAGATGTGGATGT | 32880 | GCTTGGCCTGCAGTCACTTAGA | 43864 |
| 10239 | GGAGCAGGGCTAACTCACATGAAG | 21897 | GAGAGATGCCAAGAGTCCATACATTG | 32881 | TCCTTGTGGAGCAGGGCTAACT | 43865 |
| 10240 | CGTGCTGTTAGGAGCAAGAGA | 21898 | CTCACGGGGCTCCTTTTTGA | 32882 | AGGAATAGGGGCCGTGCTGTTA | 43866 |
| 10241 | CCTGAATCTGTTGTGGATCAAGTGT | 21899 | GTGGGATGGAAGGTCCAGAAAC | 32883 | CCCCTGGTCTGCAATCCTGAATC | 43867 |
| 10242 | TGGGATGAGGCAGAGGCTTGAA | 21900 | TGCACCTAGGCGGCTGTGA | 32884 | TGCAGAGAGGCTTGGGATGA | 43868 |
| 10243 | GGGCACTACACTCCAAGATGCAA | 21901 | GGGACACAATACCATGCCTTTGTTA | 32885 | GCAAGGATGGGGCACTACACT | 43869 |
| 10244 | CAAACGTGGTAGACCCGACACT | 21902 | CGTGCAGGACTTGTCGTTCT | 32886 | GCAACATCACAGACAAACGTGGTA | 43870 |
| 10245 | ACTTCTGGGCTTAAAATGGAGTTCTAC | 21903 | GCCTCTTCTGTATTGCTCGTTTG | 32887 | GCAGAAACCAACTTCTGGGCTTA | 43871 |
| 10246 | CGGTGGCTATGCGTGTAAAGA | 21904 | GACTAGAAGACCACTTTTTCCCAAATG | 32888 | TCCTCCCCATAACGGTGGCTAT | 43872 |
| 10247 | GCTGAACCAATCAATCTGAGAGTCTT | 21905 | CTGAGGTTCACACTGAAAGGAACAA | 32889 | CCTGTCTTGGGAGCTGAACCAA | 43873 |
| 10248 | GGCTGGGATCAAGTTCTGTCTCTGT | 21906 | GACAAGTTACGAAGTCACTGAATCCTCTT | 32890 | CTGTGTGGCTGGGATCAAGTTC | 43874 |
| 10249 | TGCTCTTGTTTCATTTGTGGCTATG | 21907 | GTGCCATGTTTCTGCCACTT | 32891 | GCTTGGCCTTGCTCTTGTTTCA | 43875 |
| 10250 | CCAGCCACAGTGATCTGCTT | 21908 | AAAGTCCTCAGAGACCAAGAGTTG | 32892 | GCTTCAGATCCAGCCACAGT | 43876 |
| 10251 | GGTTCTTCATTTTGGAGAGCACGATTG | 21909 | CCTCTCCCTTTTCCTCTTGTCTTTTA | 32893 | CGAGGGATCATAGGTTCTTCATTTTG | 43877 |
| 10252 | GGCTGAGTCCATTTTTATAACCGTGTGT | 21910 | GGCTATGTATGCCCTTGTGTGTCATATTC | 32894 | GGCACCTGGCTGAGTCCATTT | 43878 |
| 10253 | GGGGCTGTCTCAGCTCTTTGT | 21911 | CAGGGGCCTGATAGTGAACTAAATC | 32895 | GAGAGAGAAGGGGCTGTCTCA | 43879 |
| 10254 | CCCACTGGAAGAGTGACTTAGCTT | 21912 | TGTAAGCCTAGTTCCTTCCTCATTC | 32896 | TCCACCAACTCACCCACTGGAA | 43880 |
| 10255 | CTTGCCCAAACCCACTCCTT | 21913 | CTCCTTCTTTCTCCAGGAACCATTAG | 32897 | GTGGGAAGTAAGAATCTTGCCCAAAC | 43881 |
| 10256 | CCCCAGTGCCTCTTGTCTCTGATA | 21914 | GGGTCCTACAGGGCACACACT | 32898 | TTTCTGGCCCCAGTGCCTCTT | 43882 |
| 10257 | GTGAAAAGGGGAAGCGAAGATG | 21915 | TGGGTTTCTGTTGCAGTTTGACT | 32899 | TCCTTGGGATCAACACATGTGAAA | 43883 |
| 10258 | TCTCTCTTCCCCTCTCAACTGATT | 21916 | CTCCCAGCTTCATGGGAGTTTC | 32900 | ACCAGGACTGGGTTCTCTCTTC | 43884 |
| 10259 | CCTGCCTTACTACCCCAATCATC | 21917 | AGCAGACTCTTAAAATCCGATCTGT | 32901 | CAAGTACCATCCCTGCCTTACTAC | 43885 |
| 10260 | AGGCTCAGAGGCAAGACAGA | 21918 | TGCAGCCATAGGTAAATGGCTTT | 32902 | AGCAGGGACAAAGGCTCAGA | 43886 |
| 10261 | CCCAGGACCACAAGCACACTTT | 21919 | GACAGCCTTTCCAGTGCTATTCA | 32903 | CCTGACACCCAGGACCACA | 43887 |
| 10262 | CACGGAGGTGAGCATGATGCAA | 21920 | TCTTTCCCGCCTGAGTGTCA | 32904 | GGTTGATGGCTGTGGGGAACA | 43888 |
| 10263 | CTGGGGTCTGTCTCTGGATGATCT | 21921 | TGCTGCCAGGTAAGATGCAA | 32905 | TAGGTAGCCTGGGGTCTGTCTCT | 43889 |
| 10264 | GCCTCTCCACCTTTTTAGAATAAGGGTATC | 21922 | GGTGACTCAGGAACAGGAGAACT | 32906 | GGGATTACAGCCTCTCCACCTT | 43890 |
| 10265 | CTCCTGCAATATCCCTTATTCAAGAGT | 21923 | GCTCCACCACCATCAACACT | 32907 | CAGGGCAGTTAGACTCCTGCAAT | 43891 |
| 10266 | CCAAGACACATTTGCCTCTCTACT | 21924 | CTGCAGTTGCTTCTCCTCACA | 32908 | AGTCCAGACCTCTTTCCAAGACA | 43892 |
| 10267 | CTTTCACCGTTAACCTGCGTTT | 21925 | GTTCCCAGTGTACTTGGATCACAT | 32909 | CCAGTCTCTTTCCTTTCACCGTTA | 43893 |

| | | | |
|---|---|---|---|
| 10268 GCCCTGTATTACTCCACAGTGTATG | 21926 CTTGAGTGTGACTGAGGTAAATGAAAG | 32910 CCACTGTTCAAGTGAGCCCTGTA | 43894 |
| 10269 GCCTGGATGGTTCTAGGGCTTTC | 21927 CCCCTGTGGACACTCGACTACA | 32911 TGCACAGCCTGGATGGTTCT | 43895 |
| 10270 CTTGCACACAGAGGGTGGTCATT | 21928 CCTCATTTCCACCATCCTGTCCTT | 32912 GCCATGCCTTGCACACAGA | 43896 |
| 10271 GACACTGACTCTCTTCTGTCTCAGATT | 21929 AGAGTCTGGCCAAATTCCAGTAAA | 32913 GGGACCTTGACACTGACTCTCTTC | 43897 |
| 10272 CCCTCTTCTCCTTCCACCAGTT | 21930 GGCAGCAATGCCTGCTACAT | 32914 ACATCCGCCCCTCTTCTCCTT | 43898 |
| 10273 GAGGTGGCAATAGCGTTGTGTT | 21931 TGCCAGGGTCAATGGAGGAA | 32915 TGGTGGAAAGAGGTGGCAATAG | 43899 |
| 10274 GCACAACTTCCCCATCTTGCTT | 21932 CAGCCAAACAGAATACTCCAGCTT | 32916 AGCTAGTGCCCTCTTGCACAAC | 43900 |
| 10275 GCCACCCTGCATATTGCCTTCA | 21933 TCAACCTCCCCTGCCATGGTTA | 32917 TCCCCATGCCACCCTGCATA | 43901 |
| 10276 GTTCCCCACATACCTTGCTTGT | 21934 AGCCGGATGGTCCAGAGATGA | 32918 CCACTGGATAGAAGAAGTTCCCCACATA | 43902 |
| 10277 GCGGATGGATGTCTAACCCAGTT | 21935 TTTGCCAGAAGTTCAGCAGTCT | 32919 GCTGGTTTGCGGATGGATGTCT | 43903 |
| 10278 AGCGTTTGGCCTTGGGTAAG | 21936 GGGGACAAGCAAGGCATTAGTGT | 32920 ATGACCAGGTCGGAGCGTTT | 43904 |
| 10279 CCGGAATATCAGCCCCATATTTATCTACA | 21937 TCCCAAATGAGACAGAGTTGAAG | 32921 AGTCCGGAATATCAGCCCCATA | 43905 |
| 10280 CTGTGTGGTTGCATTCCCTTGA | 21938 GACGAATGTCCTCAGCACTACA | 32922 GCGTCTGACCCTGTGTGGTT | 43906 |
| 10281 CTGGCTGTCTACTGCAAGCAA | 21939 TGTTTAACACGAGACAGAACCCAAA | 32923 TCCTCCCTTCTGGCTGTCTAC | 43907 |
| 10282 GGGACACAGAACAATTCAGGACTCT | 21940 CCAGCTCACGTGTGTGGCTTA | 32924 ACCCTGACTTTGGAGGGACACA | 43908 |
| 10283 CCTGGGGCAAGTTTTCAAGCCTATC | 21941 CCTCAACAGCCCTGAGTCTGTTTC | 32925 GGTAGCCTGGGGCAAGTTTT | 43909 |
| 10284 GTCACCCAGTTCCTACTTGACAGT | 21942 CGAAGAGGGGATCCAGCTCTAAT | 32926 GAATCTAACAAGTCACCCAGTTCCTA | 43910 |
| 10285 GTCACAAACCCCTACAGTTACTCCTT | 21943 CCATGCCAGCAGAACTTTCACT | 32927 CCCGTAGTCACAAACCCCTACA | 43911 |
| 10286 AGTGCTTGATTCCACGTATCTGTT | 21944 GTAGGATAAATTAAGGCAAGCGTCTTC | 32928 GCCTGGCTTAAAATAAGTGCTTGA | 43912 |
| 10287 GTTAGGTGCCATTAGCAGCAGTA | 21945 CATTTCCCATCATCCTGGTTCTTTTC | 32929 AGCAACCATGTTAGGTGCCATT | 43913 |
| 10288 GCCCCTGGTTAGTTACAGGAAGAAG | 21946 GGCTTCAGGCACCAGAATACACA | 32930 TTTTGTGAGCCCCTGGTTAGTT | 43914 |
| 10289 CCTACCAGATAAGCCTTGAGCAAT | 21947 GGCTGAGGGCCTTCAATCAACA | 32931 GGGCACCTTTACTCATCCTACCAGATA | 43915 |
| 10290 GCAGACCTTGTCTCGCTTAGTTC | 21948 GTGCAGTGGCGATGGTAGT | 32932 TAGCCACCCTGCAGACCTTGT | 43916 |
| 10291 GCCAGAAGTGCCTATTCCTAAACCAATC | 21949 GTTCACACCAGGCAGTGATCT | 32933 ACTGGCCAGAAGTGCCTATTC | 43917 |
| 10292 GCCTCCAGTTGGTTCAGAAAATGA | 21950 GCTCTTGGACAGCACAGGTCTAT | 32934 CGTTTTCTTGCCTCCAGTTGGTT | 43918 |
| 10293 CGCTACCATGTCCAGCTAGGTT | 21951 GCCTAGGCAGCATAGTGAGATTC | 32935 CTACAGGCACACGCTACCAT | 43919 |
| 10294 ACAGACACCAGCCAGCTTCA | 21952 CACAGAAAACTAAGTCGCCCAGAGT | 32936 GCCCAACGCTCAGACAGACA | 43920 |
| 10295 GTGGACTCTGGTCTACATGGGAAA | 21953 ACCTGGACTCCTGCTTGCTT | 32937 GAGGGTTAGTGGACTCTGGTCTA | 43921 |
| 10296 GCAGTTGTCTTCACACTCCGTCTAT | 21954 GGAGGTTATTGCTTCTGCTTCT | 32938 ACAACAGAGTTAGCAGTTCTTCACA | 43922 |
| 10297 TGCCAAGAACCTTAGGGACATC | 21955 AGCAAGGTTCAGTCTGGAAATGA | 32939 CCCCAGATGCCAAGAACCTT | 43923 |
| 10298 GGCCTCAACCCATAAAAACGATCA | 21956 GTTCAGACCCACGAAAAGTACTTGAA | 32940 AAGGCACGTATGGCCTCAAC | 43924 |
| 10299 CTCATTCCTAACCCAGGACTGAAC | 21957 CAGCAACTAAGGCTTTGCCATT | 32941 CAACCAGAAAGCACTCATTCCTAAC | 43925 |
| 10300 GCAGGCACCTAGTATCAAGCCAAAG | 21958 CCCTCTGGGTCATCCCTTCATTTC | 32942 GCACTTGGCAGGCACCTAGTAT | 43926 |
| 10301 CCATATGACTGGCAGGTCCTCAA | 21959 CCTCCCCTCCTCAGCATCATTG | 32943 GGTGAAGAGCCAATCAGGCATA | 43927 |
| 10302 CCACAACCAGCTCTTGTAGTGAAAGTA | 21960 CTGGGAGCAGAACCCAGCATTT | 32944 ATCCCCAAAGTGGCCACAAC | 43928 |
| 10303 GCAAGCCAGGGAAGAATCCAGTTG | 21961 GAGGAGTCAGGTCAGGAGTAGAAAC | 32945 GGCGCACTTCATGCTGCAA | 43929 |
| 10304 GGGTGATGCCAACTTCCAATCTTAG | 21962 GCTCGAGAGTTGGTTGCAGTTG | 32946 CCATCGTGACTATCTCATGGGTGATG | 43930 |
| 10305 GCTAATGTTGGTCCTCCAGTTCT | 21963 TCAGACAGGCCATGGGATCTA | 32947 GGGAGGTCCTGTTGCTAATGTTG | 43931 |
| 10306 GTCCTCCTTTTGAAGCACACTTCTTTG | 21964 GCAATGGAAGGGTAGTGGGTACT | 32948 GGACTATGTTCTGTGTCCTCCTTTTGAA | 43932 |
| 10307 CTGGGAGGCTGGGAAATTTGATAGT | 21965 CTGACGCTGGATGGCCAAAT | 32949 TCCACTGGGAGGCTGGGAAA | 43933 |
| 10308 GACGGGGCTTAAAGCTGTTTG | 21966 GCCACTGGACTTACTTCGCAAAT | 32950 CCAGTTTGGTGACGGGGCTTA | 43934 |
| 10309 TTCCCAGCTAGGGGAAGCTAAC | 21967 CTGAACTGGCTTCACAAAAACACA | 32951 TGGCTCCAGTCTTCCCAGCTA | 43935 |
| 10310 GCTGCTGTTGCCCGTTCTTC | 21968 GCCGCAGCAGCTTCTCATTC | 32952 ACTCGAGCCCGCTGCTGTT | 43936 |
| 10311 GTCTGTTTGCTGATTCCTCCTCCAT | 21969 GTTCTAGCATTGGAGGAAATCCAAAGT | 32953 CCCTTGTTGTCCTTCCTCGTCTGT | 43937 |
| 10312 AGCCACCCAAAGGGAAATGTTCT | 21970 ACTTGAGTGTTTGGGTCAACAAGA | 32954 GCCAACTCTCAGCCACCAAA | 43938 |
| 10313 CCGGTATAACATTGCCTCCCTAAG | 21971 AGAGCCCTGCTCCTAGTCTCT | 32955 GGGCGCAAGTACCGGTATAACA | 43939 |
| 10314 AAGAAGGCAGGACTGAATGTCAA | 21972 GCCATCTGGAGGCAGCTGAAAT | 32956 AGGCAGTCTCTCAGTGTAAAGAAG | 43940 |
| 10315 ACAACATGGCTGTCTTCCTGAAA | 21973 CCCCAATACCTTTAAAGCTGGAGCAA | 32957 CCCTTGGTTCCCATACTGTAAACAACA | 43941 |
| 10316 TGCTGAGAGTTTTCGCTGTCA | 21974 AGACTAGCTGAGGGAAAGTGTGA | 32958 CCCCTGTTGTGCTGAGAGTTT | 43942 |
| 10317 TGTCCCATCTCTGCCAGTGAAC | 21975 CCTGGATTGCCCACAATTCCAT | 32959 GAACTGATAAACAGTGTCCCATCTCT | 43943 |
| 10318 AGAGAAAAGCAGGCCTGGAATG | 21976 GGCCTCGTAAAAGGCAGGAT | 32960 TCCCACGGAGAGTGAAGAGAAA | 43944 |
| 10319 AGGCGTCACTTTCTGCTGTT | 21977 TGACGACTGGATTGTCCAACAAA | 32961 TGGCTGCAGGCGTCACTT | 43945 |
| 10320 CCAATGCTGGGACCGGATCT | 21978 TGAGTCCAGGTGACTGTAGGAA | 32962 ACTGCCTCGAATCAGCCAATG | 43946 |
| 10321 TCCCTCCATTCCCATGGCTTCA | 21979 AGACCCAGGGCACTTCTGAT | 32963 TCCTCACTCCATTCCCTCCATT | 43947 |
| 10322 CTGCCTTAGAAGAAATCTCTGGGAAA | 21980 CTCATCTCTGGGTCTCTCCTTTAGATG | 32964 TCCCTGCTGGTTCTGCCTTAGA | 43948 |
| 10323 ACAGCACATAGTCTCAGGGTTCA | 21981 AGGTGTCCTCCTCCCATTCTTAG | 32965 GTCACGGGTACAGCACATAGTCT | 43949 |
| 10324 GGGCCCTGAAATATGGAGCCTTT | 21982 TGAGGTTGCAATTCACCCAGAA | 32966 CACTGTGTTGGGCCCTGAAATA | 43950 |
| 10325 GCCATAGGCATCACCAGCCATCT | 21983 GGTGTGCATCTCTGGGCATATC | 32967 AGGCTGGACCCATAGGCATCA | 43951 |
| 10326 GCTCTCAAACTCTGGGGACCTT | 21984 GTGCCCTAATGATCAGTCTTCAGT | 32968 AGCCTAGGGCTCTCAAACTCT | 43952 |
| 10327 CCCACGAGATGCATTCCCTCTA | 21985 AGCCACAGGCGAGCACATAG | 32969 GGCTTTAACATGCCCACGAGAT | 43953 |
| 10328 GGATTGAGGCAAAAGCCAACAGA | 21986 CCCCAAACCCTTCGGTTTTCA | 32970 CAAGGCAGGGATTGAGGCAAA | 43954 |
| 10329 GGGGTGGGCAAAGCAGTTAGA | 21987 AGGATAATGCTGGCAAAGACACA | 32971 AAAACGGCGGGGTGGGCAAA | 43955 |
| 10330 TGCAGTGAAAATGCAGCAGATG | 21988 CTCTGTAACTTTCTGGCATTGGAGTCT | 32972 CCTCAGGAGACAGATGCAGTGA | 43956 |
| 10331 CACATGCTGCCATTTATACCTTGTTC | 21989 TGCAGCTGGGCTTAGCAACT | 32973 GCTTTAAAGATCACATGCTGCCATT | 43957 |
| 10332 TCCACGTAGTCTGTCTCCATGAT | 21990 ACCCCTACCCCAGGAGTTTTG | 32974 GGAGTCAAAGCTTCCACGTAGT | 43958 |

| | | | |
|---|---|---|---|
| 10333 CAGCAGCCCAACCTAAGACA | 21991 CGGTGCCCAAGGGCATGAT | 32975 AGCCTGTGGCGCTTTGTT | 43959 |
| 10334 TGCAGACACTCAAACTCATTTGTTG | 21992 GTTCTGTGTTAGAAGCCCTATTCATTC | 32976 CCGGCATGCAGACACTCAA | 43960 |
| 10335 ATACCACCTGTGTGCTGTTACAT | 21993 GTGGCTTTTTGGTAATTGTGCTGAAC | 32977 TCGGATAGACTTATACCACCTGTGT | 43961 |
| 10336 TCCTTGGCCACACATGTCAAG | 21994 GCTCTGCCGAGGCTGGTAAAAA | 32978 GAGGCACGGTAGACATTTCCTT | 43962 |
| 10337 GCAAGCCTCAGTGTGAGTTTTCAA | 21995 CCCAAAATGCCCGTCTGTGAAG | 32979 TGTTTCTGCAAGCCTCAGTGT | 43963 |
| 10338 GACAGTAGTCCCTTTATTGCCTATACCTA | 21996 TGACGAAAGGCCGTGTAGTAG | 32980 CCCTACAGACAGTAGTCCCTTTATTG | 43964 |
| 10339 ACACTTGCCAGTGGTCCCTAAG | 21997 ACCTGAAAGAGGGAAGTCCAAAG | 32981 TGGCACCTATGACTGACACTTG | 43965 |
| 10340 AGTGGTTTGCTTTAGCTGAACTGA | 21998 GGAAACTAACTCTGGGATCAGACAAACT | 32982 CGGAGAGATGAAGTGGTTTGCTT | 43966 |
| 10341 GACTATAACCCGCAGACGAACTCA | 21999 ACTTAGTTCAGGGGCTACACAAAAA | 32983 AGCTGGGGTGGGCAGACTA | 43967 |
| 10342 TGCTTCCGCTGCTCCCAGTA | 22000 GTGGAGAACAGAACCAGGTCAAAC | 32984 CCCTTCTCAGGCGGTGCTT | 43968 |
| 10343 CGTAGTGATTCAGAGACCCAGGTT | 22001 CTCTGAGGTTCTAGGCTATGACAGA | 32985 CGTAGGCAGCCTTCCACGTA | 43969 |
| 10344 CCCTTATGCCTGGTAGGACTGGTT | 22002 CAAATGTTATCCCCTCTGCACCTA | 32986 CACATGCTATCCCTTATGCCTGGTA | 43970 |
| 10345 CCACACCCACTTCTATGCCTTTG | 22003 GATGGAAAAGAGGGAATTGCAAGTAGA | 32987 CCTTCAGTATCTCCACACCCACTTCT | 43971 |
| 10346 GCTAAACTTAACATCTCAGCCTCCTTTC | 22004 CTGGAACCCAGACAAATGACCTTGT | 32988 CTGGGCACCCAGCTAAACTT | 43972 |
| 10347 AGAGACCCCAGGGTGCTAGT | 22005 GCAAGGAGGTGGGATGAGACA | 32989 CCCCTGACTGATGTGTCCAGAGA | 43973 |
| 10348 GTCGTCTAGGGAACCATGTCAGT | 22006 GGAGATCTTTAGGATGAGCAGCAAT | 32990 GCACAGTCTGGAAACCAGTCGTCTA | 43974 |
| 10349 GCCCTGAACGCATCTTCCTA | 22007 CACATTCTGGAACTGCCCTTCT | 32991 AGTGCCAGACAGCCCTGAAC | 43975 |
| 10350 GCCAAGCAATGATGCCTTATGAT | 22008 GCAGAAGAGAGCTGAGGTTAGATG | 32992 ACAGACTACAGCCAAGCAATGAT | 43976 |
| 10351 TGCTGTCACTGGAAATAGTTGAGAT | 22009 TCTAATGGACAGCATTGGGTCAAA | 32993 GGTACTGATCTGCTGTCACTGGAAA | 43977 |
| 10352 GTGACATTAAACAGGACACTGACATTCTTG | 22010 GGATGGAGGGAGCCATTTTTAGT | 32994 TGGCACCATTTCAGTGACATTAAAC | 43978 |
| 10353 CAGGTATTAGGGACCTCTGAGCTACT | 22011 GCTAGTTGAGGAAGCCCAAGTAT | 32995 GATTGAGAAGCAGTAGTAGCAGGTAT | 43979 |
| 10354 TGCTCGATCCGGGAACTGT | 22012 CCAGTCCCTCGTTTCCTCACAA | 32996 TCCAGCAGCCGTGCTCGAT | 43980 |
| 10355 CACTCCACACTTAACGAAGGCTATTC | 22013 GGCAGCCTTCCATGTCACTTAC | 32997 CTAGAGGCAATACACTCCACACTT | 43981 |
| 10356 CCGCATTGACTGACACAGTTAAAGACA | 22014 AAGGTAGCACGATTCACAGCAT | 32998 ACACCGCATTGACTGACACA | 43982 |
| 10357 GCAGGGATCTAACCCCTAAAACATC | 22015 GGAATTGCACGGCAGCCTTTAC | 32999 GCTGCACTTGCAGGGATCTAAC | 43983 |
| 10358 CGGAGTGTGCACAAGAATATTTGGATGT | 22016 CCCACATGAGCTGGCTTCATTTTC | 33000 TGCTGGAGTGAGCGGAGTGT | 43984 |
| 10359 CAGCCCCACATGGTAATTGCCTTAAA | 22017 GCCTTGCTGGAGTGCAAAC | 33001 CTGTTTATCTCAGCCCACATGGTA | 43985 |
| 10360 AGAAACCCGAAGAGACCCAGAA | 22018 GCTGATCATGTCACCGCTTTG | 33002 CCACCCAAAGAACCCGAAGA | 43986 |
| 10361 CAGCATCACCCCTACATGACTAAA | 22019 GTTGACAATCCTCTCTCCACTTCT | 33003 CACAGACCAGGTTCAGCATCA | 43987 |
| 10362 GCACTTGTGTGAGTCACTTCA | 22020 CCCAGATGCCTGTGGAGTCACTA | 33004 GGCCCATCAGATTCTGCACTTG | 43988 |
| 10363 GTCTCAGGGTGCCTGATCTGTT | 22021 AGAGAAAGTGGCCCTGAAGATAAG | 33005 TTGTGCCTCCCAGGTCTCA | 43989 |
| 10364 TCAGCTCCGGACCCATGT | 22022 GGAGAAGACTACTCGTACCGTGACAAT | 33006 TTGCCATGAACCGCCTTCT | 43990 |
| 10365 CGGCCCTATCTCATCTCTGTCTGA | 22023 CGCCAGGCTTGCAGTTGTAT | 33007 CCGCACGGCCCTATCTCATC | 43991 |
| 10366 GGAACCACTAAAACAAATTGCCGAGTA | 22024 GATCATGCTCCCAACCGTAGT | 33008 CAGAGAGCCACAGGAACCACTAA | 43992 |
| 10367 GCCTCGGAAGCAATGGGTTATG | 22025 CGTGTTGGATCCTTTGAGAAAACT | 33009 TGTCACAGCCTCGGAAGCAA | 43993 |
| 10368 GCTCTCACGAGGACATTTCTCACA | 22026 GGGAGCTGATGGGCTCTCTTTAG | 33010 GGAAGAGTGTTGGTTTGCTCTCA | 43994 |
| 10369 GGGCACAGTCCTCCCAGTTTC | 22027 TGGTCTGTTAGCACACCCAATTAT | 33011 AGGCCTATGGGGCACAGT | 43995 |
| 10370 GGCCAGGGAGGAACATAAATCCAA | 22028 GAACACATCTTAGGAGGGAATATGTCT | 33012 CCAGGCCAGGGAGGTGAACA | 43996 |
| 10371 CACCTTAGCACCCTGAAGAATAAAATC | 22029 GCAGTGCAGGGTTCTTACATTC | 33013 TGGCACACACCACACCTTAG | 43997 |
| 10372 GGTTCAGAAGAGTAAGGGCTTCAGT | 22030 CGCTTACCCTGGCATCTTCTCT | 33014 CCTTGTGGCCTTGGTTCAGA | 43998 |
| 10373 CCCAGTCCTCTTTCTCCTGAAACCAA | 22031 CTGTAAAAGGCCTGCTTTGTTGA | 33015 CCCAACTTGCCCAGTCCTCTTT | 43999 |
| 10374 GCAGAGTGTCCATGTGTAACAAAG | 22032 TTGACATATTCAGCCCTCAGCAT | 33016 GCAGTCAGCAGAGTGTCCAT | 44000 |
| 10375 GGGCTCCTTTGGCATCAGCATT | 22033 ACGGTGCCCTTGGGTTACTAGA | 33017 AGGGCTTGGAGGGCTCCTTT | 44001 |
| 10376 CTCCCCTTGCATTTACCCTCCTT | 22034 GGGCTACAAACTAAGGCCAAAAAC | 33018 TGGGGTCTCCCCTTGCATTT | 44002 |
| 10377 TCCTCCTCTTTTAAGACTTAGCACATC | 22035 GCCTCTGCTGCTCGCATGTAT | 33019 CGGGGATAAACACTTCCTCCTCTT | 44003 |
| 10378 ACCTGCTGACTAATACAAGCTGAAG | 22036 ACTATTCAGACATCACCTCCTCCAT | 33020 CGAACTTTCAGTAAATACCTGCTGACT | 44004 |
| 10379 GCCCTGGCTGAAATGGTAGT | 22037 ACCCTCTGGGGTTCTGGCTAT | 33021 ACCCTGGGCAAGGTCATCT | 44005 |
| 10380 CACAAGAGGTTGATGACCCATACA | 22038 CACAGTAAACAACCCAGCACATATT | 33022 CTGGAAGAGAGCACAAGAGGTTGAT | 44006 |
| 10381 TGGTGCATCCGATGAGAATGAAAA | 22039 TTGCAAGAACACCCATAACCTCTTA | 33023 CCGCTGCATGTTTGGTGCAT | 44007 |
| 10382 CCTCCTAATTAGCAAGGGAGCTAAC | 22040 GAGCTAACAATGCAAGGTAAAGCGAAT | 33024 GGAGACTGGTCAGGAATACCTCCTA | 44008 |
| 10383 CCAGAGACTTCGGACACCAGAGA | 22041 GCTGTTTATCAGTGAAATCCCAGTCACTT | 33025 GTTCATGTGTTTGCCAGAGACTTC | 44009 |
| 10384 TGCCCAAGGCCATGGAACTA | 22042 GGACAGACACGGGTCAAATTC | 33026 GAGGCTCAGAGGAGTTGACTTG | 44010 |
| 10385 CGACCTTCCAAACAACCATGCAAAG | 22043 GGAGTGACGCTCCTTCCTACCTA | 33027 TGGCCACCTCACGACCTT | 44011 |
| 10386 CGTCAAAACAAAGTGACTGCTCATT | 22044 GGTAGGAATGTTTCCCAAGCTATTCA | 33028 GCTCCAGCTGTACCTACGTCAA | 44012 |
| 10387 GCCAGAAATGGGGAGACCAGTT | 22045 GGATACACATTCTCTCCTATCTGCAT | 33029 GCAGAGAGAGGTGCCAGAAAT | 44013 |
| 10388 AGCCTGCCTCGTATATTAAGTTTCA | 22046 CCCTCAGACCTCAGCTGGTTT | 33030 GCATTTTATCTAGCCTGCCTCGTAT | 44014 |
| 10389 CCTCCCCACTTTCGCCTTTTCA | 22047 CTGGTCCCGGCTACTGACATTT | 33031 CCACCCACCCCCCACTTT | 44015 |
| 10390 CCCATTAGAAGGTAGCTTTTGACTGAAG | 22048 TGTTAGCCGTGTAACTTGTCCTTCTTG | 33032 TGTCACACCCACCTCCCATTAG | 44016 |
| 10391 ACACCTGACTCACTCTGTTCATAC | 22049 GCCGGCTGGGTTTGACCAATA | 33033 GGCAAAAGTAAACACCTGACTCACT | 44017 |
| 10392 GACCCACACTGCCCAATTAAGA | 22050 GCACAGCCCCTTCACTTCTCT | 33034 TGCAGCGTTTGACCCACACT | 44018 |
| 10393 TGGGGAACTCAACCTTCATTTTACA | 22051 GCAGGCAAGCATGCACCTTT | 33035 ATTGGATCATCAGATTTGGGGAACT | 44019 |
| 10394 TGCCTGATAGGGATGCTGTTTG | 22052 GGCCTCCGCTGTGATTCACTT | 33036 GTGAGAGACCTGGAAATGCCTGATAG | 44020 |
| 10395 GACCCAAAATGCCCTTATTTTAGTGGAGTA | 22053 GCATTAAGAGTCATACAGCAGAGTCAT | 33037 CAAGGGACCCAAAATGCCCTTA | 44021 |
| 10396 GGCCTTTGCTTGTCCTAGTAAACTCT | 22054 ATGCGCCAGGAGGGTCTTG | 33038 CACCAGGCCTTTGCTTGTCCTA | 44022 |
| 10397 GTCCCTTGGAAAAGGTGGACAA | 22055 GTCTAGCACTGGTAGCACTGGAT | 33039 GCAGGTAAGGAGTCCCTTGGAA | 44023 |

FIG. 36P10

| | | | |
|---|---|---|---|
| 10398 GCATGAAACACTTGGGAAAGCACATA | 22056 CTCTAGACACACAACTGTCTCTTTTC | 33040 TGAACAGTCTGCATGAAACACTTG | 44024 |
| 10399 CGTGGGGTGTATAGTCTAAGGATTGAGA | 22057 GACATTTGACAGTGGTTTGTGTGA | 33041 TCCCTCGTGGGGTGTATAGTCT | 44025 |
| 10400 ACAAGAAGGCTGTCACTTTACAAGA | 22058 GCCCTTTGTCTTCTTGCTAACTTCAATATG | 33042 CCCTCTGCCTCATGGTACAAG | 44026 |
| 10401 GAAGAAGGTGCTTCTGAGAAATGTAGT | 22059 AAGCTGGACCCACTAATTTGAAGT | 33043 TACCTGGGCACCTGTGAAGA | 44027 |
| 10402 GAGGTCTGGTCGATCTTGTGACTAC | 22060 GAGCCTCAGCATCAAACCATCAT | 33044 CTCCTTGAGGTCTGGTCGATCT | 44028 |
| 10403 GCCACCATGGATTCATCCTCTT | 22061 GAGAGCTTACTCCTCAAGTGTCTTT | 33045 GTTCCAAAGGCCACCATGGATT | 44029 |
| 10404 CCTAAACAACCCTGGTTGAAAGGTATC | 22062 TGCCTTGGCAAGCTCAAGTT | 33046 TTCCTGAGGGTCATCCTAAACAAC | 44030 |
| 10405 TGGCTGAGGGTCTTTTACTTGATT | 22063 GCAATTCCTGACCTGCATCTTTC | 33047 TGGTTGTGGCTGAGGGTCTT | 44031 |
| 10406 CACGGTTAGACTTAAACAAGGCTAGAT | 22064 CCTTACGCAGTTGCTGGTGAAAG | 33048 GGCTGCATAGGGTAAATCACGGTTAG | 44032 |
| 10407 CACCCACCCAGTGCAAAACA | 22065 AGCTGCTTGGTCACCCAAAG | 33049 CCCATGGAAAAGAGGGCACTGTCA | 44033 |
| 10408 CTCCCTAAGTACATGGGATCTCTTTC | 22066 TTCTTCCCTCCTAGAGATGGTCAA | 33050 GCAGAACAATGTACTCTCCCTAAGT | 44034 |
| 10409 GCACAGCCAGTGTTACCCAAAC | 22067 AGGCCAATGCCGTCTTGAA | 33051 AGTGGAGCACAGCCAGTGT | 44035 |
| 10410 TGGGCTCAGAGGATGGACTT | 22068 CAGAGCCTTGGCATAGTCCTTT | 33052 CCTTGGGGTTGGGCTCAGA | 44036 |
| 10411 GCGTGTGACATTTCGCTCCCTTA | 22069 AGGGCCGTAGAGGCAGAACAT | 33053 CTGTGCCGCGTGTGACATTT | 44037 |
| 10412 GGGTAAGAAGGCAAGAATGATACAACA | 22070 GAAGGAAATCCAGTCTGATGGAAGA | 33054 CCCTTGTGTGACATGGGTAAGAAG | 44038 |
| 10413 CTGCTCACCCTAACCTGAGAAGT | 22071 CCAGTGGCATGGAGTCAGGATAG | 33055 GGCCAGATCTGCTCACCCTAA | 44039 |
| 10414 GCAGGGAGGAAAGCTTCCACTTGA | 22072 GACCTCACACAGGTAACCCTTTCA | 33056 CTTGTTTTCAAGGCAGGGAGGAA | 44040 |
| 10415 GCCAATCTGAGAGATGCCTGAA | 22073 CGGCTGCTGGACAATCCTTT | 33057 AGACTTGGGGAGCCAATCTGA | 44041 |
| 10416 GCAGCCAAAACTGGAACAGCAA | 22074 ACGCATAATACCGGCCTTTGT | 33058 CGTGATCTTGAGAAGCAGCCAAAAC | 44042 |
| 10417 CCAGTGACCTACTTGGGAGATTTCTGT | 22075 GAAACAGCTCTCAGAATCTAAGGTTTC | 33059 CACCATTACTCCCAGTGACCTACT | 44043 |
| 10418 TTGGTCACACGTAGAGTGTAACAT | 22076 TCAAGCAGGTACCAAATCCTTTCT | 33060 GAGGAGAGACACAACTTATGCTTTTTG | 44044 |
| 10419 TCTGTGTGGACCCCTGGCAATA | 22077 CCCCAGAGGAGGATTGGGAGAATAAG | 33061 TGCTCCATGCAGGTCTGTGT | 44045 |
| 10420 CCCGTTAACCTTGTGGTCCTTGT | 22078 AGCATCGACCCTGCTTTGAA | 33062 GGCAGATTATCCCGTTAACCTTGT | 44046 |
| 10421 GCCACATGCAAGCAAGCTAGGTA | 22079 TCTCCAACTGTCCCCTTTGGAA | 33063 TCCGCCCTGCCACATGCAA | 44047 |
| 10422 GGGCTATGCCATGAAAACTTAGTTGATG | 22080 CCAACTTGCCTCTAATGAAATGTT | 33064 AGAAGAGGGCTATGCCATGA | 44048 |
| 10423 AGTGTGTCCCAGCTGCACTT | 22081 GGAGTAAAGGTATCAACCACCCTTGA | 33065 CCAGGGTTCACTGAGATGTAGTGTG | 44049 |
| 10424 CACTCACCTTTAGCTGACATTGAGGTT | 22082 ACAGCCCTATCATAGCCTTTACTTC | 33066 GAGAAGGCTCTAAGCACTCACCTT | 44050 |
| 10425 CAATGCCCACATACCTCTTCACT | 22083 CACTCCCATCCTACCTTTTATG | 33067 GGTCCTAGTTTTCAATGCCCACATAC | 44051 |
| 10426 GAGTGGCTTTTGGGTGAGAGAAG | 22084 CAATGCTGTCTTTCCCAACTCTTT | 33068 AGATGAGTGGTGAGTGGCTTTTG | 44052 |
| 10427 CTCCAGTGCTCTTGCTGACTGT | 22085 AGCCTAGTTAGGACACTTGACACT | 33069 TGCTGTCCCTCCAGTGCTCTT | 44053 |
| 10428 GTGGCAGTTCCCAAGCTAGAGATAG | 22086 TCCTGTGAAGCCAATGAACACAA | 33070 CTCACTGATGATGGTGGCAGTTC | 44054 |
| 10429 CACACTGGACGTACTGGACGTATG | 22087 GGATGCGAGTGGCTCATTCA | 33071 TCACCCACACTGGACGTACT | 44055 |
| 10430 CAAGGTGTCAGTGGGTTTGCTT | 22088 TGCAACAATTTGCAAGCCAAGA | 33072 ACCCAGGATCAAGGTGTCAGT | 44056 |
| 10431 CCTTGTAACTGGGATAGAAAAGCACAT | 22089 GGTCTGACTTGGCAGGAAATACA | 33073 GGAAATGTGTTCTACCTTGTAACTGGGATA | 44057 |
| 10432 AGATCCACAAAGCATTTGGTCCTA | 22090 CCACTCCTCAGAACCAGTGATGAT | 33074 CCTGGTAGGAAGATCCACAAAGCAT | 44058 |
| 10433 GCAATTCCTGGACAGCTCCTAGT | 22091 AGCCACCCTAGTCCTCTCCTTCT | 33075 CAGTCTAGGACACAAAGAGTGCAA | 44059 |
| 10434 TCAGAGGCCATTTCTAGGGTCTT | 22092 TGATGTGGAGGAGGCAACAGA | 33076 CCAGCATGTCTCTCAGAGGCCATTT | 44060 |
| 10435 GCATGGCAGAATCAAGGCTCAT | 22093 CTGAAGAATGGGGCAATAGGAAGT | 33077 AAGGGAGCTGCATGGCAGAA | 44061 |
| 10436 ACACACCTGGAAGAGAAAACCTT | 22094 GCAGTTCTGAAGAGAGGCTTTGAAC | 33078 AACTACAAACACACACCTGGAAGA | 44062 |
| 10437 GAGCTTGAACTCGAAGTATTAGGTGTA | 22095 GCTTTTCAGCTAGCATTCATTCACT | 33079 TCTGCATGAGCTTGAACTCGAA | 44063 |
| 10438 CAGCACGGTAGTGGCAAAGGTA | 22096 CCCCTGCTGGGAATTCAAGT | 33080 AGAGCAGCAGCACGGTAGT | 44064 |
| 10439 GCTTGAAATCTCATCCCCAGCACTTG | 22097 TCTGCTTTGTACCTTGCAGGAAA | 33081 TCGGGCTCGGGCTTGAAAT | 44065 |
| 10440 GCTGAGTGTCGTCCAAAGTCT | 22098 CGTGCCCACTCCAACCTTAT | 33082 TCCATGCCATTGCTGAGTGT | 44066 |
| 10441 CCCAGGATCAAGAGAAAGGGACAT | 22099 CCAGAACTTTGCCACTCTTCTGTCA | 33083 AAGCCCACCCAGGATCAAGAGA | 44067 |
| 10442 CACCCTGAGTTCTATTTCCAGGTA | 22100 CCTGGCTAATACATGCTGTAAGCACT | 33084 GATGCAACACCCTGAGTTCTA | 44068 |
| 10443 GGGCTTCTAGGTCCCTGGCTTT | 22101 CTCTCCACATTTGGTGATCGTGTTG | 33085 CCAGCCATCTTGGGGCTTCTA | 44069 |
| 10444 TCAAACTCTGGCCTTCTGACTTT | 22102 CCAAAGGTAACACAGGATGTTGGTA | 33086 CTGGGTAGTCAAGGTCAATTCAAAC | 44070 |
| 10445 CGCTAACTGCCTGCCTGACT | 22103 GGTGAAGTAGTGAAAGGTGGTAAGA | 33087 AACGGAGGACCCACGCTAACT | 44071 |
| 10446 CCGGTTCTGTACAAGATCCAGATTG | 22104 GGAAATAATATAGCCTGCCTTGACTTC | 33088 AACTAGGCCCCGGTTCTGTA | 44072 |
| 10447 GGCTCCAAATCACCACACCAAAC | 22105 CCCATGGGTGTATTTTGAAGGATGAA | 33089 GATTGAAATCTACCTGGCTCCAAATC | 44073 |
| 10448 GTGGGACACAGACAGCATCCTT | 22106 CGTCTCCCAAAACGTCCTCATC | 33090 GCAGTGTTTGGTGGGACACAGA | 44074 |
| 10449 CCAGGTCTCTACCTTCTCCTCTGT | 22107 GGACAGCCACAGAACGTCAACT | 33091 TTGCCCTCCAGGTCTCTACCTT | 44075 |
| 10450 GAGGCGAATAAGGTAGGCTGGTT | 22108 CCTGCATCCTGCCGCTCTTTA | 33092 GCAGATAGTGGACAATGAGGCGAAT | 44076 |
| 10451 GCACACCAAATCCCACCTCTCTTC | 22109 GGGGAGAATTGCTCCAGAGATG | 33093 GTCCTCCACTTGCACACCAA | 44077 |
| 10452 TGGCCAGTGGGAGTCAGTACAT | 22110 GCAGGTGGCAGTTGGAAAGTA | 33094 GTTGCAGCATGGGCTAGT | 44078 |
| 10453 TGAGTAACTGAGATGGTGCAACTTAC | 22111 CCCTGCTTATAAGACCAAGAGGACTTC | 33095 GGGGTTTGACTTGAGTAACTGAGAT | 44079 |
| 10454 GGAAGTGGTTTCTATCTCACCTGTCT | 22112 CCCAGGGGACCAGCATATAACA | 33096 GGGTGTTCCCTAAGGAAGTGGTTTC | 44080 |
| 10455 GACGAGAAGTCTGGTGGGTTT | 22113 GCATTCAGCCTCCCCTTTTGAATAGTA | 33097 CAGCTTGGCAAAGACGAGAAG | 44081 |
| 10456 CTGGGATAGTGGCTTCTGAGCAA | 22114 TCTCGGGAAATTTCAGGCACAA | 33098 CACCTCTTCTTTGATTCCCTGGGATAG | 44082 |
| 10457 CCACTTCCCACTCCAGTTACCAT | 22115 CAGAAGGGTGCAGAGATACAAGT | 33099 CCTTCAGTCCAGCTGACCACTTC | 44083 |
| 10458 GTGAGCCTTGGTTTCAGTCACACT | 22116 AAGTGCTGGCAAGATCTCAGTT | 33100 GCACACAGTGAGCCTTGGTTTC | 44084 |
| 10459 GCGGAGATGACAAACCTGTTCT | 22117 TCAGGGGCTAGGTGTTGAACT | 33101 TGGCCTTGCGGAGATGACAA | 44085 |
| 10460 TGCTTAATTGAGTGCTGTGTGATTC | 22118 AGCAATGTCCTCCCCTATCCTT | 33102 GGGGAGACAGACTTACATGCTTAATTG | 44086 |
| 10461 CCCAGTTGAAGTAGGAAGCAGCAT | 22119 AAGATGAGGTGCTTGTCTCATGT | 33103 GCCAGGCACCCAGTTGAAGTA | 44087 |
| 10462 CTCCCAACAACTCACATGGACTGA | 22120 GAAATAGTGAGGGCTGTCCCTAAAC | 33104 GGCCGCTCCCAACAACTCA | 44088 |

| | | | |
|---|---|---|---|
| 10463 GGGTATGGAGATAGGGGTCACA | 22121 GGAACTCCACACAGCTTTTCTCT | 33105 GGAAAGCCCCTGGGTATGGAGATA | 44089 |
| 10464 CCTGTCCATTCTGCATTGCACTTG | 22122 TTCTCCTGCCGACCTGTCTAC | 33106 TCCGGTCCTCCCTGTCCATT | 44090 |
| 10465 CCCTTATTGCCATTTGGACTCAAAGA | 22123 GCTACTATATCATCCCTGACCTTGCATTAG | 33107 GAGATGACTATTCGTTCCCTTATTGCCATT | 44091 |
| 10466 TGGCAGTAGGCAGGAGTGT | 22124 CTCTCCCTTAGGCAGTGATTCTTC | 33108 TGACCCTTGTGGGTGGCAGTA | 44092 |
| 10467 TCACCCTTGATAAGAGAGGGAAATG | 22125 GGGAGGGAGAAAGGAGGAGAAAC | 33109 GGCTTCTGAGAATGACTTTCACCCTTGAT | 44093 |
| 10468 AGGAAAGTGTCCTTGCAGGATTG | 22126 CTGTAAAGAGTACAGTGGTTCTCTGA | 33110 GCCCATGTAGCTTTAGGAAAGTGT | 44094 |
| 10469 TGATGCCTACAGGGAGACACT | 22127 CACCCTTACTCTTCCCTCTGCTT | 33111 ACATTCACAGCTTTGATGCCTACA | 44095 |
| 10470 GCCAAAGCCACTTTCTCCAGTGT | 22128 CTAGGAGAGAGTTCTAGGGTGGTT | 33112 GGAGGTTGTGCCAAAGCCACTT | 44096 |
| 10471 GCACGGGACTCAGAATAGCCAAA | 22129 GGGACATGTGACTCCTCCAACT | 33113 GAAAACGCACGGGACTCAGA | 44097 |
| 10472 CTGATTGCCGTGCTAGTTGTGT | 22130 GTGAACTCAGCCTCCTCTAAAGATCTAA | 33114 CTGGGCAGTCCATGACTGATTG | 44098 |
| 10473 GTCAGTCGCAGTTCCAGTCAAC | 22131 CCCTTCCTTCTCAGCTCCATTTG | 33115 GGTCCCAAGATGTCAGTCGCAGTT | 44099 |
| 10474 CGGGACTTGAGTCAGGTTGTGA | 22132 GGTAAAGTCAGGATTTACACCCAAGTT | 33116 GAGACAGACATGACGGGACTTGA | 44100 |
| 10475 CTCAGGACTTCTGGACATTCACA | 22133 CTGCCAGAGGGATACCCATGTA | 33117 CAGAGCTCAAAGCTCAGGACTTC | 44101 |
| 10476 GAACCAAGGAGTGACACAATCTGA | 22134 TTGCAACCTAGCAGTGAGAATGA | 33118 CCCTGGGAGGGTTTTGAACCAA | 44102 |
| 10477 GGCATGGATATGGCACAGAATAAGAAAC | 22135 TGACATGTTATGGCTCATGTCTCAA | 33119 GAAAGGCATGGATATGGCACAGA | 44103 |
| 10478 GAGGTTCACAGGGCTTGGGTAT | 22136 TTCCAGCCCTGTCCCTTAGTAG | 33120 CAGACGTAGAGCTTGAGGTTCACA | 44104 |
| 10479 CAATGAGGTTGTCTTAGCCCTTGT | 22137 ACACCCACTCTGGGCATGT | 33121 GCTACAGGATACAATGAGGTTGTCT | 44105 |
| 10480 AGCAGATGTGCTGCCACATAG | 22138 TTGCCTCCACCATGCCAAA | 33122 CCCAGGAATGCCTTCCAGCTTAG | 44106 |
| 10481 GCCAGGAACGATGTGTTAAATGCTT | 22139 CTGAGCCTCCAAGTCCTCATTTC | 33123 ATGTGCCAGGAACGATGTGT | 44107 |
| 10482 ACCTTCCACCCAGTCACTCA | 22140 TTGAGAAAGAGGGAAGAGTCTAGGAT | 33124 TTGGTGAACAGTGCCACCTT | 44108 |
| 10483 GCCTCAACCCAGTTAGGCCAAT | 22141 AGAGGCACACTTGAAAAGACTGA | 33125 TGGATCTGTGCCTGCCTCAAC | 44109 |
| 10484 GGAGGCTGCTTTTGCCTGTT | 22142 CACCCACACACATTCTACCTTGA | 33126 TCCAGAGATGGAGGCTGCTT | 44110 |
| 10485 CCCAGTGTAGCTCTGTGAGTAGT | 22143 TACTGCTGGCGGTGAGGATGT | 33127 TCCCTGTGTGTCTCCCAGTGTAG | 44111 |
| 10486 ACTGGTCTTGTTCCAGCTTCTTC | 22144 GTGAGCAAGGTATAGGAGGATGAAAGA | 33128 CCCATTTGCTGCACTGGTCTTG | 44112 |
| 10487 TGGTGTTTGACTGGGGCCTTA | 22145 TGCACTCCTTTCCCTATCTCCTTATTA | 33129 ACTTCATGGAGAAGATGGTGTTTGA | 44113 |
| 10488 AGGCCAGATGTCCTGCCAATG | 22146 GGGCAATAGCCCCAAGGTATATTTTC | 33130 GCCAAAGCAAGGCCAGATGT | 44114 |
| 10489 GCCAAGGAACCCAATACTGATAAACAGAAG | 22147 TCACTTCAGCAAAACATGCCTAAG | 33131 GGGCCAAGGAACCCAATACTGA | 44115 |
| 10490 CTGGCAACTGACCCAACCTATTG | 22148 GACCAGCATATAAGAGGGTCATGAAT | 33132 AGGCTGTCTCTGGCAACTGA | 44116 |
| 10491 GTGACCTTTGGCTCTCACTAAC | 22149 CTGGAACATTAAGCAGCTCACCTA | 33133 GTCCCCAGGAATGTGACCTTTG | 44117 |
| 10492 CACAGTGCCTGTTCTATCTCTCGAT | 22150 AGGGGTCTGGGAGGGAAGATAA | 33134 CCTCAGAATTCACAGTGCCTGTTC | 44118 |
| 10493 CCAGAATTTGCCCAGAAGCTCTCA | 22151 GGGTCAGGGGAAGGTCACTAAT | 33135 TGGACCTGCTAAGCTCCAGAA | 44119 |
| 10494 CCACCCCAGATTCAGGTACTTC | 22152 TCTCTTTATCTCAGGCCATGTAGTCA | 33136 CGCTCCTTTCCACCCCAGATT | 44120 |
| 10495 CTCCAACTGCACCCAAATGCTT | 22153 GGTTACCAAGGGCAGTTTGAGAGT | 33137 TTTTCCCTTTGATGGCTCCAACT | 44121 |
| 10496 AGGGCAACTCGGCGGAAAG | 22154 CCGATATTCCCTCCCTTTATTGGTT | 33138 GGAGGGAGGTAGAAGGGCAACT | 44122 |
| 10497 GGAGGCGCTTACAGTACCTCTT | 22155 AGGGCCACATGGCTCTTCTGT | 33139 AGCACCTGGAGGCGCTTA | 44123 |
| 10498 GGCTGCTTCTTCAACCCCAGTTC | 22156 TGGCTGGCAATTCTGATGCAA | 33140 TGCCGTGGCTGCTTCTTCAA | 44124 |
| 10499 GACTGGATACTTAGCTGTGCTTCCTT | 22157 TCAGGCGCAGAACTCTCAATG | 33141 GCTTACACTCTTTCAGACTGGATACT | 44125 |
| 10500 CCTTCCTGAACGTCCACCTGAA | 22158 GTGAAAAGCTATGCCCTGGAGAACA | 33142 TGGCACCTACACCTTCCTGAAC | 44126 |
| 10501 GCCCTCCATAATTTGGTCCCCTTCA | 22159 CACAGAGTAGGTGCTCGTGAAGTT | 33143 GGCACCAAGGCCCTCCATAAT | 44127 |
| 10502 CCTACCCCAGACTATGATGATTGAGT | 22160 GAGATGCATATTCAGGGAGCAGTAAAC | 33144 TCTTCCTCTCCTACCCCAGACT | 44128 |
| 10503 GAAGTGCTTGATCTCAGAGTTTAGTGA | 22161 CTATGAACTTGAGTGGGAGAGACATT | 33145 ATCATGGAAGGAAGTGCTTGATCT | 44129 |
| 10504 CAGACACCCTCAAGCTCAGTCA | 22162 GCAGTTTTGACTTGGCCAGCTA | 33146 ACTCCACCAAGGCACAGACA | 44130 |
| 10505 GTGGGGTATCACAGCAATCCTACT | 22163 AACAACACAGGGGCTTTGTTTC | 33147 TCTCTGACACAGTGGGGTATCA | 44131 |
| 10506 TGACACTGGAGTGACAGGACAA | 22164 GACTTCAGTCTGCCCATTGGTGAT | 33148 CCCACATTAGCAGAGACCACTGA | 44132 |
| 10507 AGTGACCTTGCGGGAGTCT | 22165 CATCACACTCTGGGTACACTTTGATT | 33149 GGTGAGAGAGCAGCAAGTGACCTT | 44133 |
| 10508 TTCTGGGTTCATTCTGGGTCTATG | 22166 AGCCTCAGCCGAGCCAAGT | 33150 AGGGAAACTTCATTCTGGGTTCAT | 44134 |
| 10509 CCCACCTTTACTTGGAGGTCAGA | 22167 GACCCAGAAAAGGAAGGGACTTA | 33151 TCGCCCCTTCCCACCTTTACTT | 44135 |
| 10510 AAGGGCTGTGGGCACCTAAG | 22168 CTTTTGCAGTACCCTAGGCACATA | 33152 GGTAGGTCAGGCAGCAATCAAG | 44136 |
| 10511 GTTCCTGTATTGCAAAGGCTATCATC | 22169 GACACAGGTAGTCCGCAGTCTAAG | 33153 CCTTCCACTTACAGTTAGTTCCTGTA | 44137 |
| 10512 CCCTGCTAACCCACCCTGTCT | 22170 TGTCCTCACACTATGCCAGTA | 33154 TCCCGTACACCTCCCTGCTAA | 44138 |
| 10513 ACCCAGGGTTCCAGTCTAACA | 22171 GTATAGAAAGGGTAGAGACTGTGGATAAC | 33155 TGGCTGTACCCAGGCATGGAA | 44139 |
| 10514 TCCTCCATGGCAGCAGTGTT | 22172 GGTGGGGCCTCTTCCTAACAA | 33156 CAGTGTGTCCAGCCACTAACTTC | 44140 |
| 10515 CTCTCCTGAAAGGAATCATGCAAAC | 22173 GCCCACTGAAGAGCATCGTA | 33157 GGCCACTTGACCTCTCCTGAAA | 44141 |
| 10516 GTGAGCATGAAGTGAAGTGGGGATT | 22174 CCCCTCACTCCATACAGCACAGA | 33158 GGGGAAAGGTAAGAGTGAGCATGAA | 44142 |
| 10517 GCATCCAATCACCCTATCTGAGAA | 22175 GCTGTACATAGGGATGTGAGTGAAAG | 33159 TGCTGGGCCACTGTTGCAT | 44143 |
| 10518 TGACCTTGGTACTTCCCTGTA | 22176 CAGATCCCAAGAGGAGGGGAAAT | 33160 GAGCCTTCTGACTGACCTTGGTA | 44144 |
| 10519 GTTGGGAAAAGAGTTTGGAGTCAGA | 22177 AGGCCAACTCCTCAGCTCAT | 33161 GGGCAGTGCTGAGGTAAAGT | 44145 |
| 10520 GGGAAATCGAGGAAAGGGAGCTT | 22178 TGTTTTCTCTCCACTCCATGTCAA | 33162 GTGGTGGTTAGGGAAATCGAGGAA | 44146 |
| 10521 GCAGGAGTGAGGAAATGGGGAAA | 22179 CCTTGCATTGGCCATTGGCTTT | 33163 CCCATGAAGCAGGAGTGAGGAA | 44147 |
| 10522 GTGAAGCAAGTTGGAGGTTGATGA | 22180 CGTTTCTGACAGAGAAAGAGGTGCTA | 33164 GGGGAAGGTAGTGAAGCAAGTT | 44148 |
| 10523 AGGCCCTGACTCTCATCCTAAC | 22181 GAGAGAATCCAGGTAACAAACCAATG | 33165 AAGCTCACCAGGCCCTGACT | 44149 |
| 10524 CCCTCCACCTGTACCTAGTGTCAA | 22182 TCACAAAGTTTGGCCATCAGAAGA | 33166 TCCTTCACCCCTCCACCTGTA | 44150 |
| 10525 GCCTACAAGCATGGCACGATCT | 22183 GGGTGAGTAGAAGGAACCGATGACA | 33167 AGCCCTTACAGTGGCCTACAAG | 44151 |
| 10526 GTTCAAAAATATGGCCAAGGCTTCT | 22184 GCAGGGAAGGGAATCCAACAGT | 33168 GTTTGCAGTGCTGTTGTTCA | 44152 |
| 10527 GGTCAGTGGCGTGGGCTTA | 22185 ACAGTCTGACCCCATTTTGTCTT | 33169 TCAAGGGTGCCTGGTCAGT | 44153 |

| | | | | | | |
|---|---|---|---|---|---|---|
| 10528 | CCACAGGTTGTAAGACAGGTCAA | 22186 | CCATTATTCCTGCAACGCTCTTTC | 33170 | CGGTTCAGCCACAGGTTGTAAG | 44154 |
| 10529 | GAGGTGTTGCCTATCAGGTTGAGA | 22187 | GGGCCTTGCATGGCTAACTTTG | 33171 | ACAAAGGATTGAGGTGTTGCCTAT | 44155 |
| 10530 | CAAACGAGCTTTTGGTGATGGAT | 22188 | CAGACAACTTGTTCCTGGGAAACAAAAG | 33172 | GCAGGATAAGGCTTTCAAACGAGCTT | 44156 |
| 10531 | TGCACTCGACAGTTCATAGAGATG | 22189 | AGCGAGGACACCCTGGTCAAA | 33173 | CCTTCAGATGCACTCGACAGTTC | 44157 |
| 10532 | CACCCGTACCCTAACTCACCATAC | 22190 | CCTCTGCCAGTATAGGCAGTCTCT | 33174 | GCCAAAGCACCCGTACCCTAA | 44158 |
| 10533 | GGAACTTTCAAAGCAATAGCCTCCTT | 22191 | TCCAGTAGGGCTCTGACCAACA | 33175 | GCACTGGTGGAACTTTCAAAGCAAT | 44159 |
| 10534 | GTGTTCCAAAACCGGATTGTAGTGA | 22192 | CTGCCCCAATGGGTTAACAGAGAT | 33176 | AGGGCATGGAAGTGTTCCAAA | 44160 |
| 10535 | GCTCCACAAAGGGCAACCAA | 22193 | GTTGAATACGCAGTACCCTACGTT | 33177 | CACATTCCAGTGCTCCACAAAG | 44161 |
| 10536 | GTCTTCCCTTTTAGTGGAACCCATT | 22194 | ACACGTAGAGTGCAAGGAATCAT | 33178 | GTCTCAATTCTGAACGAGTCTTCCCTTT | 44162 |
| 10537 | AGCTCGCCACAATCTTCTTGA | 22195 | CACAGCTGAAACTACCAGAGAACTA | 33179 | GGAGCAAAAGCTCGCCACAA | 44163 |
| 10538 | GCGTAAAGTCAAGGAAAACCCCTTAC | 22196 | CGTAGTAATCAGGTGCAGCCAATAG | 33180 | ACTTCTGTGCGTAAAGTCAAGGAA | 44164 |
| 10539 | CGGACCGAAAGGCAGCATAG | 22197 | GCAGTAGCCAGAGAGTGGTTACA | 33181 | GTGAACTGAGTCGGACCGAAAG | 44165 |
| 10540 | GCCCCAAAAGCTTGGAGGGTAA | 22198 | AGGGGTTCCACCACCAGATG | 33182 | GTTAGGCTCCTTTGCCCCAAAA | 44166 |
| 10541 | GCAAGTTAGCTCACTGTCACCTT | 22199 | GCCAGAGAGGGCTACATGCAGTAAT | 33183 | GACACCTTGGCTGATAGAAAAATGCAA | 44167 |
| 10542 | GCTGACCTTTGCCCCTGTAA | 22200 | ACTACGTGAGTATGAGGCACAAG | 33184 | GGGGCAGAACAATGCTGACCTT | 44168 |
| 10543 | GCAGCGATTGTGAGGAAAGAGT | 22201 | GAACTCCTTATGAGCTTTGCCTTGT | 33185 | GAGGTGTTATTATTGTTGCAGCGATTG | 44169 |
| 10544 | CCATGAAAGCCTGGCATCCTGTT | 22202 | GCAGACCAAAGCGGCAAGAAG | 33186 | CTGCCTCAATCTCCCCATGAAAG | 44170 |
| 10545 | CTTGCTTAAAGGCCTCCCTCATC | 22203 | CTTTGCATGGGAATGTTCCTCTTT | 33187 | GTCAAGAGCACACCACTTGCTT | 44171 |
| 10546 | GACATCTGGAGTAGCAGGAGACA | 22204 | ACGTGAAGAGGGCCTGAGACT | 33188 | CAGCAGGTGACATCTGGAGTAG | 44172 |
| 10547 | GGTGCGGAGAAATGTCATTGGTTTG | 22205 | ACCAGTCGTGCAGGGAGTCGAA | 33189 | CCCTTTGGTAGGTGCGGAGAAA | 44173 |
| 10548 | GAGACAACCTCTCCCTTTATGGACTT | 22206 | TGCCCAGTCCCCTGCTTTC | 33190 | GGGATCAGAACCCATGGAGACAAC | 44174 |
| 10549 | GCCCATGTGCCAAGGAGACA | 22207 | CGTTATAACCTGGGCTTCCACAA | 33191 | ACCTCACCTACAAACACACACTTG | 44175 |
| 10550 | TTCACGCTTCTCAATACCCCTATTT | 22208 | ACAAGGAAAGTTACTTGGAGTCCTT | 33192 | CCCCAGCTTCACGCTTCTCAAT | 44176 |
| 10551 | GCCAGGCCTTAGGTTTTACTGATG | 22209 | GGGAAAGAAGGCACAGGTACA | 33193 | CCTCATAGTGCCAGGCCTTAGGTT | 44177 |
| 10552 | CCTCCTCGACAGAAGCTGAACA | 22210 | CCAGGCAGGACATGATACACACA | 33194 | AGGCATCACCTCCTCGACAGA | 44178 |
| 10553 | CTGTTCCTCTGATCCCTGAGTAGT | 22211 | GAAAAACTGCAGGCTGACAGAGA | 33195 | AGACTAGGCACTGTTCCTCTGA | 44179 |
| 10554 | GTGAAATATTGCCCCATGCTAGGTT | 22212 | CGCGAGGAAACTTGGCTTGTGTT | 33196 | AAGTAGTTGGCCACCTGTGAAA | 44180 |
| 10555 | CTCTCAGGCATAACTGCAGAGTTCTT | 22213 | CTTCCTGAGGAGGAAAAATAGGCCATAA | 33197 | CCATATAAAGTCAGTCCTCTCCAGGCATA | 44181 |
| 10556 | TGGAGGGAAAGTGGTGTGTGT | 22214 | CTGTGAAGCAGTCAGGGCAAA | 33198 | CTGTGGTGAGTTGGAGGGAAAGT | 44182 |
| 10557 | CCAGCCCAAATAGCGGTAGCTT | 22215 | GGCCTGATGCAAGGATGTAACACA | 33199 | CTCAAAGTGAACCAGCCCAAATAG | 44183 |
| 10558 | GGTCTCTGTTGGACCTCCAATATTCT | 22216 | CCCCATGTAGGAGGACTGAGGAT | 33200 | AGCCACAGGCTGGTCTCTGTT | 44184 |
| 10559 | GCTGTGAGGTTGGTTAGAATCATTTGT | 22217 | GACATCAGTCACCCTCTCTTTCAA | 33201 | GGTTGAAGCTGTGAGGTTGGTTAG | 44185 |
| 10560 | GGTTGGAGTAGCTTGTCCAGTCTT | 22218 | CACTGAAGGAGAGGCAAGACAGAAAT | 33202 | AAAATGTACCTGGTTGGAGTAGCTT | 44186 |
| 10561 | GCCTCAGCATCTTGGGCTTTT | 22219 | GATTAGGAAGGGCTTTGGCATTG | 33203 | GTCCTTCCAGAAGCCTCAGCAT | 44187 |
| 10562 | GGTGTCCTAAGAATGACTAAGGTCTGA | 22220 | CATGGTTAAGGCAGCAAAGTGTAA | 33204 | GCCTGTAGGTGTCCTAAGAATGACT | 44188 |
| 10563 | GTGAGAGTAAGGAAGTGCTTTACAAC | 22221 | GTTGGTAGGGACTCTTGAAGTTTTG | 33205 | CATTCTAGGCATGTGAGAGTAAGGAA | 44189 |
| 10564 | TGCTCCTCAAAGCTCCCAAAC | 22222 | CACAGGAGAGTCTGGGTTGACT | 33206 | GCCAGATCCATATGCTCCTCAAAG | 44190 |
| 10565 | CTGCATTTTTCCAGAAGCCCACTAT | 22223 | GGCCAGAACTGGGCCGAAA | 33207 | GCTGACCACCAGACAATTACTGCATTT | 44191 |
| 10566 | CTGGGGCTGTAACTTCATCTGTTT | 22224 | GGATGGGTACAGTTGGAGAACAA | 33208 | TGCTGTACTCTGGGGCTGTA | 44192 |
| 10567 | CCCCTTCAGGATAGAAAGGACCTAAG | 22225 | AGACCAACTGGCTACCTGATGT | 33209 | TGCTGTCCCCTTCAGGATAGAA | 44193 |
| 10568 | CAAGGGCCTACCTACATCCGTTT | 22226 | GGCTAAGAGGAGCAGTGACCAT | 33210 | CACTCAGTTTCAAGGGCCTACCTA | 44194 |
| 10569 | GCACAGAGCACATCCTGGCATA | 22227 | GGTGCTCAGGGGAGTGAGAAAA | 33211 | TACCACAGCCCATGGCACAGA | 44195 |
| 10570 | TGGCATTGAGACACTTCTTGGAT | 22228 | GAGAATGTGAACAGGGGAAATAGGAA | 33212 | AGCCATTATTCTGGCATTGAGACA | 44196 |
| 10571 | GGGAGACCAAATCCTTTGTAATAGACACAT | 22229 | ACTTCAAAGTGTATGACGCTTGCTA | 33213 | GCCAGGGAGACCAAATCCTTTGT | 44197 |
| 10572 | CACCAATGACTTTGACTGTGGGAGAA | 22230 | GCTGGGCTAGATTAGCCATTCAAC | 33214 | GCCAGCCATCACCAATGACTT | 44198 |
| 10573 | CAGTGGTGCTACTTTCAGTGTCT | 22231 | TGGCAGCTCCAGCGAATC | 33215 | CGCTGTCAGTGGTGCTACTT | 44199 |
| 10574 | GCCAACCCTGTAAAAACTTTGTGT | 22232 | CTCCTCAACTCCTCACTAGGAACTT | 33216 | GGAGAGAATTAGCCAACCCTGTAA | 44200 |
| 10575 | ATGGCTCCAGCAGGGGAAA | 22233 | GGGAAGGGCAGCAGACATCTTT | 33217 | ACCAAGCCATCCAGCCTCCAT | 44201 |
| 10576 | ACCCAGCACCTAGGGTTCCAA | 22234 | GGCCTGTGATTATGTCAGAAGGGTTT | 33218 | TCCAATGCCACCCAGCACCTA | 44202 |
| 10577 | GCCACCTTGGCTCATTATGACT | 22235 | GGGAATACAATTGGAGTCAGTGGAAG | 33219 | GTTGTGACCATTTTTGCCACCTT | 44203 |
| 10578 | CCACAGGCTGTCCTAACTCCTCTT | 22236 | GAGGAAAGACCTTGTCTGTTCAGGTA | 33220 | CTTCCTCCACAGGCTGTCCTA | 44204 |
| 10579 | GTGGTGGAAGTTCTATACCGGAGAA | 22237 | GCCACCTGGCAGAGAGATGAAA | 33221 | CTGCCCTTTGTGGTGGAAGT | 44205 |
| 10580 | CCAATCAGGGGAATGGCAGAAAG | 22238 | GGAGGCAAGTTAAAAACGTGACTAGGAA | 33222 | CCACAGGCCTTAGCTCCAATCA | 44206 |
| 10581 | TCGCCCCAGTTTGTGCCTAAG | 22239 | GCTAGGCTGCTATTGCAGTAGTTC | 33223 | CCATTCCTATCGCCCCAGTTT | 44207 |
| 10582 | GAGGCTACTTCACATGGCCTAAT | 22240 | CCCCATTTGACCCTCTTTTTCAGA | 33224 | ACTTAGCAAGCTATGAGGCTACTTC | 44208 |
| 10583 | GCATGATTCAGAACCGCTAGAGCAT | 22241 | TTGGGCTCCTGCCTGCACAC | 33225 | CCAGGAACTATGCATGATTCAGAAC | 44209 |
| 10584 | GCGCGTGTTGTGGTCAATGT | 22242 | TGGGAGGAGGCGCGAGACTA | 33226 | ACGTCTGGCGCGTGTTGT | 44210 |
| 10585 | CACCTTTCAACTTCACCTCTCCGTTA | 22243 | ACCCACAAGCCTCAACCATTTC | 33227 | GCCCAGTCACACCTTTCAACTTC | 44211 |
| 10586 | GGTGGACATTTTCCCTTGCACTTG | 22244 | GGCACACCTGTGTTCTGTTGA | 33228 | GGCCAAGATGAGAAAGTAGGTGGACAT | 44212 |
| 10587 | CCCACTTGGATGCCAGAACA | 22245 | GCCACAACCTCCTGTTTGAGAGA | 33229 | TGACATTCTAACCCTATTTCCCACTTG | 44213 |
| 10588 | GGGTGCAAGGAAGCAAAAGGAAGA | 22246 | GTTTCCTGCTTGGACTTGACTGA | 33230 | CAGAAATGGGTGCAAGGAAGCAA | 44214 |
| 10589 | GAAGAATGACAAGGCATTAGCTAGGAT | 22247 | GACACTATTAACCACCACCGTTCCTT | 33231 | CCCAGAAAATGTGAGCCATGAAGA | 44215 |
| 10590 | GGCCATTAAAGGAATGACGTGGAT | 22248 | CCATCCATCCGTCCAATACGTTAG | 33232 | CCCAAGGTGGCCATTAAAGGAA | 44216 |
| 10591 | GCTCCTCTGAACTACAACAACCTT | 22249 | GGAGCAGCTAGAAGCTGAACAA | 33233 | GACCACCATTATTGCTCCTCTGAAC | 44217 |
| 10592 | CTTTCTGTGGGCCTGTGATAGT | 22250 | CCCCTTTCCTAAGGTAGAGGAGTCT | 33234 | GGTACCCTGGCAGTACTTTCTGT | 44218 |

FIG. 36Q3

| | | | |
|---|---|---|---|
| 10593 CAACCGTCTTCCCACAAGTCTGA | 22251 GGGTTTCAGAAAGTTAGAGCCATTCA | 33235 ATTCTCCATGTGTCAACCGTCTT | 44219 |
| 10594 AGGTACTCAGGGCTCAAAGGAA | 22252 GGAAATGGATCATCAGCAGAAGCAA | 33236 CAGGGATAACTGCTCATGTAAGGTACT | 44220 |
| 10595 GAAATGGTTAGGCTTCTCTCTGCTT | 22253 ACAGCATTGGCCTTATTTCCAAAAG | 33237 CGGACCAATGACAGAAATGGTTAG | 44221 |
| 10596 GGGGAGTGAGGGAGGAGCTTA | 22254 GGCTCTCTGCGCATCAGAAGAA | 33238 GGACGGCTGGGTTTCCTTT | 44222 |
| 10597 GGGAATGGCATGTCATGATTTGTT | 22255 GCATGGTCTTGTCTAGGGAGGAA | 33239 TGGTCAATGGGAATGGCATGT | 44223 |
| 10598 GTCACAGCCTCTCAAGGTTCAGT | 22256 GGAGCAGGACCTATTATTAGTCTTCGATT | 33240 CCTGAAACTAGTCACAGCCTCTCA | 44224 |
| 10599 CAGTGTCAGCTTCTTCCGTGGAT | 22257 CAGGACATTCCTCCTCCTCAGACA | 33241 GGTAATGGACAGTGTCAGCTTCT | 44225 |
| 10600 GCCACCCAATGGTGAATGCTAA | 22258 CACCACATCAAGGCTCTACCAT | 33242 ACTTCTCCAGCCACCCAATG | 44226 |
| 10601 GAGGTGAAGGCAGACATGTGGAA | 22259 GGGCAGGAGGCATTCATCAACT | 33243 TCCAGATAGCCCAAAGAGGTGAA | 44227 |
| 10602 TGGGGTCAAATACAACAAGAGACA | 22260 CCTGGTAGTCTTAAACAGGAATCTCTCA | 33244 GCCATAGACAGTTGGGGTCAA | 44228 |
| 10603 GGCTTGGAGCATGGCAGGAAAT | 22261 GGAGCTGCTGTGTTGGAGTT | 33245 GCTTATGGGTGGCTTGGAGCAT | 44229 |
| 10604 CTGCTCCTTGACATTGCAGACACT | 22262 CTCAGCGAAGTTTAAAGCACATCATTC | 33246 CCAATCCCCTGCTCCTTGACAT | 44230 |
| 10605 CCTTAGCTGCAAGAGAGCCTGTTA | 22263 GAACCTCTCTTCCCAGAGATTGAAA | 33247 GTCCATGCCTTAGCTGCAAGA | 44231 |
| 10606 CTTTGTAGAGGTGGCAGGAACA | 22264 TCTTCCTTAGCACCATGGTAGAGAT | 33248 GGTGAGGGCATGGACTTTGTAG | 44232 |
| 10607 CACCCTCGCTTACTGGGATACTGA | 22265 GGAAACAAAGCTCTCCAGTAAGTT | 33249 TTCTGGCCACACCCTCGCTTA | 44233 |
| 10608 GGTAGGCCCAGTAATTGGTACTTG | 22266 GCTTTATGAGGGTAGGGCTTTTCA | 33250 TGTGCTAGGTAGGCCCAGTAA | 44234 |
| 10609 CAGTACCCTTTTATAGGCAGCAACTT | 22267 AGTCCACATCTCCCTTGAAGACA | 33251 GGGGAGGTTTTATCAGTACCCTTTTA | 44235 |
| 10610 GTTCCCAAATCTGCAACCCAAAG | 22268 AGGGTGGGGAAAGATAAATGCAA | 33252 GGAAAGACACAGTGGTTCCCAAATC | 44236 |
| 10611 GTTGCCTCACACACTAGACCTTTG | 22269 TGCAGACCATCACACATCTCAAC | 33253 GTCTTTTAAACAGTTGCCTCACACA | 44237 |
| 10612 TCCATCAGGGAAGAACCACTTATG | 22270 CAGACACTAAGCCAAGCTCTGAAG | 33254 CTGTGAGTTCCATCAGGGAAGAA | 44238 |
| 10613 CCTGTGTATTGGGGCAATGCTT | 22271 CAAGAGCCCCAAGTAATGTGTGT | 33255 GGATGATGGGGAGAGTCCTGTGTATT | 44239 |
| 10614 GACAGGATTCCATAGGGTCTTGTTT | 22272 CCCCACCTTAAAGGCACAGAGTAG | 33256 GGTCTCTTGAAGACAGGATTCCAT | 44240 |
| 10615 CAGAGAGCAAGTGACAGAGTCAT | 22273 GGTGGGGAGAGGCAGGATTG | 33257 GCCTGACACAGACAGAGAGCAA | 44241 |
| 10616 TCTGCATGTCCAACACTGAACT | 22274 AAATGTGTGTTTGCGTGTGGAA | 33258 TGTACTTCAAACTCTGCATGTCCAA | 44242 |
| 10617 GCAGTGGCAATGTGGCAAGA | 22275 GGCCTAAACGCTGCTCACCTAT | 33259 CTGGAGCTAGAGCAGTGGCAAT | 44243 |
| 10618 GCTCTCCACAAGAAGATGGCAGTT | 22276 GGAAACCGGCATTTGGACACA | 33260 GCTGGGTTGCTCTCCACAAGAA | 44244 |
| 10619 ACTTTGGGTCTCTGGTTCCTGTA | 22277 GTGACTGTGGCTTCAGAGTGATG | 33261 GCCCTACAGAAAACTTTGGGTCTCT | 44245 |
| 10620 GGCTCCCAATGCAAAGACCTTCA | 22278 GAGCACAAAAGGTAGGAGTGAGAA | 33262 GCCATCTTGCCTCCCAATGCAA | 44246 |
| 10621 GGGTGCAGGAACATTACCTGGAGTA | 22279 TCATAACGTGGAGGAGAACTGTTG | 33263 CCTCACTAAAGTTTGGGTGCAGGAA | 44247 |
| 10622 GCAAGGGGTATATTGAGTTTCAGTGACTA | 22280 GCCTAAAACTTTCATGGGGTGTTT | 33264 TTCATGCAAAGCAAGGGGTAT | 44248 |
| 10623 CCAGGGGCATTGATGGGTTT | 22281 ACAGACCTCAAGCTCGCTCAGA | 33265 GCAAGGGAATCCAGGGGCATT | 44249 |
| 10624 CAGCAAAACCAATGCAGTGTGA | 22282 AGCCTGGGGCCTTGTCTGA | 33266 ACCCTGAGTGAGCCAGCAAA | 44250 |
| 10625 AGATCTTAGGATCAAGGGGAACACTA | 22283 CACTGGAACATGACCTGTGAGA | 33267 AGGAAGCAAAGAGATCTTAGGATCAAG | 44251 |
| 10626 GGCCCAGTCTCACTATCTAAGTACAGA | 22284 GACGTTTAGGTTTCCATGGCCAAA | 33268 AACAGGCCCAGTCTCACTATCT | 44252 |
| 10627 TGGAAGCAGGCTGGATCACT | 22285 TCCCAGGAGAGGAAGGCCAAT | 33269 CCCGAGGGAAAACAAGAGCTGGAA | 44253 |
| 10628 AGCAGGAAATGGGCCTGAAG | 22286 CTCCTTAGGGTGGCATACACAAAC | 33270 GGCAGGTTAGGTATTAGCAGGAAATG | 44254 |
| 10629 GGCCTCATTTACTTTTGTTGCCTTT | 22287 CAGAGAAGGAATCCCTGCTATCAAA | 33271 GGCTGCTGGCCTCATTTACT | 44255 |
| 10630 CTGTAGAAGACGGACCTCAACAATCA | 22288 GGTTTGAGAGGCACCTAGAATCACT | 33272 GTCTTGACAGACTAGCCTTCTGTAG | 44256 |
| 10631 GGGTGACTGCCAAGTCCAGAAA | 22289 GTGTGAAAGCCAGGTGAGCAT | 33273 TGTCAGAAGGAAGGGGTGACT | 44257 |
| 10632 AGGTGCAAGGTATGCACTGATT | 22290 GGACCACAATCTTCATGAGAGCAA | 33274 GTGCTGTGCTAGGTGCAAGGTA | 44258 |
| 10633 ACGGCCTTGAAAACACCATTCA | 22291 CTCATTAGATGCCTTCGTCTTTTCAGT | 33275 ACAAGGTTTATGTAACGGCCTTGAA | 44259 |
| 10634 CCATGAGGACACAATCAGTCTCAA | 22292 GTATTGGCCGTAGGTTTATTGACTTC | 33276 GGGAAAATCTATGCCATGAGGACACA | 44260 |
| 10635 GCCCATATCGGTGAGGATGGAT | 22293 CCAGATAGTGGCCAGATTGCTT | 33277 TGAGACACAGGGAGGCCCATATC | 44261 |
| 10636 GCCAAGTTCCTCTGGTAACAAAGTT | 22294 AGTAGGCAGCAACAGTTGTCAT | 33278 GGGATTGGGATTGTTGCCAAGTTC | 44262 |
| 10637 GGTGGTGGCTACTACCAAAATGT | 22295 TCTCCAGCACTGGCTCAGAT | 33279 GACTAGCATATGGTGGTGGCTACT | 44263 |
| 10638 CAGAAACAGCCACCTAGCTGGTAA | 22296 ATGTCAAGACAGCCTAGGTTCAAA | 33280 GGTGGGGTACCTAGATTCAGAAACA | 44264 |
| 10639 CCCAGGACATCTCTTCCACTGCTT | 22297 TGGAGGGAGCTCTTCTAGCTT | 33281 CCACAAACTCCCAGGACATCTCT | 44265 |
| 10640 ACGAGCCACGACGGCTCTGA | 22298 CGTGACCGGCCAACACTGA | 33282 TACCACCGCCGAGAATGGAA | 44266 |
| 10641 GTCAAGCAGGTAACAGCAGACT | 22299 TGCTGTGGTTGGGTCCCATT | 33283 AGGGTCCCAGTCAAGCAGGTAA | 44267 |
| 10642 CCACAAATAGGCAGTTTACGACATGAA | 22300 GTGAAATCCCTGAAGTGTTTGCTT | 33284 GCCATGGCCACAAATAGGCAGTT | 44268 |
| 10643 GGGCTTTGACAGTCAGCAGAT | 22301 AGGGTAAATGGGAGTGCTTCTCT | 33285 GGGCAGAGGGGCTTTGACA | 44269 |
| 10644 GGTGCTGCCTTTAGGGGAGTTT | 22302 GCAGCTGGTCAGGAGATAAAGT | 33286 CAGATGAGGGTGCTGCCTTT | 44270 |
| 10645 CCAGCATCTGTGAGAAAACTTCGTT | 22303 CGCTGGCTTCCAGAAGGGTTT | 33287 GGACTCCTTCCAGCATCTGTGAGA | 44271 |
| 10646 GAGTGGCCAGCTGCATAAAAG | 22304 TGGGTCTCTTGAAGACAGAAGATG | 33288 TGCCCACATTTAAAAGGCATAGAGT | 44272 |
| 10647 GCACAGTTTGCAAGCCACTTC | 22305 CTCTGAGAAGCCTGTCTCATTTCCAA | 33289 CTGGTTTGGGGAAGCACAGT | 44273 |
| 10648 CGTGTTTCTGGGATGAGTTAGTCTGT | 22306 CCCTCTTCAGCTAGGCACACA | 33290 GTCTTGACAGACTGTTTCTGGGATGA | 44274 |
| 10649 GGGACATTGGTAGAGCAAAGAGT | 22307 ATCGGCCCTCCTCACCTTTCA | 33291 GGGAGAACAGGGTAGGGACATTG | 44275 |
| 10650 GCAGCGAGAGCTTAGCACATCT | 22308 CCCAGGCCCATGACTACTCCTT | 33292 TGGCTGGCAGCGAGAGCTT | 44276 |
| 10651 GTTTGGGTCAGTGGCAAGAGA | 22309 CCTTAAGGATTCAGCCCTCTTCTAAA | 33293 CTGAGGCAGAAAGTTTGGGTCAGT | 44277 |
| 10652 GACAGAGGAAACCGGGGAAACT | 22310 CCCTCCCTTCCCTCTAAATAGACTT | 33294 TGTCCCAGTTTTGACAGAGGAAAC | 44278 |
| 10653 GTGGAGGGGATGATGGAGTTCAGA | 22311 GTCCAGGAAGACTGGAGCCTAGAA | 33295 GGGGAATGTGGAGGGGATGA | 44279 |
| 10654 GGGCAGAAGATTAGGGAGGTCTT | 22312 GGCTTCTGGTTTTGGAAACAGGTTGA | 33296 GACAGTTGCTTAGGGCAGAAGATT | 44280 |
| 10655 TGGGCTTGGATCCTATGGGAAA | 22313 GGGGCTTTGTACTCACAAGTCA | 33297 CCCCAGATAACTATGGGCTTGGAT | 44281 |
| 10656 CATTCAGGACTTGTTTTTCGTACA | 22314 CCTTGCGCTTGGCATTGGTT | 33298 CAAGGAAAACATTCAGGACTTGGTT | 44282 |
| 10657 CACAGGGGTCTAGGCAAATCTCA | 22315 CAGAGGACACTGACAATCAAGTCA | 33299 CAACGGAAACACAGGGGTCTA | 44283 |

FIG. 36Q4

| | | | |
|---|---|---|---|
| 10658 CCTGTTCCTTCCACTCCTTTTCA | 22316 CCTGACCAGGGTACAGTCACTAAG | 33300 GAGTTTCAAGGCTTAACCTGTTCCTT | 44284 |
| 10659 CCACAAAGCTCCCCTACCATGT | 22317 CAGCAACCAAGCCAATCCTGAA | 33301 GGGTGAGTTGAAATGCCACAAA | 44285 |
| 10660 CAAAGGCTGTTTCAGAACTGATCTCT | 22318 GGGTAAAGGTGGGAGAGAAGAGAGTTTC | 33302 TCCCATTACAAAGGCTGTTTCAGA | 44286 |
| 10661 GCCCTACCCAGTGAGGAGTAGTAG | 22319 TGTAAAAGTGGCCAGTCTGTTCT | 33303 AGAGGGCCCTACCCAGTGA | 44287 |
| 10662 ATCCAGAAGGCAGCAAGCAA | 22320 AGGCAGAGCAGCTCCACAA | 33304 TGCGGGCCAAGAATCCAGAA | 44288 |
| 10663 CCTGCTGTAGACATTCAACAACCAA | 22321 GGTGCTTGAAGTGGGCTTTTC | 33305 GGACTCTACAAGATCCTGCTGTAGACAT | 44289 |
| 10664 CACGGGAAGTCAAATCAATTACGAT | 22322 GGCCAGTTCGCTACCAAGGAA | 33306 GGAGAAGATTTCACGGGAAGTCAAA | 44290 |
| 10665 GGTTTTGACCTCCCGGAATATTAGGAAA | 22323 CACCTCAGCCTCCTGCATAG | 33307 CTTGGTTTTGACCTCCCGGAAT | 44291 |
| 10666 GGCTTTTGGGTGTCAAGAACACACT | 22324 AGTAGTCCCCAACCAGCAGAGA | 33308 GAGTTGAGGCTTTTGGGTGTCA | 44292 |
| 10667 TGCACGTAGTTGCTAAGAGAGTTATG | 22325 CCTCTTCTTCATCCTGGTTAATTTGGAAGT | 33309 GTGATTGGTTGCACGTAGTTGCTAAG | 44293 |
| 10668 GACTGATTATGAGGCAACGTGTGT | 22326 AGACGAAGGCTCAATGTAGACAAG | 33310 ACCAATGTTCCCTTTCTGACTGAT | 44294 |
| 10669 TGGCCATCTTGGGCGTAGAA | 22327 CGTCTGTCACAGTTAACGGCAAA | 33311 GCTTCCGGCTGGCCATCTT | 44295 |
| 10670 CCGGAGCACAAAGCAAGTGAA | 22328 TCCACACCTGCGGCCAAAAT | 33312 CTGTTCACAAACCGGAGCACAA | 44296 |
| 10671 ACACACCAACAGGCACAGAAG | 22329 TGCTGGGCCCATGTGCTT | 33313 CACACCATCGTATACACACCAACA | 44297 |
| 10672 CGCTTCATCAACCTCAATGGTAAG | 22330 TGCTGGGTGCCAGGACATC | 33314 GGAGAGCTGCATTCGCTTCATC | 44298 |
| 10673 GTCTTAGGAGGAAAGTGTCCAGGTTT | 22331 CTGCAGAAGACCTACAGGTAACATC | 33315 GCCTTGTTCCCAGTCTTAGGAGGAA | 44299 |
| 10674 CCATCAGTGGAGCTTTCAGTTCTTC | 22332 GCCCTGTGGCATGGTCATTT | 33316 ACCCTCCATCAGTGGAGCTTT | 44300 |
| 10675 GCACAGCATGGAAATGAGAGACA | 22333 GTGAGAGGAAATCTTGGGCTATGA | 33317 CTTTGGTTAATGCACAGCATGGAA | 44301 |
| 10676 AGGCACTAAAAGCTGACCTAAAGT | 22334 GGAGCAAGGCACAGTTTTCAGA | 33318 TGCTGAGGTCAAGGCACTAAAAG | 44302 |
| 10677 AGTGGCTCCAGTGTGGATGA | 22335 GCCCTTTAAGCCAACCCTACA | 33319 GGGGAAGCCCACTGGAAAAA | 44303 |
| 10678 GCTTGCCTTGTAGCTTGGTGTT | 22336 GCCCAGCCACTGGTGAACT | 33320 CCTGCTGTATTTGCTTGCCTTGTAG | 44304 |
| 10679 AGGGTAAGGGGAGAGAGGAGTCT | 22337 TTGTCACCACCGGGCACATT | 33321 CCACGGAGCTCAGAGGGTAAG | 44305 |
| 10680 AGAGTCTTGGTCCCGGAGTT | 22338 GCGGAGCAGATGTGATGCCTAT | 33322 GGCCAGTCACGCTAGAGTCTT | 44306 |
| 10681 TGGAAGACAGGGGTGGAAAAAG | 22339 CAATCTCACCCAAACCTGCTTCT | 33323 AGAGGGTCACCCAGATTGGAA | 44307 |
| 10682 TGTGCCTGCTAGAAGGGTAAAG | 22340 CCCCGTACCCAATGAGGAGCTAT | 33324 AACAAACACTGTGCCTGCTAGA | 44308 |
| 10683 CACTTCGTTTTGCAGGACACA | 22341 ACAGAAAGTGTGTGCTTCACTGATA | 33325 CACACCTCCTGCACTTCGTTT | 44309 |
| 10684 TGCAGCCATTTGGAGGAGAGA | 22342 CAGTGCAAGAACACTGAAGACTCA | 33326 GCAGAGGTGATGCAGCCATT | 44310 |
| 10685 CTCGTCTGTTGGCAGAGCAACT | 22343 ACTGACTCTCCCAGTCAGGGTCAAG | 33327 GCCCTCAACGATCTCGTCTGTT | 44311 |
| 10686 GGGGAAGAGTAATCTATGGGAGCTAAC | 22344 CCAGCCCTGCCTGCTTCACATTA | 33328 GCCTGAGGAAGGGGAAGAGTAATCTATG | 44312 |
| 10687 CCCTGACCATGTCCCTTTTGACA | 22345 CCCCAGGGCTCCTCCGGTTATTA | 33329 ACAGCTGACCCTGACCATGT | 44313 |
| 10688 GCTGTAGGGTCAAAGAATGTGACT | 22346 CCCAGAGGACCTCACACCTCAT | 33330 TGGAGAGCATGGGACTCCTTCA | 44314 |
| 10689 GCAGCATGCAAGCCATTGTCA | 22347 CACTCTGAATGTGAGGCTGTAGT | 33331 AGCCAGAAAGCAGCATGCAA | 44315 |
| 10690 TGGTGACTAAGATTAAGGGCAGTATCT | 22348 GTTCAGCAAGGTGTGCTTCTGT | 33332 CTGAGCCCACTTATGGTGACTAAGAT | 44316 |
| 10691 CAACTTGCCAGTCTTCCACGTATC | 22349 TGGAGGGCCAGTGGGATGT | 33333 CCCACCTCAACTTGCCAGTCTT | 44317 |
| 10692 CTGGTCCTCTGCATAGACCTAAC | 22350 GCATCACCAAGAGTCTCCCTTGT | 33334 TCCTGCTGGTCCTCTGCAT | 44318 |
| 10693 GCCTGTGTCACATCCCTGAGAAG | 22351 GGACAGGGTGGATACTGTGTTGTAG | 33335 CCACAGTGCCTGTGTCACATC | 44319 |
| 10694 TCCTCCTTCACTCCCTGTCATAG | 22352 CTTAGCACAGAGTAAACCCACACA | 33336 GTTTTCCCCAATTATCCTCCTTCACT | 44320 |
| 10695 GGAGAAGGTCTCATTAAGGGAGTAGA | 22353 CCTCCCAAACCTGGACTGTTCT | 33337 CCCAGGAGTTGGAGAAGGTCTCATT | 44321 |
| 10696 GGAGGGATGATGGAGGTGGATT | 22354 CCCCTCCCCGCAGGACTTAAATA | 33338 TGCACGTCTGGAGGGATGAT | 44322 |
| 10697 CAAGCCTTATTCAGTTCTTGGCATCA | 22355 CAGACCCAAACCATATCACCTTCTTTTC | 33339 CCAACCTCACTCAAGCCTTATTCAGT | 44323 |
| 10698 GTCAATAGCCAGGAAACATGGGTAA | 22356 GGGTCAGTCTGTAGAGTCCGTTTC | 33340 GGGCAGTTTCTAATTGTCAATAGCCAGGAA | 44324 |
| 10699 GCAACCTGCACCGGTCTTTTG | 22357 TAGCAGGGCCCAGAGCAA | 33341 GCCTCTCTGGCTTCACAGCAA | 44325 |
| 10700 CTCCCCTAGTTATTAAGGGTGAGGTATC | 22358 CTGCAGACATTCTGTGTACTGTGAGA | 33342 CTGCTGGTAAACCTCCCCTAGT | 44326 |
| 10701 GGGCTTGTATCCCACTCCAACTAC | 22359 AAGTGTGGTCTTCATGGTTCCAA | 33343 TGGGAATAAAAGATCTGGGCTTGT | 44327 |
| 10702 TTGGGGCTGAGAATACCTCTCT | 22360 GTGCCCACAGAGGGAGCATTTA | 33344 CCGGGGCTTGGATTTCTCTTGTT | 44328 |
| 10703 CCTGTGTACTGTTTGCTTGGGATA | 22361 GCACAATTTTCAGCAAGGAGAGATG | 33345 CTGAGCCTTTGATCCTGTGTACTGT | 44329 |
| 10704 GGGCACTAAGAAGGGCTCAGAGAT | 22362 CTGTGAGCATCTAGGGTCACGAT | 33346 TCCCTGAGCTGGGCGACTAA | 44330 |
| 10705 CCTAGATCCAGCCTCTATCGAGTTC | 22363 CACAATGGTCCCAGACAGAAGCAA | 33347 CAGGCTAACTCAAGACACTCCTAGA | 44331 |
| 10706 TGCCACCAGGATATTGATTGAGATT | 22364 GTGCCCATACTACCAAAGCAATAC | 33348 CTGTGAAGAATGCCACCAGGATATT | 44332 |
| 10707 CAGCCCTAAGGGTGGGATTTCA | 22365 TGGGCAGGGTACCCAGTGA | 33349 CCCACCATGACACAGCCCTAA | 44333 |
| 10708 ACGCCAGGCCAGAAAAATATTACA | 22366 CATTTTCCCTGGGCTACACTCT | 33350 CATCAACGCCAGGCCAGAAA | 44334 |
| 10709 GACCCAAGTCGCGTCAATTCT | 22367 GGTGGTGATGAATGATGGACATACT | 33351 CTTTATATCCAACCCAGACCCAAGT | 44335 |
| 10710 GGGAGAGCTGGTCTATAAGAGGAACTTG | 22368 TCTGAAGATTTCACGACAGGAAGAA | 33352 GGGTGGGAGAGCTGGTCTATAA | 44336 |
| 10711 TGCCTGTAGCATTTGACAACCAT | 22369 GAACCACAAACCTTTGGAATGGAA | 33353 CCCTGCCTTGCCTGTAGCATTT | 44337 |
| 10712 GGTGGGTAAATCTGCCTATTTCAGA | 22370 GCTCTGCTAGCAAACTGTGCTTGTT | 33354 GAGTATTGTGACTAGGTGGGTAAATCT | 44338 |
| 10713 CCACCCTAGTCAATGTCACTATCCTTTC | 22371 ACCAGGTAGGAGGCTGCTTT | 33355 TGCTACCACCCTAGTCAATGTCA | 44339 |
| 10714 GCCTGTCTGCCAATTTGAACAT | 22372 GGGGAAGGATGGAGGTATTAAGTGA | 33356 CTGTGGGACCTTTAGCCTGTCT | 44340 |
| 10715 CAGTAGGCCTGAAGAACCACTCT | 22373 TCGAGAGGAAAGGGCTGTGT | 33357 TGCCAACAGTAGGCCTGAAG | 44341 |
| 10716 CCACTGACAGGTCTGCTGTT | 22374 AAGGCCAGGTCACCTACAGA | 33358 GGCTTGAAGGGTTTCCACTGACA | 44342 |
| 10717 TGGGGACTCTGCAGGTCAAA | 22375 TGTGCCCAGGCCTAAACTGT | 33359 CGCTGAAGCTTGGGGACTCT | 44343 |
| 10718 TGGGTTGTCAGTCACCCAGTA | 22376 AGCCTCCAGCTACCCGGAAT | 33360 AGGCTCCTGGGTTGTCAGT | 44344 |
| 10719 GCCTCAAGGTCTCATTTGCATAGAAAG | 22377 GTGTGGTGAGGACCATGGATT | 33361 CTCTGCAGCCTCAAGGTCTCAT | 44345 |
| 10720 GCTGCTGGTCCATTCTGAGTTG | 22378 GGGAGGGCTTCCACAAAG | 33362 TGTCACTGCTGCTGGTCCAT | 44346 |
| 10721 GTGCAGAATCAAAGACAGTGTAGAAAC | 22379 CCCCGTAGAGAACTGTCTCACATC | 33363 TGGGAACATGTGCAGAATCAAAGA | 44347 |
| 10722 GCCCTGAGACCAAGCAATCA | 22380 ACTCAAAATGCAGCCTAGATAGCAA | 33364 GCAGCAAGTTAGCCCTGAGA | 44348 |

FIG. 36Q5

| | | | |
|---|---|---|---|
| 10723 GTGGTATGCCTTCCTTCCATACTAAACA | 22381 GCAGCTACCAGATAGACTTAGCTGTAA | 33365 GTAGCAAGTGGTATGCCTTCCTT | 44349 |
| 10724 GTGCCCTTCCTTCCCAGTTTCA | 22382 GACAGAACCCCTTGTATAACAATCAGACT | 33366 CCAAGTCCAAGTGCCCTTCCTT | 44350 |
| 10725 CACACTAGAATAGGTAGGGTGCTCTT | 22383 GTCCAGGCAGAGCCATACATC | 33367 GGAAGCCTCCCACACTAGAATAGGTA | 44351 |
| 10726 TGCTTCGGAGTAAGACCTCCAT | 22384 TAGGGCCAAGAGCTCCTGCAA | 33368 GAGGACAAATACTATGCTTCGGAGTAA | 44352 |
| 10727 GACATGTGGCCAGTTGGATCAGT | 22385 GAAGCCATGCAGAAAACATTTCCTTAC | 33369 CCTCCCCAGCCTCTTTTGACAT | 44353 |
| 10728 TGTTTCCCCACTCCCCAAGA | 22386 CCTGCCCCGCCTCCATATTTA | 33370 GGTTTGCTGCTGCGCTTTGT | 44354 |
| 10729 GCCAGATGCTATGTAGTGGCAAA | 22387 GTGGAAATAGAAGCTCACTCTCAACT | 33371 GCACTGTGCCAGATGCTATGT | 44355 |
| 10730 TGATCAGGCACAATACTCTAGTCTCA | 22388 CAACACACCAATGCAGCCAATC | 33372 CCCAGACAAAAATGATCAGGCACAATACT | 44356 |
| 10731 CCAGGTACTATCAGTGCCGACTGT | 22389 CCTGCAGAGTTATTGGGAAGATGA | 33373 GGAGGTAGGCCAGGTACTATCA | 44357 |
| 10732 CTGTTGTTTGGAGCCAAAAGTGT | 22390 TGGGCAGCACGTCACAGAATC | 33374 GGGGTCAGTCGTATTTTCTGTTGT | 44358 |
| 10733 CCTTCCACAATGCAGAGCAGTGA | 22391 AGCAGGCTGGGCCAAAATCA | 33375 AGTATCAGGGGCCTTCCACAA | 44359 |
| 10734 CTCTGCCCTGTAAGTTTTCTACTGACTA | 22392 CACTTGCGAAGGAATCACCATCA | 33376 TCTCCTCTGCCCTGTAAGTTTTC | 44360 |
| 10735 GGAGAAGGTCTTTCTACAGTGAAACT | 22393 TGGTGGAGCAGTCACCTCTTCT | 33377 CCCCACCATAGGAGAAGGTCTTT | 44361 |
| 10736 CGGCAAGACTAGGAATACCAGAGGAA | 22394 GCCTGGCTTTGCAGAGCTTTT | 33378 GCGCTCGGCAAGACTAGGAATA | 44362 |
| 10737 GCATCTTCACATACAGGAAGGAGCAAA | 22395 AGGGCCTTTACAAAAGAGTCTTGA | 33379 AATGGCACCTTTTTGCTGCAT | 44363 |
| 10738 GGTAAAGCTGCTCAATGGGCAATAG | 22396 CAGCCCAGGACCCTCTTTTGAT | 33380 TTGTCCAGGTAAAGCTGCTCAAT | 44364 |
| 10739 GCACCCATGTTGCTCTCAGTGT | 22397 GCAGGATATGAGTGATGCTCCAT | 33381 CCAAAATCTCTCTTGGCACCCATGTT | 44365 |
| 10740 CCTGTTTCCTAGCTTGGCTCTCTTT | 22398 GCCGCCATCTCTGAACTGT | 33382 GCCGATCCGTCTATCAACCTGTTTC | 44366 |
| 10741 TCACCAACACCTTCCTGGAATTAAG | 22399 GTCATAACTACATGGCTGGAACCTA | 33383 CAAGCAATTCTTCACCAACACCTT | 44367 |
| 10742 TGCATGGATCACAGTTTCTTCTGTA | 22400 ACCATGACTAATGAAATCTGGCTATG | 33384 CCCTGGTGCATGGATCACAGTT | 44368 |
| 10743 CCATGTTTCCTCTCAATTCTCTGAAAG | 22401 ATCCACAGCCAGCCATCAAG | 33385 CAGTTGCAACCATGTTTCCTCTCA | 44369 |
| 10744 GGTGATGTGGCCAGACTTGT | 22402 GAGTGCTCACTCAGCATATCTGCTATC | 33386 GAAGGAACCTGTCTGGTGATGT | 44370 |
| 10745 CTTGTGTAGGGACAAAAGCATACCAA | 22403 TTCTGGGGACACCTGATAGACA | 33387 CCCAAGGTAAAAGCAATTCTTGTGT | 44371 |
| 10746 CCAAAGGCCCAGGAGAGGTTT | 22404 AGCAAAAATACCGAGGTAGCCAAT | 33388 ACTGGGCTTCAAAGACCCAAAG | 44372 |
| 10747 GAGAACTGACTCTCCCAGATATAAAGAGTT | 22405 GCCCAATAGGTGTGAAACTTTGAA | 33389 AAGGAGAACTGACTCTCCCAGAT | 44373 |
| 10748 TCTCTGTGATTTAGGTTCCTGCTTTAG | 22406 GGATAGGCAAGTACTGGCTAAAAGT | 33390 GGCTCGTCAGTCTCTTCTCTGT | 44374 |
| 10749 GCCTGGCCTCAATTCTCATTTTT | 22407 CCCCTACCATGACTGATGAAGAAA | 33391 CCACTGTGCCTGGCCTCAAT | 44375 |
| 10750 CTTGGTATGGAATCCTAGTGTATTCTGACT | 22408 GGCTGAGCCCATGGAGTTAAGAT | 33392 GGTTCTTGGTATGGAATCCTAGTGT | 44376 |
| 10751 TTCCTGTGAGAGCATGTGTGTT | 22409 CAGCCTGCAATTCCTATGGACTA | 33393 CCCATAAGTGGATTTCCTGTGAGA | 44377 |
| 10752 CCAGCTAGAGGCTACTCTGTCA | 22410 ACCTGTGGCTCTTCTCCATCT | 33394 ACAAACAGCAATGCTCCAGCTA | 44378 |
| 10753 GGCAGAGTCAAAAGGAAGTCAAC | 22411 GAGTCTGATCATACCAGACCATCCTT | 33395 GCCCTTTGAAATAAGGCAGAGTCA | 44379 |
| 10754 TGCTGGACTCAGGGTTGAATATG | 22412 GAGCTCGTGATAACAATATCCCTTTG | 33396 TCCATAGGCTTGCTGGACTCA | 44380 |
| 10755 ACACCTGCGAAACACTTTATTGTAG | 22413 CACGCTTCAATTTTCTCCTGTTTTCA | 33397 GACACCACACACCTGCGAAA | 44381 |
| 10756 CCTGTCATTACCAGTGACTGCAT | 22414 GGAAAGTGGGAAACTTGAAACTGAGA | 33398 AGGTCACACTCTAGACCTGTCATT | 44382 |
| 10757 GGCATCCTTTGACCCATGATGAGA | 22415 CCAGCAGGACCCTGACTGTACT | 33399 GGGTTGGCTTGGCATCCTTTGA | 44383 |
| 10758 AGGACCAGGCCTCCTTGTTT | 22416 CAGGACCTGACATTAACCTTGGTTTTAG | 33400 AGCAGCTTTGTGGCCTGTA | 44384 |
| 10759 CCACAATGACCTAGCAGACCTT | 22417 GCATCTATGGGAATGGGAGCAA | 33401 GAAATACAGTGGAACCACAATGACCTA | 44385 |
| 10760 CCAGCTTCACCATTGGCTTTC | 22418 CAGCAAGGCGTTTTCCACTGA | 33402 GGCACGAATCATTCCAGCTTCA | 44386 |
| 10761 GTGTCTACTAATAAGTACCAGGGCAAA | 22419 GCCTGCTTGGTATCCCCTGAAT | 33403 GGCAGCTGCACTACAAAGTGTCT | 44387 |
| 10762 TCTGAAAGTACCCCATTCAAGTCAAG | 22420 CAGGACACAATTGGAAACACTGGTTA | 33404 GAGTCTGTATCTGAAAGTACCCCATT | 44388 |
| 10763 GTGGTCATTTCCTCAGTGCCAGAA | 22421 CTGCCAGCTACTAAGTATGTCTATGCTA | 33405 GGACCCCATCCTGTGGTCATTTC | 44389 |
| 10764 GGTTTTGCTTCCAAGGGACTGT | 22422 GCCTAAGAGCAGGCATGCAA | 33406 CCTCCCTGTAGCTTTGAGGTGGTT | 44390 |
| 10765 GGCATATTCAGCACAATCTGCTTTAC | 22423 GGCAGCTGTGGTAGACCTTTGT | 33407 GCTAAGAGAAGCCGTTTGGCATA | 44391 |
| 10766 GCCATGAGTTGATGATTGCGAGGAA | 22424 CCATTAGTGGCTCCATACCCTTCA | 33408 AGGGAGGTGCCATGAGTTGA | 44392 |
| 10767 GCAGCAATGCCCAGGTACTACA | 22425 GCCTGAAGCCATCAAGTTTCAGGTTTA | 33409 GCCCTGAATAACTGGCAGCAATG | 44393 |
| 10768 CTTGTGGGGTCTGGAATTTGGAT | 22426 CTGGGGACTGGTCGTATAGGTATC | 33410 GCTGAACTCCCGCTTTCCTTGT | 44394 |
| 10769 TGGTCCTGGGTGTAGTCTGGATTC | 22427 GGCCATGGACCTTTGGCAAT | 33411 GGACTTCATTGGTCCTGGGTGTA | 44395 |
| 10770 GGAGGCACAAACATGCATTCAGA | 22428 GAATGTGGATTTAGCTTCTCCCTAGA | 33412 ACTCTGCAGGAGGCACAAAC | 44396 |
| 10771 GTACTTGTGCTTGGATGTTTGCTA | 22429 CACCATGAGTTTGACTTTGTACCTGAT | 33413 ACTTACTGTGTACTTGTGCTTGGAT | 44397 |
| 10772 TGGGAGTTAAGAGTGAGTGGAATG | 22430 TTCCTGACTCCACCGTCCTT | 33414 GGTGACCCTCTTGGGAGTTAAGAGT | 44398 |
| 10773 CCAGAGCACACAGCTTCACAAC | 22431 GGAGAAATCTCTGTTTCTCACCATGACTCT | 33415 GTGGAAATACCCAGAGCACACA | 44399 |
| 10774 TCTCACCGATGTTGGGCTCTA | 22432 TTCCCTCACCCTCAGGGATCTT | 33416 GCAGCACGTATATCTCACCGATGT | 44400 |
| 10775 GACACAATGCTGCGTGTTGCTT | 22433 AGGGCCAGAGGTGCGCAAA | 33417 GGCAGGGCTAATTTGACACAATG | 44401 |
| 10776 GAGTGAGTGAGGGTGGGAAGTT | 22434 CAAGCTGCCCCTACTACAACA | 33418 GAGGAAAAAGGTACAGAGTGAGTGA | 44402 |
| 10777 TGCCCAAAGCTCCTGCTAGT | 22435 AGCCAGTGGGAGGAGCAGATA | 33419 ACACAACGTCCTGCCCAAAG | 44403 |
| 10778 CAGAGGCCTGAGTTTGTTAGTTG | 22436 TGTCACGGAAACTATCACCTTTGA | 33420 TTCCTCCAGAGGCCTGAGTT | 44404 |
| 10779 AGGCCAGCCTCCACACATACT | 22437 GGGACTAAAGCCTGAGAGCATGAGA | 33421 CCTGTGGGCCCAGACTTCA | 44405 |
| 10780 GCCATTTTGAGAGCTGCCCTAT | 22438 GTGAGCCACCTGCATTTTCTTAC | 33422 AGCCAGCTGCCATTTTGAGA | 44406 |
| 10781 CCCACACAATCACACCTTACCTTTC | 22439 AACCAGGGGACCAGGATATGT | 33423 CCTGAAAGCCCACCCACACAAT | 44407 |
| 10782 GGGACTTCTGTTTCTCAGAGTAGTTC | 22440 GGGTGAGGTGTCCTGGTCTGT | 33424 GGGTAGTTCAAGGGACTTCTGTTTC | 44408 |
| 10783 TGAGAAGGCAGGAGCAGTGATA | 22441 CTCATTCCCTCTCTCCCACCTAAC | 33425 GCTTCAGCAGTGGCTAAGAATGA | 44409 |
| 10784 GGGTCTGTATAGCCCCATTTCACA | 22442 GAGCCAAGCCATGACACACT | 33426 GGTCGCTGTCTCATAGGGTCTGTA | 44410 |
| 10785 GGATGCACTTAATTCGCCCAACAA | 22443 GGAGGAGCTTCCTGATTGGTAT | 33427 GGGAGCTATGCAGGATGCACTT | 44411 |
| 10786 GCAAGTTTTGGCTTGAGAGCTT | 22444 GCACATGAACTGCCACGTCCTA | 33428 AGCCCACCCACTCTCACTTA | 44412 |
| 10787 GCACTGTCTGCTTCCTTCTAGACT | 22445 GGTGGTTGTAGCTGTGATTAACAAGA | 33429 CGCCTTGAAGTTAGATGCACTGT | 44413 |

FIG. 36Q6

| | | | |
|---|---|---|---|
| 10788 GCGGGCAGTGATCATTGGAA | 22446 TCCTTCTTCAGTCCTGTTGAAAGTAG | 33430 AACTGCTATGCGGGCAGTGA | 44414 |
| 10789 GGTGAGGGTGAAATCAATAGCAGAAG | 22447 ATCCTCAGGGGCTCCAGGATCT | 33431 GCAGCTAGAGAGGTGAGGGTGAAATC | 44415 |
| 10790 CACAGACCCAAAACGCAACACA | 22448 GGTGGAGACCAGTAGGTTTTATTGT | 33432 CCCTTGTTCCTTATCTCACAGACCCAAA | 44416 |
| 10791 GACCTCCTGGATTTTCTCCCTTTG | 22449 CCAGGAAAATATCAGGCTCAGTTTCA | 33433 TCCCCAATTGACCTCCTGGAT | 44417 |
| 10792 GCATGGGAGGGGTAGTCTATTAGCAA | 22450 GGTGAAATGTAAGCTCTCTGGTTCTTTC | 33434 GTGGCATGGGAGGGGTAGT | 44418 |
| 10793 GTGGTGGTTAGGACAGTTGAACCAA | 22451 GGGTGCTGAAATGGTTGGAATGAGT | 33435 GCATCTGGGAAAGAAGTGGTGGTT | 44419 |
| 10794 ACAGCTACCCCTCCCATTACA | 22452 GGCCCAGCCTATAAAACCACAT | 33436 ATGTCAGAGGTCTCCACAGCTA | 44420 |
| 10795 GGACAGTTGTTGACCTAGGCTGCTA | 22453 GGTTAAAAACATGGGCCTTAGAGTCA | 33437 ACCTAACAGAGCTGGACAGTTG | 44421 |
| 10796 GGGGCAGACTGAGTGTATAGGAA | 22454 CCCACAGCTAGGGCAATCTGA | 33438 AGAGCTTGGGGCAGACTGA | 44422 |
| 10797 GCCACATGACAACATGTAGCTGGAA | 22455 GCAGAGGGCACTCATAAGTCAGT | 33439 CCCACCTTGCCACATGACAACA | 44423 |
| 10798 CCTGACTGGGTCAGCTTTCAA | 22456 GTCCGGGGACACATTCTAGTTTC | 33440 TGTAACGTGGGTCCCTGACT | 44424 |
| 10799 CCTGGTTTCCCCTTCATGCAAA | 22457 CTAAAGACCTAAGCCTGTTCACATCT | 33441 CCTGGTTTGGGTCACCTGGTTT | 44425 |
| 10800 GGAACACAGGACTGGTTCAGAAA | 22458 GTGCCACCTTACTGGCCAAAGA | 33442 CACCAAACCTAGCATGGAACACA | 44426 |
| 10801 CCGCTCTTCAGAGTGACTACCCTAAC | 22459 CCAGCTGCAGATGAAGCTCAA | 33443 CCAAGGCTAACAATTCCGCTCTTC | 44427 |
| 10802 TGGTCCTTGTAGATGGGAAGACA | 22460 GTAAGTCAAGTCACACCAATTCCTTAC | 33444 AGGGGCTTGATGGTCCTTGTAG | 44428 |
| 10803 CCAGAGGACTTCAGCCAGTTGT | 22461 CAGATCCCAGTGTTCTGAACTTGA | 33445 GGTTTATTTAAAGCCCCAGAGGACTTC | 44429 |
| 10804 CCTGGCCCTCATAGGGAGATAGA | 22462 GCCTGTACCACCTCCTGCTAAT | 33446 GTATAGTATTGTACCTGGCCCTCATAG | 44430 |
| 10805 CTGGCTGCGTATTTTGGCATGT | 22463 CTGAACATGCACCCGAGACAGA | 33447 TAGGTGGCTGGCTGCGTAT | 44431 |
| 10806 GGCAAAACTGTTATGGTGACAAGACAGA | 22464 AGCCAGGCCTCCTGTTCT | 33448 AGGGGCTTGGATCCTGGCAAA | 44432 |
| 10807 GGGGCACAAAATGCACCACAGA | 22465 GCAAGCCCCATCAACCATCT | 33449 CGGAGATCTCTGGGGCACAAAA | 44433 |
| 10808 TGGATGGAGTTCACCACTCAATG | 22466 GATGCCTCAAAACGCCTCATAGAT | 33450 CACAAAGATGCCTTATGGATGGAGTTC | 44434 |
| 10809 CCCCGGTTTTTCACAGTACAGA | 22467 GAGTCAATGAATACTGCACCCTCTT | 33451 ACACGCCCCGGTTTTTCA | 44435 |
| 10810 CCAGACAGACGCCTTCCAGTT | 22468 CCCAGGGAATCTGCTGGAATGTAG | 33452 ACAAGCCAGAGACCCAGACA | 44436 |
| 10811 CAGCCTCAAAATATATTCAGGGACCATAC | 22469 AAAATGGACCCTAACTGCCAGAA | 33453 GGCAACCTTTGACAGCCTCAAAAT | 44437 |
| 10812 GCGTGCTCCAACCAGTCTTG | 22470 GGATCCCTGCCTCTAACTCTGA | 33454 AACTGAGTGCGTGCTCCAA | 44438 |
| 10813 CGTGTGCAATCTGGAGCATGT | 22471 GTTCCAGAAATCTATGAGGCCATGA | 33455 CCTGAGCACGTGTGCAATCT | 44439 |
| 10814 GGGTTCAAGTCCTCATCGTGTCT | 22472 GGGAAGGCCAGAGAGTAAGCTACA | 33456 GCTTCCCAAGCATGGGTTCAAG | 44440 |
| 10815 TCTGTGTCTGACCTTTCACTTTTCT | 22473 GATTGGAAGGACATAGGCAGTTCA | 33457 GCCCCTGGTTCCTGTTTGTTT | 44441 |
| 10816 CGGTACAGTGAGTTTCTGCATAGATTT | 22474 GTCCCTTGACAAAGTTCCCCTAGA | 33458 ACCAATTCGGTACAGTGAGTTTCT | 44442 |
| 10817 CCTGCTACTAAAGTTACTCTCCCATTG | 22475 GAGAGTCTGGGAAGGCTGAACT | 33459 TGGCCACAGCAGCACTAATTC | 44443 |
| 10818 AGTCCAGGGAAAGCATTGATGATAG | 22476 CACTATTTTCCACACTGAGGGCATCT | 33460 GACTGACTTAGTCCAGGGAAAGCAT | 44444 |
| 10819 ACCCATCCCACAAAACCAGATG | 22477 CGTAGAACCAAGCCTGAGATATGA | 33461 GACTTTTCAAAACCCATCCCACAA | 44445 |
| 10820 CCGACTGTCCAGCTTTTTCGTAAG | 22478 TCGAGGAGCCCAGCACATCTA | 33462 GACTTTTCCGACTGTCCAGCTT | 44446 |
| 10821 GGAGCATCTTTTCCAACACTATGAATC | 22479 TGATGTCTTTGGCAGAGTGTTTTAC | 33463 GTCACGCTTGGAGCATCTTTTC | 44447 |
| 10822 ACCTAAGCCACAGAGTGCTTATC | 22480 CTAGGCCTCAGCATCAAGCAT | 33464 GCAACCTGACAGCAGCTCTA | 44448 |
| 10823 CCCAACTGTGTTCTGCCTACAAG | 22481 CCCTTGTAGCCTATGTTTATCCTTGA | 33465 AAAAGCAAGACCCAACTGTGTTC | 44449 |
| 10824 CTGCAGGCAGATCATCCCAAT | 22482 CCCAAACTGGGTCTCCTCTTTGAT | 33466 CTGCAGTGGGTAGCTCCTTTCT | 44450 |
| 10825 GGAGTAGCAGGTTTCCGTGATG | 22483 CCCACCTCCCAGACAGCATTT | 33467 TCCCCTTGGAGTAGCAGGTT | 44451 |
| 10826 GACTGGAACAGGTAAGGGGAAAG | 22484 TTCACATTACTCGCAAGGTCAGT | 33468 CACCTCTAATAGAAGACTGGAACAGGTA | 44452 |
| 10827 TCAATTCAGTCTTCCTGAGTGCAA | 22485 TGATGACCATGCCACATCTGTAA | 33469 GTCAGGACTGCAACACACTCT | 44453 |
| 10828 CCACAGTCAGTCCAGTCTCCAA | 22486 GGGGAAAACAGTGACAAGTCACGAA | 33470 TCAGGCTGCCACAGTCAGT | 44454 |
| 10829 CTCATAGCCAGGATTCACAGATCCAT | 22487 GAGTGGTGCCACTTCTGCTTCA | 33471 GGTACTATTTCTCTCATAGCCAGGATTC | 44455 |
| 10830 GACAGTGCAGGATTGAGTAAATGCAA | 22488 GCACTTGGGAGAGGGAAAAATGCAA | 33472 CTGCTATGACAGTGCAGGATTGA | 44456 |
| 10831 GCAGGTATGCTGGCTGGTGAAA | 22489 CCCTCATTTGTAGGTCTACCCTGAT | 33473 GGGTTAGTTTTCATGCAGCAGGTATG | 44457 |
| 10832 GACAAATGGCTTTGCATATCCCCATAC | 22490 CCCTGCCATGTTGCCAGATA | 33474 GTCTGCCAATTAAGACAAATGGCTTTGCAT | 44458 |
| 10833 ACCAACGGGAAATCCCAGTTAATC | 22491 GGGCTCGGACTCTTGGCATCTTC | 33475 GGCAGAAAACACCAACGGGAAATC | 44459 |
| 10834 GCTCCAGGCTTGCTTAGGCTAGAA | 22492 AGGAGCTACCACGGGGTATGAA | 33476 TCTCGCTCCAGGCTTGCTT | 44460 |
| 10835 GCTTGGAAAGGCAGTAGGAAAGTGT | 22493 GCTTTCCCCTTTTCCTGAAAAACCAA | 33477 CACTCAAAGTAGCTTGGAAAGGCAGTA | 44461 |
| 10836 TGGCCATGAAAGGAGGTACAATTC | 22494 CAGCTGAGATCATTCTGCCCTTCAA | 33478 GCGTAAGTCCAATGGCCATGAAAG | 44462 |
| 10837 GCCGTGTGTTTCCAGAGCTT | 22495 ACAAATCCTAACACAGCACGTGAA | 33479 CCCTAGTTTGGGCCGTGTGTTT | 44463 |
| 10838 GGGACTTATTGTAGCCCCTTAGTCA | 22496 CTGTTTTCGAGCAGCTAGGGATT | 33480 GGGGTGAGTAAGGGACTTATTGTAG | 44464 |
| 10839 ATAGGAGGTGCGGGCAGATTC | 22497 TGGAATCCTTTCCCCTGTAAGATAAC | 33481 ATAGGCCCAGTGGCCAGGATA | 44465 |
| 10840 AATGTGATGAGGAAGTGGCATCT | 22498 GCCAGACCACTTCAGGAACA | 33482 GTGCAGCAAGAATGTGATGAGGAA | 44466 |
| 10841 GGAAGGGATTAAGTGGCAGGTT | 22499 CTGTTAGAAGGTTTCCTCTCATGGTT | 33483 GAGGGTTGGTTGGAAGGGATTAAG | 44467 |
| 10842 GCAGACACTGATATCCCCTACCCATT | 22500 CCAGCTGAATGCTTGGAGATGTT | 33484 GGCCTTCTCCTACATGGCAGACA | 44468 |
| 10843 CTCCCTCAGCTAAGCTATACAGTCAGT | 22501 CACTGCAGAGAAGTTTGGGCTTT | 33485 GGTCTCCAGATCTCCCTCAGCTA | 44469 |
| 10844 CCTCCAAAGAGTCTGTCCACAATGA | 22502 GTGAGATGACTCACCCTTTTTGCTTAG | 33486 TGCCAAACTGGCCCTCCAAAG | 44470 |
| 10845 GCCAGCACCATGGAAGAGGTA | 22503 CTGTGGGCAGTCAGTTTTTCT | 33487 GTTGCCAGCCAGCACCAT | 44471 |
| 10846 GTCATGGAATCCTCTTCTTTAGCCATA | 22504 ACCTAACCCTATCTCAGCTGTTTTC | 33488 GCTGATGAAGTCATGGAATCCTCTTCT | 44472 |
| 10847 ACTCCACCAACCTGCCCTTTG | 22505 CAGATACAGAGATCAATTCCAGCTAGT | 33489 GCTTGCACCACAACTCCACCAA | 44473 |
| 10848 AGAACCGTGGTCTTCAAATAGCAT | 22506 GCGTCTCAGATGGGTTTTATGTAACTCT | 33490 GTAGTTTTGTTAGAACCGTGGTCTTC | 44474 |
| 10849 AGCAAGAGTTGAGGGGCATTG | 22507 GCTCCTCTCTGAAGTTGGGTTT | 33491 GGTGGTCTGAATATTAAGCAAGAGTTG | 44475 |
| 10850 CCCACTAACAGCGCCAAGTT | 22508 GGCCTGAGGCAGGTTTGAGTT | 33492 CCCACAGTGCCCCACTAACA | 44476 |
| 10851 GACTCCTTGGCTTTCACAAAGAGA | 22509 TACCCAGGAAGCCGCCTGAA | 33493 GGCCTTTTGACTCCTTGGCTTT | 44477 |
| 10852 CAGCCGTGCATAATTTGGGTGTAG | 22510 AGGCTGCCTAGGGGCTATTT | 33494 CTGGCCAGCCGTGCATAAT | 44478 |

FIG. 36Q7

| | | | |
|---|---|---|---|
| 10853 CCCTCCTGTATCTCATCCCCATTC | 22511 TGGGGAGGAGGGACTCTAGTTT | 33495 CCTTCTGCCCTCCTGTATCTCA | 44479 |
| 10854 CACCATGCCATTTTGCTGTGA | 22512 AGGTGCCAGAGACTGCAGAAAC | 33496 CGACATCCTTCACCATGCCATT | 44480 |
| 10855 CAGACATGAAGCTCACTGAAGGTGTAA | 22513 CCACTGCACCTGGCCTATCA | 33497 TGAAGCAGACATGAAGCTCACT | 44481 |
| 10856 GCACAGCTAACATACTCAGTGGTGAA | 22514 TCCTTGTCATGTTCCTTCCTCTTTT | 33498 ACACATACGCACAGCTAACATACT | 44482 |
| 10857 CAGAGCCTTTGCTCATCCCACTAC | 22515 CAGATATCCATGGGAATCAACAGTTTC | 33499 GTACTGACCTTGCAGAGCCTTT | 44483 |
| 10858 GTGAATCCAGCGGGTTACAAG | 22516 TGTGCTTTCACTTCCTGGAAACTT | 33500 GCTGGAGGTGTTGTGGTGAATC | 44484 |
| 10859 GCACGTGCTGGTGCTCAGA | 22517 GCCCCAGTTCAAAATCTCTTGTCA | 33501 CCCTGGCTTTGGGTTGGTGAT | 44485 |
| 10860 CCCTACTCCCAGCCAATTTCCAT | 22518 GGAAGACCAAAAAGGGATAAAGGTTGA | 33502 CCAGCCTCTTCTAGCACCCTACT | 44486 |
| 10861 GTCTACACACACAGCCTCACTATG | 22519 GCCTAGAGGGGTGGAAAGCAAAG | 33503 CACAGAGCAGTCTACACACACA | 44487 |
| 10862 GGCACATACTGTACTCTTGCATGTTG | 22520 TGCGTCTGCATGGGTGGTTT | 33504 GGGTGGAGGCACATACTGTACT | 44488 |
| 10863 CCTAATCCACGATCTCCTCATCTGT | 22521 GACAGCCCTGTGACGTAGGAAT | 33505 GGCACTGCTTCCTAATCCACGAT | 44489 |
| 10864 GCAATTCCCTGAAGATACCTGCTA | 22522 GAGAAACAGTAGGGTCAAAGGAACAGA | 33506 CCTTGACCTTTGCAATTCCCTGAA | 44490 |
| 10865 CGGGTACACAATTGTCCCCAGTT | 22523 GGAGCAAATTTGGTGGATTAAGGATAG | 33507 TGTCCCCTCGGGTACACAAT | 44491 |
| 10866 ACTTGGGCGAGGTGGCTAAG | 22524 CGCTCCTGCCGCAAAACTCTA | 33508 GGCTACAGGCCTGGCACTTT | 44492 |
| 10867 TCACTGGTATGTCTGGGAAAGTTG | 22525 TGCCTCCACCTTGCTGCTA | 33509 GGTTTCAAGCCTCACTGGTATGTCT | 44493 |
| 10868 GCACCCAAGTGGAGAGGGTAAATC | 22526 GAGCAAAGAGGTTAAGGTCACAGT | 33510 GAAGGACAGTGCACCCAAGT | 44494 |
| 10869 CCCAAGAAGCTCTCTGTGCTATG | 22527 GGCACCTGCAGACCAGTTCTT | 33511 GGGCTAAGGCTCCCTACACAT | 44495 |
| 10870 GCTCCTGCACAAGCACAGATG | 22528 CGATCCCCTTGGTGTGAGAGTTG | 33512 CCTGTTAGCTTTGCTCCTGCACAA | 44496 |
| 10871 CTGAACACCTCCTTGAGTACAGTTC | 22529 CCTAGGATAGCCCATCGCTGATGTAG | 33513 CCTTGGATCACTGAACACCTCCTT | 44497 |
| 10872 CCCAGTTTGCAAGAAGCATGAAAG | 22530 CCCTCCAAGGACGTCTTCCCTAA | 33514 GCCTGTAAGACTTTAACCCAGTTTG | 44498 |
| 10873 GGTTATTCCGTGTTCTTGATCTTGCTT | 22531 CTTTGTGTCTCAGGCTCACCAT | 33515 GCACCTCTGTGGTTATTCCGTGTTC | 44499 |
| 10874 GCAGTGGCAGAAGGGCATTTG | 22532 AGTCCCGCCTCCTCTATAGTCATC | 33516 CCGGATAGGCAGTGGCAGAA | 44500 |
| 10875 CTCCTCTAAGAAACTAAGGGCAACA | 22533 GCCAGGGATAGCTAACAATGACA | 33517 CTGCAAACTCTTTCTTCTCCTCTAAGAAAC | 44501 |
| 10876 CGCTAGGTTGTGTACTGGGAACA | 22534 GTGGACTCCTCTAGGTCAAGCTATTTG | 33518 AGCCGTACGCTAGGTTGTGT | 44502 |
| 10877 GCCCATAGCCTTGTCCCCATTGACTGTT | 22535 ACATCATGTGGATAGAATGGGGATTAG | 33519 GTATCCAGATTGCCCATAGCTTGT | 44503 |
| 10878 CCCTAAGCTTTACCTTAGATGGAGAGAAAG | 22536 CCAGCCTGAGGTTCCTTCAGAT | 33520 GAGGATCAGGAACCCTAAGCTTTAC | 44504 |
| 10879 CACACTGGAACCAAAGACCTTTATC | 22537 GCGAGCTATCTTGCAGGCTAGTAA | 33521 AGTTACCCACACTGGAACCAAAG | 44505 |
| 10880 GGGCTGAGTAACAAGAGTGGTTCT | 22538 AAGTAATGCAGGATGAGTGATGGAT | 33522 AGAATCTTGTGGCGTGAGTAACAA | 44506 |
| 10881 GGTTTCCCTGTAGCTTAAGAACCAT | 22539 GGGGTGGCTCAGAAACCCTTT | 33523 CCCTCTGTATAGGTTTCCCTGTAGCTT | 44507 |
| 10882 GGTGGAGAATGCAACATGCAGAA | 22540 CTCTACTGAGAGACAAGCAAAGTTTCA | 33524 GCTAGGCTATGTAAGTAGGTGGAGAATG | 44508 |
| 10883 ACCAGTGGGATTGATGAGACAAAA | 22541 CGCCCTACTTCACTTGTTTCTTG | 33525 GCCCCTGTATTCTAACCAGTGGGATTG | 44509 |
| 10884 CCACAGAGCCTAGCAAGGTGTT | 22542 GGGAGGCTATCCAACCACTAAGT | 33526 AGAGCACAGGGACCACAGA | 44510 |
| 10885 CCCTTCTGTGCAATGGGACTTG | 22543 CCCCACCCCTGCCCATCTTAC | 33527 CAGCTTCCCCTTCTGTGCAA | 44511 |
| 10886 TGTTGGCTTCTGCAGTGTGA | 22544 TGGGCTCCCACACCTGTTTC | 33528 AGGACCTTTCTGGCATGTGTTG | 44512 |
| 10887 CCAACTGAGAACTTGCTTCCCAAAAG | 22545 GGCTGTGAAGAAGCAGTCAGGAT | 33529 GCCACAACCCTACCAACTGAGA | 44513 |
| 10888 CTGCCCAGGCTTTTGACTTTTG | 22546 CCTCAATGAATAGTTCCCACCTCAA | 33530 AAGGTTTCTGCCCAGGCTTT | 44514 |
| 10889 GTGAAAGCTAGCATCTGGGGTTT | 22547 CTTTAAACTGGGATCGCTACAGAAAAG | 33531 GCAAAAGTACTTGCCATTGTGAAAGCTA | 44515 |
| 10890 CAAAATCCTGGGGATACAGACTCTT | 22548 TGCCCAGGCAGAGGGAGCAA | 33532 CCTCTGCCCCAGCATATATCAAA | 44516 |
| 10891 GAACCCACTGGAATACCTCCTT | 22549 CCCAAAGTGCCTTGTTTTCTCTGATAC | 33533 CACACCCAAGAACCCACTGGAA | 44517 |
| 10892 GACATGATCTGACCCTTGACACA | 22550 GGCTGCAGCAGAGTGAATAAGA | 33534 GCCCAGAGGCTTGACTGATCT | 44518 |
| 10893 AGGGAGCTTAGAGGAAGCTCAA | 22551 CACTCTGACAGTGAGGTTCTTGGTA | 33535 GTCATTGCCCTCAAAGGGAGCTTAG | 44519 |
| 10894 CAGCCACATTCCAGAGCCAATC | 22552 GCCATCTCCTGCTGGGTTACT | 33536 CTAGCCTCTCTCAGCCACATT | 44520 |
| 10895 GTGTGTGTGGGCTTTATGAAGAAAA | 22553 TGCATACAGCATACTCTGTTCACAT | 33537 GCTCACAGTGTGTGTGGGCTTT | 44521 |
| 10896 GAAGTGAAGAAGAGTGGTCAGCTA | 22554 TCCTACAGGCCCCTGAACTT | 33538 CCTACTTTTGGGAGGGAAGTGA | 44522 |
| 10897 ACCATGGTTTCCTTGTCAGCATAA | 22555 CCGAAAAGAGGTAGGCAGAGCTAAT | 33539 GCCCCTTGATTCCTCTAAACCAT | 44523 |
| 10898 GAAATCAGCTTCTCTCTCACTCAGTT | 22556 GTGATTGGGCACAGAACTCTCTA | 33540 GAGCCCTGAAATCAGCTTCTCTCT | 44524 |
| 10899 TGTGGTAGAAGAGTTGTCTCCATTG | 22557 CTGAAGGTAGGTCAGATCAAGCAA | 33541 GGTGGTTCAGTGTATTGTGGTAGAAG | 44525 |
| 10900 GCCTAGCTTCAAGAGCTCCTTCT | 22558 ATTCCAGCCAGCCACCAATG | 33542 GGCCTGTGCCTAGCTTCAAGA | 44526 |
| 10901 GTGGCTTACCCACCAGCAAACT | 22559 ACTGTCATGTGTCTCTCTGCTTTT | 33543 AACGGGCAGCAGGTGGCTTA | 44527 |
| 10902 CTGAGTGTTCTGGGGCTAGTTT | 22560 GCCTTGCACCACTACACAGAGA | 33544 GAGGCAAGCCTGAGTGTTCT | 44528 |
| 10903 CAGAGGGCTAGTGTATCTCCAAGA | 22561 GGGGAGTATTACAAAGACCTAAGGAGGTA | 33545 TCACCCATCAGAGGGCTAGTGT | 44529 |
| 10904 GTCTCTGGGCTTAATGTGCAAGT | 22562 GCAATGTGTACCGGTTCTGTACT | 33546 TCCCAGCTTGTCTCTGGGCTTA | 44530 |
| 10905 CACAGTGGACTTGTTTGTTCTTGAGT | 22563 GGGTCTGTTCATCACTCAATCATTC | 33547 CAGATTCTGACTCACAGTGGACTTGTT | 44531 |
| 10906 GCTCCATTTATGTTCCCATTGGTCT | 22564 GACACTGCCTAGCCTTTCTCATTG | 33548 CCTGCCACCTTGATTGCTCCAT | 44532 |
| 10907 GCTTATTTGGTAACGACTAGGCAGAT | 22565 TGCTGGGCTGTGGATTGCTA | 33549 CCACATACATTACCGTCTGCTTATTTG | 44533 |
| 10908 TCTCCAGAGCCTTTGCTTCCTA | 22566 AGCCAAGAGGAGTTGGGACTTG | 33550 CGAACCCAAGCAGTCTTCTGTCT | 44534 |
| 10909 CCACCAGCATTCAAGTGCAATGTA | 22567 GCACTCACAGAAGGGCACGTAA | 33551 GCTAGGACATCCACCAGCATTCA | 44535 |
| 10910 ACCTTCCAGGTCTCAGCTCTCT | 22568 GCTGGTGGGAGAGGAGTATAGAT | 33552 CTGTGTTTGCCATGGACACCTT | 44536 |
| 10911 CACCCTTGAGACAATGGGTTGTAG | 22569 GACCCACTGGGAAGGTATGGTA | 33553 GCCCTCAATCACCCTTGAGACA | 44537 |
| 10912 GGACATGGAAAGATTGGGACAGGTT | 22570 TCCTATGGGTCCCATCATTTTCT | 33554 GCTGGCTGAATAGGGACATGGAA | 44538 |
| 10913 CCAGTGTCAGCTGGGTTTTGT | 22571 CATTAAACTCAGTGCTGTCCTGTTAG | 33555 TCCTTCCATGGGCCAGTGTCA | 44539 |
| 10914 AGGTAAAGGGTGGAAAAAGACATC | 22572 GTGTCTGATATTCCTGCTCACTTTG | 33556 CACAAACTTAAGGTAAAGGGTGGAA | 44540 |
| 10915 CCTTCTAACACCCCTTCTCTGTGAGAT | 22573 CATTCCCAACGCATCCTAGATA | 33557 AGAGTTTCCTTCTAACACCCCTTCT | 44541 |
| 10916 GAGTGAAGACCAGCAGACAGAAG | 22574 GGTTAGCTTCAGTTGTTGGGAGTA | 33558 GGAAATGATCCACCATGAGTGAAGA | 44542 |
| 10917 GGTGGAACCAAAGAAGAAAGGGTTT | 22575 GCATCTCAGCCCTTTGGGTTTG | 33559 TTTGGACAGGTGGAACCAAAGA | 44543 |

FIG. 36Q8

| | | | |
|---|---|---|---|
| 10918 | GCTGCCACCTAGGAAACAAAGT | 22576 | CCTAGCCCTATGGCAGAGTTTTC | 33560 | CCAGACCAAAGCTGCCACCTA | 44544 |
| 10919 | GGGGACATCGTGGTCTTGCAT | 22577 | AACTGTTGCCCTATCCTCCATTAC | 33561 | GGAGAGGGAAGAGTGGGGACAT | 44545 |
| 10920 | GCCACTTGCAAAGAACACTTTTGT | 22578 | CTGGTTGTCTTCATGGGATTTCCTTA | 33562 | GACGTCTAAATTGTTCTTGCCACTTG | 44546 |
| 10921 | GCCTTTCTGCCTGGCTCTTG | 22579 | CAGCCCTGGAGGAGTTCTGA | 33563 | TCCTTTTCCTTGGTGCCTTTCT | 44547 |
| 10922 | GGACCATTTAGACTCACTGCCATCA | 22580 | CCAGGGTGCTGGAGACATTT | 33564 | CTATTTCACCTGGACCATTTAGACTCA | 44548 |
| 10923 | ACCCGTGTATTATGACTTTCAGAGTTC | 22581 | CCAGAGGATATCCCACAGTTCATCTCA | 33565 | GCCCCACCCGTGTATTATGACT | 44549 |
| 10924 | TGGGGAGGTAACCAAATCTTTTGA | 22582 | CCACATCAACACTATTATCCCCAATTC | 33566 | ACGAAGCCTTGGGGAGGTAAC | 44550 |
| 10925 | CCAAGGACTTGGGACGACTTT | 22583 | CGGCCTGAAATTTCTTTACAACCAT | 33567 | AGGGCTGGCACCCTACCAA | 44551 |
| 10926 | GACGTTGCTGTGTCCTTTGCTT | 22584 | CAGCCTGGTGGACACCTTGATT | 33568 | TGGCTATGACGTTGCTGTGT | 44552 |
| 10927 | GCCACTGGATAGCATCATTGGATCT | 22585 | GTCCGAGCTGTTCTGCCTTTTG | 33569 | GGCTATCTGCCACTGGATAGCAT | 44553 |
| 10928 | CCGCTTCCATAACCTGGAGATACCTA | 22586 | GGAGCCTCCTACATACATCATTCCAA | 33570 | CCTGACCTACCGCTTCCATAAC | 44554 |
| 10929 | CCCCTCTATTCAAGGCTATGTTGT | 22587 | CCAGGAGTAAAATCAGGGAATCTGAGT | 33571 | TGACACTTTGTTGTCCCCTCTATTC | 44555 |
| 10930 | CATGCCGAACAGCCTTCTTTC | 22588 | ACACACTGTGACATGATGGGATT | 33572 | GGACAAAGCTCATGCCGAACA | 44556 |
| 10931 | CCTGAGGGGAGGTAGGAGGAAAAA | 22589 | TCCACTCTGACTCAGTCTTCAGTA | 33573 | CAGTTGCCTGAGGGGAGGTA | 44557 |
| 10932 | TGAAGCCTCAGATCCTAGAGTCA | 22590 | AGTGACTTTGGGGTTCTTCTTG | 33574 | TTTCCTCATTTCCCAGGCTTGAA | 44558 |
| 10933 | GGGCATCTAACAACTACCCATGCATTT | 22591 | CTGTCTCTGGATCCTGTAGGT | 33575 | GGGAACTTTGGGGCTCTAACAAC | 44559 |
| 10934 | GAGAGCCATCACATTCTGGTCTTC | 22592 | GCCCAGACAGCAAGAAAGGAAGT | 33576 | ACCTGAGCTGAGAGCCATCACA | 44560 |
| 10935 | GAATCCACCCATTCAAGGAAAGAAG | 22593 | GAACCCGCTGGCATTCTCTT | 33577 | TGGTAGGCAGAATCCACCCATT | 44561 |
| 10936 | GGCAGTAGTGCTCCAAATATGCTA | 22594 | ACAGGAAGGGCGGGAGTAG | 33578 | CGACATCCTCACGATGGCAGTAG | 44562 |
| 10937 | TGGCTACAGACAAGTGAGGATGA | 22595 | GACCTATTGAGGCTTGGGCAAAGT | 33579 | CCCCAGCTATTAACTACTTGGCTACAGA | 44563 |
| 10938 | ACTCAAAGCAAAAGAGGGACAACT | 22596 | ACCTACCTGTGGCCTGGAAGAT | 33580 | AGGTGGAGCAACTCAAAGCAA | 44564 |
| 10939 | ACACATGGGGTCTCAGGAACT | 22597 | GACAGAGCTGCAGCCAGTAAT | 33581 | GCCACCACTGAGGAACACAT | 44565 |
| 10940 | CCTCACTAGACCTTAACTGGGATGACT | 22598 | AGGCAGAGCACAGGGCCTAAAT | 33582 | GGCCAATGTCCTCACTAGACCTT | 44566 |
| 10941 | GCCATCCTTGCTTGTATCCTTCTCTT | 22599 | GAGCATGGCATGGACCTGGAAT | 33583 | GTGACAAAGCCATCCTTGCTTGTA | 44567 |
| 10942 | CTGAGTCACACAGTCCATTGAAAC | 22600 | AGCGCCACATGGCTGATG | 33584 | TCTCCACCAGCTGAGTCACA | 44568 |
| 10943 | TGCTGACAGCCCTCCTAAGCTA | 22601 | GCAAAGCTTGATGGTGGAAGAAG | 33585 | GAAAAGTTGTTTAACCCTGCTGACA | 44569 |
| 10944 | GCCTCCATTGTCTCTCTCCTGGATAA | 22602 | GGGAAGCAAGGAGAGCAGCTAGTA | 33586 | TCCAAGCCTCCATTGTCTCTCT | 44570 |
| 10945 | GGCCGGAGAAAGGTTTGGCATT | 22603 | GGCTCAGGGGCAAAAGTTGT | 33587 | GAACTAACTCAAGGCCGGAGAA | 44571 |
| 10946 | GCCACCAATTCCTTTGGATGATCTTT | 22604 | GTCACCAGGAAATGCACATCTTTT | 33588 | CCTCATATGCCACCAATTCCTTTG | 44572 |
| 10947 | TCCATTCCATGTTGGAGCAAAAC | 22605 | GCCCTGAAAATTCGTGCTATCAAATG | 33589 | CCACCTAAATTTGCTCCATTCCATGT | 44573 |
| 10948 | TGAGTAGGAATGGCAACAGCTAAT | 22606 | TGACAGGGGCTCTAGAAGTAGTAAG | 33590 | GTGGAGTAGACAGCAAATGAGTAGGAA | 44574 |
| 10949 | CCCATTCAGTGGGGTTTCGTT | 22607 | GGCCAACTTCCTGCTAAGGATTG | 33591 | GTGCAGTAAGCCCCATTCAGT | 44575 |
| 10950 | CGGCACAGATGGTTAAGAATAAGA | 22608 | GCTAGGCATTTTGCCAGAGGCTTT | 33592 | CACCTATATAATCGGCACAGAGTGGTT | 44576 |
| 10951 | GCATCAGAACTCATGACACTTGATTG | 22609 | AGAACCCGAGAGGCCTATCCAA | 33593 | CATGTTTCCAAACACATGCATCAGA | 44577 |
| 10952 | GTGGCATGGAAGAATCATGTGCTTAG | 22610 | GCTTTCCTGCTCTGGTGCTGAA | 33594 | GGGAGTGGCATGGAAGAATCA | 44578 |
| 10953 | ACCTTCTCATAGCCCAGTCTGT | 22611 | AACTGATCTGGCCTGCTAAAACT | 33595 | CAGGCTTCCCAACCTTCTCATAG | 44579 |
| 10954 | GCTCTTAAATAGCTCACACGCTAGT | 22612 | TGTGCTTAACCTCCTAGCCTCAT | 33596 | ACCCGTGGCATCTGCTCTTA | 44580 |
| 10955 | CGTTTGTGGAATGGCTCAAGATT | 22613 | GGTGATATTAGTGAAGCCCTCTGTTG | 33597 | CAGCAAAGAGACGTTTGTGGAATG | 44581 |
| 10956 | TCCCCACCTTGAGTGCTCAGT | 22614 | CCAAAGTAGCAAAAGGTGTCTGCATTC | 33598 | GCCCTTATCTCAATGATCCCCACCTT | 44582 |
| 10957 | GCTCTATACATTGTGGTGCCTGCAA | 22615 | GGATGATGCTGGCTAATGGGAGAAA | 33599 | ACCCCAGTGTTGCTCTATACATTG | 44583 |
| 10958 | GAGTATGGGATCAGGTCCATGTCA | 22616 | ACCTTGTCTCCCACTCCAGAT | 33600 | CTGGGTACCGAGTATGGGATCA | 44584 |
| 10959 | GGCAAACCCTACATTCTGTGTAAAAAC | 22617 | CACATGCATAGCTTAGCCAGTGA | 33601 | CCAGAAAAGGCAAACCCTACATTC | 44585 |
| 10960 | GCTGGTGACTGGTTCATCCTAGA | 22618 | CGAGAGATTGGCAGTCCCAGTT | 33602 | AGCAGTGAGGCCAGAAACTTAG | 44586 |
| 10961 | GCGTGCTAGCCAAACTGTTG | 22619 | CCCCATTCAAAGGGCTCTCAAG | 33603 | TGGATTCCAAACTTTGCGTGCTA | 44587 |
| 10962 | GGTTGGGAAGACTGTGGGACAA | 22620 | AGCCTGAGTAACCAGGGACTCT | 33604 | TGGTCTGTGGGTTGGGAAGACT | 44588 |
| 10963 | CCAAGTGGTGGCAATTACAGGACTA | 22621 | CACAGCCTGCTGCTAATTGTTC | 33605 | GGCTTCCAAGTGGTGGCAAT | 44589 |
| 10964 | TGGTCACTCAGGGTGGGTAAG | 22622 | GCTGCAGGAGTGAAACTAGGAACA | 33606 | AGGCAGGGGTGGTCACTCA | 44590 |
| 10965 | ACACACTCCCCACCCCAAAC | 22623 | TCTTCCAGAATTCCCTTCAAAGCAT | 33607 | TCGCCACTGCCACACACT | 44591 |
| 10966 | GCTTCCCACTCTGCCCATCAAT | 22624 | GTGAAAGCAGGTGGTCATACTCT | 33608 | AGTAGAAGATCAGCTTCCCACTCT | 44592 |
| 10967 | CACCACCGTAGATCCAAAGTGT | 22625 | CTGCAGGTAGCAGAATTAACTGACA | 33609 | GCCTATAGTGAACACCACCGTAGA | 44593 |
| 10968 | GGTGCTATTGCTCCCTGTTCA | 22626 | CTGTGCTCAGATCTGCATTGGAT | 33610 | CCATGTCCATTGCTAGGTGCTATTG | 44594 |
| 10969 | GAACCTCTCCTTTTACGGTGCAA | 22627 | CACTCATTTGACTTCCCGCTGTT | 33611 | CGACGGAACAGAACCTCTCCTT | 44595 |
| 10970 | CTCTCTGGCCAGGTGACATTGTAG | 22628 | ACAGGGATCCACTGGTATGATAAAGA | 33612 | GCTCACTGCAGCTTGCTCTCT | 44596 |
| 10971 | GCTCAAAACCGGCATTGATGTA | 22629 | CTGAGCAGGCTATTCCAGTCTGT | 33613 | GCCAATAGCTAATGCTACAAGTAGCTCAAA | 44597 |
| 10972 | TCAACCAACCAGCGGTCAGA | 22630 | TCGCCAAGGACCTAGGAACA | 33614 | TTCTCCATAGACGTGACCATCAAC | 44598 |
| 10973 | GAGTTTCCGTCACAACGTTCCTT | 22631 | CGGTGGTGCGCAAGTAGT | 33615 | GCAGCTGGAGTTTCCGTCACA | 44599 |
| 10974 | AGGGAGGGAGTTATTGTGCTACT | 22632 | GAGTTGTGCAGATGGGTTGAAAA | 33616 | CCTCAGCCAAGGGAGGGAGTTAT | 44600 |
| 10975 | GAAGCTGGGTTGAAGTGCTTTG | 22633 | CCTGGCATCACAGTGGCTACAA | 33617 | GCAAAATCTTAGAGAAGCTGGGTTGA | 44601 |
| 10976 | GGAGAGTTATCAATGAGCCTTCTGT | 22634 | AGTGCCCCACCCGGTGTTT | 33618 | GGTGTCCATGTACTAGAAGGAGAGTTATC | 44602 |
| 10977 | TGGCAAAGTGAGAACCTGCAT | 22635 | CCTTATAGTGGGTTCTGGGACTTAGTA | 33619 | GCTGTTTTTGAAGCTGGCAAAGT | 44603 |
| 10978 | CGTGTGTCCTGGAAGAGATGGAA | 22636 | GGGTAGCCCTGGGAATGCTT | 33620 | TGCTCACGTGTGTCCTGGAA | 44604 |
| 10979 | GAGAGACAGCAATTCTGGGGAACAT | 22637 | GAACCTCGCCTCATTGTGATTTC | 33621 | GCCCCATCTGAGAGACAGCAATTC | 44605 |
| 10980 | AGGGTTGGACTAGGGGAAGTGA | 22638 | AGCACCGGCAGGCGACTTT | 33622 | TAGGGCGGCAGGGTTGGACTA | 44606 |
| 10981 | GGTTTCTCCCTGAAATCGTGTGTGA | 22639 | CTCCAGAATTCTACGGAAACTGGAAGT | 33623 | CCAGGGTGGTTTCTCCCTGAAA | 44607 |
| 10982 | CTGCACCTTGGCAACACTTTGA | 22640 | GCTCTGTACTGGCCACTTTGTTC | 33624 | ATCACCTCTCCCTGCACCTT | 44608 |
| 10983 | GGACCCCAGGATTGAGGAGACAA | 22641 | CCAGCCTAGACCTAAACCCTTGA | 33625 | CAACTAAGATGGACCCCAGGATTG | 44609 |
| 10984 | TGCACATGCGCTCTTCTCA | 22642 | GTGATGCCAGACAGAGCTGACA | 33626 | CCTGTGCCTGCCTTCCGAAT | 44610 |

FIG. 36Q9

| Description | MAPPED_READS | TOTAL_READS | %Mapped Reads |
|---|---|---|---|
| gMother | 3,633,900 | 3,647,446 | 100% |
| gMother | 3,567,685 | 3,578,549 | 100% |
| gMother | 3,733,706 | 3,747,692 | 100% |
| gChild | 3,725,554 | 3,737,742 | 100% |
| gChild | 3,816,989 | 3,829,450 | 100% |
| gChild | 3,524,956 | 3,536,569 | 100% |
| 1 mother | 3,467,493 | 7,564,869 | 46% |
| 1 mother | 3,868,210 | 7,107,028 | 54% |
| 1 mother | 4,918,140 | 7,613,240 | 65% |
| 1 child | 361,390 | 6,507,434 | 6% |
| 1 child | 1,885,864 | 6,496,348 | 29% |
| 1 child | 2,789,647 | 6,259,288 | 45% |

FIG. 37

| Description | MAPPED_READS | TOTAL_READS | %Mapped Reads |
|---|---|---|---|
| case 1 blastoceol | 68,123 | 8,470,872 | 1% |
| case 1 cell 1 | 4,340,613 | 8,248,598 | 53% |
| case 1 cell 2 | 5,480,580 | 8,230,870 | 67% |
| case 1 cell 3 | 4,664,577 | 7,846,040 | 59% |
| case 2 blastoceol | 45,794 | 6,302,957 | 1% |
| case 2 cell 1 | 6,988,854 | 8,622,495 | 81% |
| case 2 cell 2 | 7,083,600 | 8,843,495 | 80% |
| case 2 cell 3 | 5,811,364 | 8,256,310 | 70% |

FIG. 39

|  | gDNA | Single Cell |
|---|---|---|
| Count | 75 | 510 |
| Mean | 0.15 % | 0.51 % |
| Median | 0.09 % | 0.33 % |
| Max | 1.03 % | 10 % |
| Standard Deviation | 0.16% | 0.79 % |
| 95th percentile | 0.43 % | 1.22 % |
| 90th percentile | 0.37 % | 0.92 % |

FIG. 46

| DOE1 | Mapped READS | TOTAL READS | % Mapped | Dropout Count | Median DOR All | NOR | Error Rate (%) |
|---|---|---|---|---|---|---|---|
| 1xMM | 1,112,007 | 1,262,558 | 80.0% | 436 | 26.25 | 1,043,539 | 0.107% |
| 2xMM | 3,412,593 | 3,615,347 | 94.4% | 105 | 147.75 | 3,206,478 | 0.141% |
| F-A | 449,074 | 635,571 | 70.6% | 1379 | 9.625 | 421,228 | 0.077% |
| F-B | 3,293,944 | 3,519,378 | 93.7% | 105 | 142.5 | 3,106,520 | 0.072% |
| F-D | 4,028,128 | 4,109,448 | 98.0% | 122 | 142.5 | 3,796,213 | 0.064% |
| F-J | 3,676,617 | 3,922,330 | 93.7% | 102 | 159.25 | 3,461,304 | 0.079% |

F-A is : 25 mM Tris pH 7.8, 3 mM MgCl$_2$, 0 mM KCl, 10 mM (NH$_4$)$_2$SO$_4$, 50 U/mL Taq Gold     aka F-A Gold F-B is : 75 mM Tris pH 7.8, 6 mM MgCl$_2$, 0 mM KCl, 40 mM (NH$_4$)$_2$SO$_4$, 150 U/mL Taq Gold     aka F-B Gold F-D is : 25 mM Tris pH 8.2, 3 mM MgCl$_2$, 30 mM KCl, 40 mM (NH$_4$)$_2$SO$_4$, 150 U/mL Taq Gold F-J is : 75 mM Tris pH 7.8, 6 mM MgCl$_2$, 0 mM KCl, 40 mM (NH$_4$)$_2$SO$_4$, 150 U/mL Qiagen HS Taq   aka F-B Qiagen

FIG. 48

METHODS FOR SIMULTANEOUS AMPLIFICATION OF TARGET LOCI

CROSS-REFERENCE TO RELATED APPLICATIONS

This application is a continuation of U.S. Utility application Ser. No. 15/336,630, filed Oct. 27, 2016. U.S. Utility application Ser. No. 15/336,630 is a continuation of U.S. Utility application Ser. No. 14/538,982 filed Nov. 24, 2014 (now U.S. Pat. No. 9,677,118), which claims the benefit of U.S. Provisional Application Ser. No. 61/982,245, filed Apr. 21, 2014; U.S. Provisional Application Ser. No. 61/987,407, filed May 1, 2014, U.S. Provisional Application Ser. No. 61/994,791, filed May 16, 2014; and U.S. Provisional Application Ser. No. 62/066,514 filed Oct. 21, 2014. The entireties of all these applications are each hereby incorporated by reference in their entireties.

SEQUENCE LISTING

The instant application contains a Sequence Listing which has been submitted electronically in ASCII format and is hereby incorporated by reference in its entirety. Said ASCII copy, created on Aug. 21, 2019, is named N 012 US 21 SL.txt and is 8,724,428 bytes in size.

FIELD OF THE INVENTION

The present invention generally relates to methods and compositions for simultaneously amplifying multiple nucleic acid regions of interest in one reaction volume.

BACKGROUND OF THE INVENTION

To increase assay throughput and allow more efficient use of nucleic acid samples, simultaneous amplification of many target nucleic acids in a sample of interest can be carried out by combining many oligonucleotide primers with the sample and then subjecting the sample to polymerase chain reaction (PCR) conditions in a process known in the art as multiplex PCR. Use of multiplex PCR can significantly simplify experimental procedures and shorten the time required for nucleic acid analysis and detection. However, when multiple pairs are added to the same PCR reaction, non-target amplification products may be generated, such as amplified primer dimers. The risk of generating such products increases as the number of primers increases. These non-target amplicons significantly limit the use of the amplified products for further analysis and/or assays. Thus, improved methods are needed to reduce the formation of non-target amplicons during multiplex PCR.

Improved multiplex PCR methods would be useful for a variety of application, such as Non-Invasive Prenatal Genetic Diagnosis (NPD). In particular, current methods of prenatal diagnosis can alert physicians and parents to abnormalities in growing fetuses. Without prenatal diagnosis, one in 50 babies is born with serious physical or mental handicap, and as many as one in 30 will have some form of congenital malformation. Unfortunately, standard methods have either poor accuracy, or involve an invasive procedure that carries a risk of miscarriage. Methods based on maternal blood hormone levels or ultrasound measurements are non-invasive, however, they also have low accuracies. Methods such as amniocentesis, chorion villus biopsy and fetal blood sampling have high accuracy, but are invasive and carry significant risks. Amniocentesis was performed in approximately 3% of all pregnancies in the US, though its frequency of use has been decreasing over the past decade and a half.

Normal humans have two sets of 23 chromosomes in every healthy, diploid cell, with one copy coming from each parent. Aneuploidy, a condition in a nuclear cell where the cell contains too many and/or too few chromosomes is believed to be responsible for a large percentage of failed implantations, miscarriages, and genetic diseases. Detection of chromosomal abnormalities can identify individuals or embryos with conditions such as Down syndrome, Klinefelter's syndrome, and Turner syndrome, among others, in addition to increasing the chances of a successful pregnancy. Testing for chromosomal abnormalities is especially important as the mother's age: between the ages of 35 and 40 it is estimated that at least 40% of the embryos are abnormal, and above the age of 40, more than half of the embryos are abnormal.

It has recently been discovered that cell-free fetal DNA and intact fetal cells can enter maternal blood circulation. Consequently, analysis of this genetic material can allow early NPD. Improved methods are desired to improve the sensitivity and specificity and reduce the time and cost required for NPD.

SUMMARY OF THE INVENTION

In one aspect, the invention features methods of amplifying target loci in a nucleic acid sample. In some embodiments, the method involves (i) contacting the nucleic acid sample with a library of test primers (such as non-immobilized primers) that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci to produce a reaction mixture; and (ii) subjecting the reaction mixture to primer extension reaction conditions to produce amplified products that include target amplicons. In some embodiments, the method also includes determining the presence or absence of at least one target amplicon (such as at least 50, 60, 70, 80, 90, 95, 96, 97, 98, 99, or 99.5% of the target amplicons). In some embodiments, the method also includes determining the sequence of at least one target amplicon (such as at least 50, 60, 70, 80, 90, 95, 96, 97, 98, 99, or 99.5% of the target amplicons). In some embodiments, the method involves multiplex PCR and sequencing (such as high throughput sequencing). In some embodiments, the method includes selecting the test primers from a library of candidate primers by removing one or more of the candidate primers based at least in part on the likelihood of dimer formation between candidate primers (such as ΔG values, undesirability scores, or interaction scores) prior to contacting the nucleic acid sample with the library of test primers.

In some embodiments, the method involves (i) contacting a sample comprising target human loci with a library of at least 50 (such as at least 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000) non-immobilized, non-identical primers that simultaneously hybridize to at least 50 (such as at least 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000) non-identical target human loci to produce a reaction mixture; wherein the primers do not include molecular inversion probes (MIPs); (ii) subjecting the reaction mixture to primer extension reaction conditions to produce amplified products comprising target amplicons; wherein the annealing temperature for the reaction conditions is greater than a melting temperature (such as the empirically measured or calculated $T_m$) of at least 50 (such as at least 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000) of the non-identical primers and/or the length of the annealing step of the reaction conditions is greater than 5 minutes (such as at least 8, 10, 15, 20, 30, 45, 60, 75, 90, 120, 150, or 180 minutes; and wherein at least 50 (such as at least 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000) non-identical target human loci are simultaneously amplified; and (iii) detecting the amplified products such as by sequencing the amplified products or hybridizing the amplified products to an array. In some embodiments, the method includes empirically measuring or calculating (such as calculating with a computer) the melting temperature of at least 25, 50, 80, 90, 92, 94, 96, 98, 99, or 100% of the primers in the library and selecting an annealing temperature that satisfies any of these embodiments for PCR amplification of target loci.

In some embodiments, the method involves (i) contacting a sample comprising target human loci with a library of at least 2 (such as at least 5, 10, 25 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000) non-immobilized, non-identical primers that simultaneously hybridize to at least 2 (such as at least 5, 10, 25 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000) non-identical target human loci to produce a reaction mixture; wherein the primers do not include molecular inversion probes (MIPs); (ii) subjecting the reaction mixture to primer extension reaction conditions to produce amplified products comprising target amplicons; wherein at least 2 (such as at least 5, 10, 25 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000) non-identical target human loci are simultaneously amplified; and (iii) detecting the amplified products such as by sequencing the amplified products or hybridizing the amplified products to an array. In various embodiments, (i) the annealing temperature is at least 1, 2, 3, 4, 5, 6, 7, 8, 9, 10, 11, 12, 13, or 15° C. greater than the melting temperature (such as the empirically measured or calculated $T_m$) of at least 2, 5, 10, 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers; (ii) the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the melting temperature (such as the empirically measured or calculated $T_m$) of at least 2, 5, 10, 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers; (iii) the annealing temperature is at least 1, 2, 3, 4, 5, 6, 7, 8, 9, 10, 11, 12, 13, or 15° C. greater than the highest melting temperature (such as the empirically measured or calculated $T_m$) of the primers; (iv) the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the highest melting temperature (such as the empirically measured or calculated $T_m$) of the primers; (v) the annealing temperature is at least 1, 2, 3, 4, 5, 6, 7, 8, 9, 10, 11, 12, 13, or 15° C. greater than the average melting temperature (such as the empirically measured or calculated $T_m$) of at least 2, 5, 10, 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers; or (vi) the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the average melting temperature (such as the empirically measured or calculated $T_m$) of at least 2, 5, 10, 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers. In various embodiments, (i) the length of the annealing step (per PCR cycle) is greater than 1, 3, 5, 8, 10, 15, 20, 30, 45, 60, 75, 90, 120, 150, or 180 minutes or (ii) the length of the annealing step (per PCR cycle) is between 5 and 180 minutes, such as 5 to 60, 10 to 60, 5 to 30, or 10 to 30 minutes, inclusive. In various embodiments, any of the embodiments for annealing temperature are combined with any of the embodiments for annealing time. In various embodiments, the annealing temperature is at least 3° C. greater than the melting temperature of at least 50 of the non-identical primers, the annealing temperature is at least 3° C. greater than the highest melting temperature of the primers, the annealing temperature is at least 8° C. greater than the highest melting temperature of the primers, the annealing temperature is at least 3° C. greater than the average melting temperature of the primers, the annealing temperature is at least 8° C. greater than the average melting temperature of the primers, the range of melting temperature of the primers is between 1 to 5° C., inclusive, the range of melting temperatures of the primers is less than 5° C., or any combination thereof. In some embodiments, the method includes empirically measuring or calculating (such as calculating with a computer) the melting temperature of at least 25, 50, 80, 90, 92, 94, 96, 98, 99, or 100% of the primers in the library and selecting an annealing temperature that satisfies any of these embodiments for PCR amplification of target loci. In some embodiments, a crowding agent, such as PEG or glycerol is included in the reaction mixture.

In various embodiments of any of the aspects of the invention, the method includes non-specifically amplifying nucleic acids in a sample comprising target human loci; contacting the amplified nucleic acids with a library of non-identical primers (such as non-immobilized primers) that simultaneously hybridize to at least 1,000 non-identical target human loci to produce a reaction mixture; wherein the primers do not include molecular inversion probes (MIPs); subjecting the reaction mixture to primer extension reaction conditions to produce amplified products comprising target amplicons; wherein at least 1,000 non-identical target human loci are simultaneously amplified; and sequencing the amplified products. In some embodiments, the non-specific amplification comprises universal polymerase chain reaction (PCR), whole genome application, ligation-mediated PCR, degenerate oligonucleotide primer PCR, or multiple displacement amplification. In some embodiments, the method includes contacting a sample comprising target human loci with a library of non-identical primers (such as non-immobilized primers) that simultaneously hybridize to at least 1,000 non-identical target human loci to produce a reaction mixture; wherein the primers do not include molecular inversion probes (MIPs); subjecting the reaction mixture to primer extension reaction conditions to produce amplified products comprising target amplicons; wherein the annealing temperature for the reaction conditions is greater than the melting temperature of at least 1,000 of the non-identical primers; and wherein at least 1,000 non-identical target human loci are simultaneously amplified; and sequencing the amplified products. In some embodiments, the method includes contacting a sample comprising target human loci with a library of non-identical primers (such as non-immobilized primers) that simultaneously hybridize to at least 1,000 non-identical target human loci to produce a reaction mixture in which the concentration of each primer is less than 20 nM; wherein the primers do not include molecular inversion probes (MIPs); subjecting the reaction mixture to primer extension reaction conditions to produce amplified products comprising target amplicons; wherein the length of the annealing step of the reaction conditions is greater than 10 minutes; and wherein at least 1,000 non-identical target human loci are simultaneously amplified; and sequencing the amplified products. In some embodiments, the method includes contacting a sample comprising target human loci with a library of non-identical primers (such as non-immobilized primers) that simultaneously hybridize to at least 1,000 non-identical target human loci to produce a reaction mixture; wherein the guanine-cytosine (GC) content of the primers is between 30% and 80%, inclusive; wherein the range of melting temperatures of the primers is less than 5° C.; wherein the length of the primers is between 15 to 75 nucleotides, inclusive; and wherein the primers do not include molecular inversion probes (MIPs); subjecting the reaction mixture to primer extension reaction conditions to produce amplified products comprising target amplicons; wherein at least 1,000 non-identical target human loci are simultaneously amplified; and sequencing the amplified products. In some embodiments, the method does not comprise using a microarray. In some embodiments, the library includes a least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primers. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified.

In various embodiments of any of the aspects of the invention, the ΔG values for each possible combination of two primers in the library are all equal to or greater than −5 kcal/mol. In some embodiments, the method simultaneously PCR-amplifying at least 1,000 non-identical target human loci in the sample using at least 1,000 non-identical primer pairs (such as non-immobilized primer pairs) to produce a first set of amplified products; wherein each primer pair includes a forward primer and a reverse primer that hybridize to the same target human locus. In some embodiments, the method also includes simultaneously PCR-amplifying at least 1,000 non-identical target human loci in the first set of amplified products using at least 1,000 non-identical primer pairs (such as non-immobilized primer pairs) to produce a second set of amplified products; wherein each primer pair includes a forward primer and a reverse primer that hybridize to the same target human locus. In some embodiments, the primer pairs used in the first and second round of PCR are the same. In some embodiments, the primer pairs used in the first and second round of PCR are different. In some embodiments, the forward primers used in the first and second round of PCR are the same, and the reverse primers used in the first and second round of PCR are different. In some embodiments, the forward primers used in the first and second round of PCR are different, and the reverse primers used in the first and second round of PCR are the same. In some embodiments, the method simultaneously PCR-amplifying at least 1,000 non-identical target human loci in the sample using at least 1,000 non-identical primer pairs (such as non-immobilized primer pairs) to produce a first set of amplified products; wherein each primer pair includes an outer forward primer and an outer reverse primer that hybridize to the same target human locus; and simultaneously PCR-amplifying at least 1,000 non-identical target human loci in the first set of amplified products using a universal reverse primer and at least 1,000 non-identical inner forward primers to produce a second set of amplified products; wherein each inner forward primer hybridizes to a region downstream from the corresponding outer forward primer. In some embodiments, the method includes simultaneously PCR-amplifying at least 1,000 non-identical target human loci in the sample using at least 1,000 non-identical primer pairs to produce a first set of amplified products; wherein each primer pair includes an outer forward primer and an outer reverse primer that hybridize to the same target human locus; and simultaneously PCR-amplifying at least 1,000 non-identical target human loci in the first set of amplified products using a universal forward primer and at least 1,000 non-identical inner reverse primers to produce a second set of amplified products; wherein each inner reverse primer hybridizes to a region upstream from the corresponding outer reverse primer. In some embodiments, the method includes simultaneously PCR-amplifying at least 1,000 non-identical target human loci in the sample using at least 1,000 non-identical forward primers and a universal reverse primer to produce a first set of amplified products; and simultaneously PCR-amplifying at least 1,000 non-identical target human loci in the first set of amplified products using a universal forward primer and at least 1,000 non-identical reverse primers to produce a second set of amplified products. In some embodiments, the method includes simultaneously PCR-amplifying at least 1,000 non-identical target human loci in the sample using at least 1,000 non-identical reverse primers and a universal forward primer to produce a first set of amplified products; and simultaneously PCR-amplifying at least 1,000 non-identical target human loci in the first set of amplified products using a universal reverse primer and at least 1,000 non-identical forward primers to produce a second set of amplified products. In some embodiments, at least 96% of the primer molecules are extended to form amplified products. In some embodiments, the annealing temperature is at least 1, 2, 3, 4, 5, 6, 7, 8, 9, 10, 11, 12, 13, or 15° C. greater than the melting temperature of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers. In some embodiments, the annealing temperature is at least 1, 2, 3, 4, 5, 6, 7, 8, 9, 10, 11, 12, 13, or 15° C. greater than the highest melting temperature of the non-identical primers. In some embodiments, the annealing temperature is at least 1, 2, 3, 4, 5, 6, 7, 8, 9, 10, 11, 12, 13, or 15° C. greater than the average melting temperature of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers. In some embodiments, the range of melting temperature of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers is between 1 to 5° C., inclusive. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers have 2, 1, or 0 guanines or cytosines in the last 5 bases at the 3' end of the primers. In some embodiments, the sample comprises maternal DNA from the pregnant mother of a fetus and fetal DNA, and wherein the method comprises determining the presence or absence of a fetal chromosome abnormality from the sequencing data. In some embodiments, the sample is from an individual suspected of having cancer or an above normal risk for cancer; and wherein one or more of the target human loci comprises a polymorphism or other mutation associated with an above normal risk for cancer or associated with cancer.

In various embodiments of any of the aspects of the invention, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, or 99.5% of the amplified products are target amplicons. In some embodiments, at least 50, 60, 70, 80, 90, 95, 96, 97, 98, 99, or 99.5% of the target loci are amplified. In some embodiments, at least 50, 60, 70, 80, 90, 95, 96, 97, 98, 99, or 99.5% of the target loci are amplified at least 5, 10, 20, 40, 50, 60, 80, 100, 120, 150, 200, 300, or 400-fold. In various embodiments, less than 60, 50, 40, 30, 20, 10, 5, 4, 3, 2, 1, 0.5, 0.25, 0.1, or 0.05% of the amplified products are primer dimers. In some embodiments, the library of test primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 test primer pairs, wherein each pair of primers includes a forward test primer and a reverse test primer that hybridize to the same target locus. In some embodiments, the library of test primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 individual test primers that hybridize to different target loci, wherein the individual primers are not part of primer pairs.

In various embodiments of any of the aspects of the invention, the concentration of each test primer is less than 100, 75, 50, 25, 10, 5, 2, 1, 0.5, 0.1, or 0.05 nM. In various embodiments, the guanine-cytosine (GC) content of the test primers is between 30 to 80%, such as between 20 to 70%, 40 to 70%, or 50 to 60%, inclusive. In some embodiments, the range of GC content (e.g., the maximum GC content minus minimum GC content, such as 80%-60%=a range of 20%) of the test primers is less than 30, 20, 10, or 5%. In some embodiments, there are at least 2 (such as 3, 4, or 5) guanines or cytosines in the last 5 bases at the 3' end of the primers. In some embodiments, a maximum of 2 (such as 2, 1, or 0) of the bases in the last 5 bases at the 3' end of the primers are guanines or cytosines. In some embodiments, there are at least 1 (such as 2 or 3) guanines or cytosines in the last 3 bases at the 3' end of the primers. In some embodiments, the melting temperature ($T_m$) of the test primers is between 40 to 80° C., such as 50 to 70° C., 55 to 65° C., 54 to 60.5° C., or 57 to 60.5° C., inclusive. In some embodiments, the range of melting temperatures of the test primers is less than 20, 15, 10, 5, 3, or 1° C. In some embodiments, the length of the test primers is between 15 to 100 nucleotides, such as between 15 to 75 nucleotides, 15 to 40 nucleotides, 17 to 35 nucleotides, 18 to 30 nucleotides, or 20 to 65 nucleotides, inclusive. In some embodiments, test primers include a tag that is not target specific, such as a tag that forms an internal loop structure. In some embodiments, the tag is between two DNA binding regions. In various embodiments, the test primers include a 5' region that is specific for a target locus, an internal region that is not specific for the target locus and forms a loop structure, and a 3' region that is specific for the target locus. In various embodiments, the length of the 3' region is at least 7 nucleotides. In some embodiments, the length of the 3' region is between 7 and 20 nucleotides, such as between 7 to 15 nucleotides, or 7 to 10 nucleotides, inclusive. In various embodiments, the test primers include a 5' region that is not specific for a target locus (such as a tag or a universal primer binding site) followed by a region that is specific for a target locus, an internal region that is not specific for the target locus and forms a loop structure, and a 3' region that is specific for the target locus. In some embodiments, the range of the length of the test primers is less than 50, 40, 30, 20, 10, or 5 nucleotides. In some embodiments, the length of the target amplicons is between 50 and 100 nucleotides, such as between 60 and 80 nucleotides, or 60 to 75 nucleotides, inclusive. In some embodiments, the length of the target amplicons is at least 100; 200; 300; 400; 500; 600; 700; 800; 900; 1,000; 1,200; 1,500; 2,000; or 3,000 nucleotides. In some embodiments, the length of the target amplicons is between 100 and 1,500 nucleotides, such as between 100 to 1,000; 100 to 500, 500 to 750, or 750 to 1,000 nucleotides, inclusive. In some embodiments, the range of the length of the target amplicons is less than 50, 25, 15, 10, or 5 nucleotides. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 or all of the target amplicons have a length that falls within the range of the average length of the amplicons ±5% of the average length, average length ±20%, average length ±20%, average length ±30%, or average length ±50%.

In various embodiments of any of the aspects of the invention, the primer extension reaction conditions are polymerase chain reaction conditions (PCR). In various embodiments, the length of the annealing step is greater than 3, 5, 8, 10, 15, 20, 30, 45, 60, 75, 90, 120, 150, or 180 minutes. In various embodiments, the length of the extension step is greater than 0.2, 0.5, 1, 3, 5, 8, 10, or 15 minutes.

In various embodiments of any of the aspects of the invention, the test primers are used to simultaneously amplify at least 300 different target loci in a sample that includes maternal DNA from the pregnant mother of a fetus and fetal DNA to determine the presence or absence of a fetal chromosome abnormality. In various embodiments, the method includes ligating a universal primer binding site to the DNA molecules in the sample; amplifying the ligated DNA molecules using at least 300 specific primers and a universal primer to produce a first set of amplified products; and amplifying the first set of amplified products using at least 300 pairs of specific primers to produce a second set of amplified products.

In various embodiments of any of the aspects of the invention, the test primers are used to simultaneously amplify e.g. at least 100 (e.g., at least 300 or 1,000) different target loci in sample includes DNA from an alleged father of a fetus and to simultaneously amplify the target loci in a sample that includes maternal DNA from the pregnant mother of the fetus and fetal DNA to establish whether the alleged father is the biological father of the fetus.

In various embodiments of any of the aspects of the invention, the test primers are used to simultaneously amplify e.g. at least 100 (e.g., at least 300 or 1,000) different target loci in one cell or multiple cells from an embryo to determine the presence or absence of a chromosome abnormality. In various embodiments, cells from a set of two or more embryos are analyzed, and one embryo is selected for in vitro fertilization.

In various embodiments of any of the aspects of the invention, the test primers are used to simultaneously amplify e.g. at least 100 (e.g., at least 300 or 1,000) different target loci in a forensic nucleic acid sample. In various embodiments, the length of the annealing step is greater than 3, 5, 8, 10, 15, 20, 30, 45, 60, 75, 90, 120, 150, or 180 minutes In various embodiments of any of the aspects of the invention, the method involves using the test primers to simultaneously amplify e.g. at least 100 (e.g., at least 300 or 1,000) different target loci in a control nucleic acid sample to produce a first set of target amplicons and to simultaneously amplify the target loci in a test nucleic acid sample to produce a second set of target amplicons; and comparing the first and second sets of target amplicons to determine whether a target locus is present in one sample but absent in the other, or whether a target locus is present at different levels in the control sample and the test sample. In various embodiments, the test sample is from an individual suspected of having a disease or phenotype of interest (such as cancer), or an increased risk (such as an above normal level of risk) for a disease or phenotype of interest; and wherein one or more of the target loci include a sequence (e.g., a polymorphism or other mutation) associated with an increased risk (such as an above normal level of risk) for the disease or phenotype of interest, or associated with the disease or phenotype of interest. In various embodiments, the method involves using the test primers to simultaneously amplify e.g. at least 100 (e.g., at least 300 or 1,000) different target loci in a control sample that includes RNA to produce a first set of target amplicons and to simultaneously amplify the target loci in a test sample that includes RNA to produce a second set of target amplicons; and comparing the first and second sets of target amplicons to determine the presence or absence of a difference in the RNA expression levels between the control sample and the test sample. In various embodiments, the RNA is mRNA. In various embodiments, the test sample is from an individual suspected of having a disease or phenotype of interest (such as cancer) or an increased risk for the disease or phenotype of interest (such as cancer); and wherein one or more of the target loci includes a sequence (e.g., a polymorphism or other mutation) associated with an increased risk for the disease or phenotype of interest or associated with the disease or phenotype of interest. In some embodiments, the test sample is from an individual diagnosed with a disease or phenotype of interest (such as cancer); and wherein a difference in the RNA expression level between the control sample and test sample indicates a target locus includes a sequence (e.g., a polymorphism or other mutation) associated with an increased or decreased risk for the disease or phenotype of interest.

In some embodiments of any of the aspects of the invention, the test primers are selected from a library of candidate primers based on one or more parameters, such as the selection of primers using any of the methods of the invention. In some embodiments, the test primers are selected from a library of candidate primers based at least in part on the ability of the candidate primers to form primer dimers.

In one aspect, the invention features methods of selecting test primers from a library of candidate primers. In various embodiments, the selection involves (i) calculating on a computer a score (such as an undesirability score) for most or all of the possible combinations of two candidate primers from the library, wherein each score (such as an undesirability score) is based at least in part on the likelihood of dimer formation between the two candidate primers; (ii) removing the candidate primer with the highest score (such as an undesirability score) from the library of candidate primers; and (iii) if the candidate primer removed in step (ii) is a member of a primer pair, then removing the other member of the primer pair from the library of candidate primers; and (iv) optionally repeating steps (ii) and (iii), thereby selecting a library of test primers. In some embodiments, the selection method is performed until the score (such as the undesirability score) for the candidate primer combinations remaining in the library are all equal to or below a minimum threshold. In some embodiments, the selection method is performed until the number of candidate primers remaining in the library is reduced to a desired number. In various embodiments, a score (such as an undesirability score) is calculated for at least 80, 90, 95, 98, 99, or 99.5% of the possible combinations of candidate primers in the library. In various embodiments, the candidate primers remaining in the library are capable of simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci. In various embodiments, the method also includes (v) contacting a nucleic acid sample that includes target loci with the candidate primers remaining in the library to produce a reaction mixture; and (vi) subjecting the reaction mixture to primer extension reaction conditions to produce amplified products that includes target amplicons.

In one aspect, the invention features methods of selecting test primers from a library of candidate primers. In various embodiments, the selection of test primers are selected from a library of candidate primers involves (i) calculating on a computer a score (such as an undesirability score) for most or all of the possible combinations of two candidate primers from the library, wherein each score (such as an undesirability score) is based at least in part on the likelihood of dimer formation between the two candidate primers; (ii) removing from the library of candidate primers the candidate primer that is part of the greatest number of combinations of two candidate primers with a score (such as an undesirability score) above a first minimum threshold; (iii) if the candidate primer removed in step (ii) is a member of a primer pair, then removing the other member of the primer pair from the library of candidate primers; and (iv) optionally repeating steps (ii) and (iii), thereby selecting a library of test primers. In some embodiments, the selection method is performed until the score (such as the undesirability score) for the candidate primer combinations remaining in the library are all equal to or below the first minimum threshold. In some embodiments, the selection method is performed until the number of candidate primers remaining in the library is reduced to a desired number. In various embodiments, a score (such as an undesirability score) is calculated for at least 80, 90, 95, 98, 99, or 99.5% of the possible combinations of candidate primers in the library. In various embodiments, the candidate primers remaining in the library are capable of simultaneously amplifying at least 25; 50; 75;

100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci. In various embodiments, the method also includes (v) contacting a nucleic acid sample that includes target loci with the candidate primers remaining in the library to produce a reaction mixture; and (vi) subjecting the reaction mixture to primer extension reaction conditions to produce amplified products that includes target amplicons.

In various embodiments of any of the aspects of the invention, the selection method involves further reducing the number of candidate primers remaining in the library by decreasing the first minimum threshold used in step (ii) to a lower second minimum threshold and optionally repeating steps (ii) and (iii). In some embodiments, the selection method involves increasing the first minimum threshold used in step (ii) to a higher second minimum threshold and optionally repeating steps (ii) and (iii). In some embodiments, the selection method is performed until the score (such as the undesirability score) for the candidate primer combinations remaining in the library are all equal to or below the second minimum threshold, or until the number of candidate primers remaining in the library is reduced to a desired number.

In various embodiments of any of the aspects of the invention, the method involves, prior to step (i), identifying or selecting primers that hybridize to the target loci. In some embodiments, multiple primers (or primer pairs) hybridize to the same target locus, and the selection method is used to select a one primer (or one primer pair) for this target locus based on one or more parameters. In various embodiments, the method involves, prior to step (ii), removing a primer pair from the library that produces a target amplicon that overlaps with a target amplicon produced by another primer pair. In various embodiments, a candidate primer is selected out of a group of two or more candidate primers with equal scores (such as undesirability scores) for removal from the library of candidate primers based on one or more other parameters. In some embodiments, the candidate primers remaining in the library are used as a library of test primers in any of the methods of the invention. In some embodiments, the resulting library of test primers includes any of the primer libraries of the invention.

In various embodiments of any of the aspects of the invention, the selection method selects candidate primers and divides them into different pools (e.g., 2, 3, 4, 5, 6, or more different pools). Each pool can be used to simultaneously amplify a large number of target loci (or a subset of target loci) in a single reaction volume. In some embodiments, a graph coloring algorithm is used to divide candidate primers into different pools. If desired, this method can be used to minimize the number of different pools needed to amplify most or all of the target loci.

In some embodiments, most or all of the target loci (such as at least 70, 80, 90, 92, 94, 96, 98, 99, or 100% of the target loci) are amplified by at least 2, 3, 4, 5, 6, or more different pools. In some embodiments, most or all of the bases in the target loci (such as at least 70, 80, 90, 92, 94, 96, 98, 99, or 100% of the bases in the target loci) are amplified by at least 2, 3, 4, 5, 6, or more different pools. In some embodiments, most or all of the bases in the target loci (such as at least 70, 80, 90, 92, 94, 96, 98, 99, or 100% of the bases in the target loci) are amplified by at least 2, 3, 4, 5, 6, or more different primers or primer pairs in different pools. For example, a particular base in a target locus may be amplified by at least 2, 3, 4, 5, 6, or more different primers or primer pairs; wherein each different primer or primer pair is in a different pool. Using different primers or primer pairs to amplify each base allows multiple independent measurements of the base to be made, thereby increasing the accuracy of the method. Dividing the different primers or primer pairs that amplify the same base into different pools prevents interference due to overlapping amplicons being formed by different primers or primer pairs.

In one aspect, the invention features methods of selecting test primers from a library of candidate primers to form 2 or more different primer pools. In various embodiments, the selection involves (i) calculating on a computer a score (such as an undesirability score) for most or all of the possible combinations of two candidate primers from the library, wherein each score (such as an undesirability score) is based at least in part on the likelihood of dimer formation between the two candidate primers; (ii) removing the candidate primer with the highest score (such as an undesirability score) from the library of candidate primers; and (iii) if the candidate primer removed in step (ii) is a member of a primer pair, then removing the other member of the primer pair from the library of candidate primers; and (iv) optionally repeating steps (ii) and (iii), thereby selecting a first pool. In some embodiments, the selection method is performed until the score (such as the undesirability score) for the candidate primer combinations remaining in the library are all equal to or below a minimum threshold for the first pool. In some embodiments, the selection method is performed until the number of candidate primers remaining in the library is reduced to a desired number for the first pool. In some embodiments, after the first pool is selected those primers are removed from further consideration and steps of the method (such as steps (ii) and (iii)) are repeated with the remaining primers to select a second pool. If desired, this method may be repeated to select the desired number of primer pools. In various embodiments, a score (such as an undesirability score) is calculated for at least 80, 90, 95, 98, 99, or 99.5% of the possible combinations of candidate primers in the library. In some embodiments, the score is based at least in part on the current coverage of the bases in the target locus (such as the number of other primer pools that have a primer or primer pair that amplifies a particular base in the target locus). In various embodiments, one or more of the pools are each capable of simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci. In various embodiments, the method also includes separately contacting a nucleic acid sample that includes target loci with two or more of the pools to produce separate reaction mixtures; and (vi) subjecting the reaction mixtures to primer extension reaction conditions to produce amplified products that includes target amplicons.

In one aspect, the invention features methods of selecting test primers from a library of candidate primers to form 2 or more different primer pools. In various embodiments, the selection of test primers are selected from a library of candidate primers involves (i) calculating on a computer a score (such as an undesirability score) for most or all of the possible combinations of two candidate primers from the library, wherein each score (such as an undesirability score) is based at least in part on the likelihood of dimer formation between the two candidate primers; (ii) removing from the library of candidate primers the candidate primer that is part of the greatest number of combinations of two candidate primers with a score (such as an undesirability score) above a first minimum threshold; (iii) if the candidate primer removed in step (ii) is a member of a primer pair, then removing the other member of the primer pair from the library of candidate primers; and (iv) optionally repeating steps (ii) and (iii), thereby selecting a first pool. In some embodiments, the selection method is performed until the score (such as the undesirability score) for the candidate primer combinations remaining in the library are all equal to or below the first minimum threshold for the first pool. In some embodiments, the selection method is performed until the number of candidate primers remaining in the library is reduced to a desired number for the first pool. In various embodiments, the selection method involves further reducing the number of candidate primers remaining in the library by decreasing the first minimum threshold used in step (ii) to a lower second minimum threshold and optionally repeating steps (ii) and (iii). In some embodiments, the selection method involves increasing the first minimum threshold used in step (ii) to a higher second minimum threshold and optionally repeating steps (ii) and (iii). In some embodiments, the selection method is performed until the score (such as the undesirability score) for the candidate primer combinations remaining in the library are all equal to or below the second minimum threshold, or until the number of candidate primers remaining in the library is reduced to a desired number for the first pool. In some embodiments, after the first pool is selected those primers are removed from further consideration and steps of the method (such as steps (ii) and (iii)) are repeated with the remaining primers to select a second pool. If desired, this method may be repeated to select the desired number of primer pools. In various embodiments, a score (such as an undesirability score) is calculated for at least 80, 90, 95, 98, 99, or 99.5% of the possible combinations of candidate primers in the library. In some embodiments, the score is based at least in part on the current coverage of the bases in the target locus (such as the number of other primer pools that have a primer or primer pair that amplifies a particular base in the target locus). In various embodiments, one or more of the pools are each capable of simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci. In various embodiments, the method also includes separately contacting a nucleic acid sample that includes target loci with two or more of the pools to produce separate reaction mixtures; and (vi) subjecting the reaction mixtures to primer extension reaction conditions to produce amplified products that includes target amplicons.

In some embodiments, at least 70, 80, 85, 90, 95, or 100% of the nucleotides in a region of interest (such as an exon) are included in at least 1, 2, 3, or 4 different amplicons (i.e., amplicons with non-identical sequences that are formed by different primers or primer pairs). In some embodiments, at least 70, 80, 85, 90, 95, or 100% of the nucleotides in at least 70, 80, 85, 90, 95, or 100% of the regions of interest are amplified by at least 1, 2, 3, or 4 different amplicons. In some embodiments in which 2-fold coverage is desired, the primers are divided into at least two different pools such the amplicons in each pool do not overlap with each other (which would cause interference during amplification).

In various embodiments of any of the aspects of the invention, the score (such as the undesirability score) are based at least in part on one or more parameters selected from the group consisting of heterozygosity rate of the target locus, disease prevalence associated with a sequence (e.g., a polymorphism) at the target locus, disease penetrance associated with a sequence (e.g., a polymorphism) at the target locus, specificity of the candidate primer for the target locus, size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, and size of the target amplicon.

In various embodiments of any of the aspects of the invention, the score (such as the undesirability score) are based at least in part on one or more parameters selected from the group consisting of heterozygosity rate of the target locus, specificity of the candidate primer for the target locus; size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, and size of the target amplicon; and the test primers are used to simultaneously amplify e.g. at least 100 (e.g., at least 300 or 1,000) different target loci in a sample that includes maternal DNA from the pregnant mother of a fetus and fetal DNA to determine the presence or absence of a fetal chromosome abnormality. In various embodiments, the method includes ligating a universal primer binding site to the DNA molecules in the sample; amplifying the ligated DNA molecules using e.g. at least 100 (e.g., at least 300 or 1,000) specific primers and a universal primer to produce a first set of amplified products; and amplifying the first set of amplified products using e.g. at least 100 (e.g., at least 300 or 1,000) pairs of specific primers to produce a second set of amplified products. In various embodiments, at least 500; 750; 1,000; 2,000; 5,000; 7,500; 10,000; 15,000; 19,000; 20,000; 25,000; 27,000; 28,000; 30,000; 40,000; 50,000; 75,000; or 100,000 different primer pairs are used. In various embodiments, at least 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, 99.5, or 100% of the target loci are amplified at least 5, 10, 20, 40, 50, 60, 80, 100, 120, 150, 200, 300, or 400-fold.

In various embodiments of any of the aspects of the invention, the score (such as the undesirability score) are based at least in part on one or more parameters selected from the group consisting of heterozygosity rate of the target locus, specificity of the candidate primer for the target locus; size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, and size of the target amplicon; and the test primers are used to simultaneously amplify e.g. at least 100 (e.g., at least 300 or 1,000) different target loci in sample includes DNA from an alleged father of a fetus and to simultaneously amplify the target loci in a sample that includes maternal DNA from the pregnant mother of a fetus and fetal DNA to establish whether the alleged father is the biological father of the fetus. In various embodiments, at least 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, 99.5, or 100% of the target loci are amplified at least 5, 10, 20, 40, 50, 60, 80, 100, 120, 150, 200, 300, or 400-fold.

In various embodiments of any of the aspects of the invention, the score (such as the undesirability score) are based at least in part on one or more parameters selected from the group consisting of heterozygosity rate of the target locus, specificity of the candidate primer for the target locus; size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, and size of the target amplicon; and the test primers are used to simultaneously amplify e.g. at least 100 (e.g., at least 300 or 1,000) different target loci in one cell or multiple cells from an embryo to determine the presence or absence of a chromosome abnormality. In various embodiments, cells from a set of two or more embryos are analyzed, and one embryo is selected for in vitro fertilization. In various embodiments, at least 300, 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, 99.5, or 100% of the target loci are amplified at least 5, 10, 20, 40, 50, 60, 80, 100, 120, 150, 200, 300, or 400-fold.

In various embodiments of any of the aspects of the invention, the scores (such as the undesirability scores) are based at least in part on one or more parameters selected from the group consisting of heterozygosity rate of the target locus, specificity of the candidate primer for the target locus; size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, and size of the target amplicon; and the test primers are used to simultaneously amplify e.g. at least 100 (e.g., at least 300 or 1,000) different target loci in a forensic nucleic acid sample. In various embodiments, the length of the annealing step is greater than 3, 5, 8, 10, 15, 20, 30, 45, 60, 75, 90, 120, 150, or 180 minutes. In various embodiments, at least 300, 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, 99.5, or 100% of the target loci are amplified at least 5, 10, 20, 40, 50, 60, 80, 100, 120, 150, 200, 300, or 400-fold.

In various embodiments of any of the aspects of the invention, the scores (such as the undesirability scores) are based at least in part on one or more parameters selected from the group consisting of heterozygosity rate of the target locus, disease prevalence associated with a sequence (e.g., a polymorphism) at the target locus, disease penetrance associated with a sequence (e.g., a polymorphism) at the target locus, specificity of the candidate primer for the target locus, size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, and size of the target amplicon; and the method involves using the test primers to simultaneously amplify e.g. at least 100 (e.g., at least 300 or 1,000) different target loci in a control nucleic acid sample to produce a first set of target amplicons and to simultaneously amplify the target loci in a test nucleic acid sample to produce a second set of target amplicons; and comparing the first and second sets of target amplicons to determine whether a target locus is present in one sample but absent in the other, or whether a target locus is present at different levels in the control sample and the test sample. In various embodiments, the test sample is from an individual suspected of having a disease or phenotype of interest, or an increased risk for a disease or phenotype of interest; and wherein one or more of the target loci include a sequence (e.g., a polymorphism) at the target locus associated with an increased risk for the disease or phenotype of interest, or associated with the disease or phenotype of interest. In various embodiments, at least 300, 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, 99.5, or 100% of the target loci are amplified at least 5, 10, 20, 40, 50, 60, 80, 100, 120, 150, 200, 300, or 400-fold.

In various embodiments of any of the aspects of the invention, the scores (such as the undesirability scores) are based at least in part on one or more parameters selected from the group consisting of heterozygosity rate of the target locus, disease prevalence associated with a sequence (e.g., a polymorphism) at the target locus, disease penetrance associated with a sequence (e.g., a polymorphism) at the target locus, specificity of the candidate primer for the target locus, size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, and size of the target amplicon; and the method involves using the test primers to simultaneously amplify e.g. at least 100 (e.g., at least 300 or 1,000); different target loci in a control sample that includes RNA to produce a first set of target amplicons and to simultaneously amplify the target loci in a test sample that includes RNA to produce a second set of target amplicons; and comparing the first and second sets of target amplicons to determine the presence or absence of a difference in the RNA expression levels between the control sample and the test sample. In various embodiments, the RNA is mRNA. In various embodiments, the test sample is from an individual suspected of having a disease or phenotype of interest (such as cancer) or an increased risk for the disease or phenotype of interest (such as cancer); and wherein one or more of the target loci includes a sequence (e.g., a polymorphism or other mutation) associated with an increased risk for the disease or phenotype of interest or associated with the disease or phenotype of interest. In some embodiments, the test sample is from an individual diagnosed with a disease or phenotype of interest (such as cancer); and wherein a difference in the RNA expression level between the control sample and test sample indicates a target locus includes a sequence (e.g., a polymorphism or other mutation) associated with an increased or decreased risk for the disease or phenotype of interest. In various embodiments, at least 300, 500; 750; 1,000; 2000; 5,000; 7,500; 10,000; 15,000; 19,000; 20,000; 25,000; 27,000; 28,000; 30,000; 40,000; 50,000; 75,000; or 100,000 different target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, 99.5, or 100% of the target loci are amplified at least 5, 10, 20, 40, 50, 60, 80, 100, 120, 150, 200, 300, or 400-fold.

In one aspect, the invention features libraries of primers (such as non-immobilized primers). In some embodiments, the primers are selected from a library of candidate primers using any of the methods of the invention. In some embodiments, the library includes primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci. In some embodiments, the library includes primers that simultaneously amplify at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci. In some embodiments, the library includes primers that simultaneously amplify at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci such that less than 60, 40, 30, 20, 10, 5, 4, 3, 2, 1, 0.5, 0.25, 0.1, or 0.05% of the amplified products are primer dimers. In some embodiments, the library includes primers that simultaneously amplify at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci such that at least 50, 60, 70, 80, 90, 95, 96, 97, 98, 99, or 99.5% of the amplified products are target amplicons. In some embodiments, the library includes primers that simultaneously amplify target loci such that at least 50, 60, 70, 80, 90, 95, 96, 97, 98, 99, or 99.5% of the target loci out of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, 99.5, or 100% of the target loci are amplified at least 5, 10, 20, 40, 50, 60, 80, 100, 120, 150, 200, 300, or 400-fold. In some embodiments, the library of primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers or primer pairs. In some embodiments, the library of primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 primer pairs, wherein each pair of primers includes a forward test primer and a reverse test primer where each pair of test primers hybridize to a target locus. In some embodiments, the library of primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 individual primers that each hybridize to a different target locus, wherein the individual primers are not part of primer pairs. In some embodiments, the primers in the library are not immobilized (such as not immobilized to a solid support) or not part of a microarray. In some embodiments, the primers are dissolved in solution (such as dissolved in the liquid phase). In some embodiments, the library of primers consists essentially of, or consists of primers.

In some embodiments, $\Delta G$ values for each possible combination of two primers (each possible primer dimer) in a library are all equal to or greater than $-20$, $-18$, $-16$, $-14$, $-12$, $-10$, $-9$, $-8$, $-7$, $-6$, $-5$, $-4$, $-3$, $-2$, or $-1$ kcal/mol. In some embodiments, $\Delta G$ values for at least 80, 85, 90, 92, 94, 96, 98, 99, or 100% of the primers in the library for possible combinations of that primer with other primers in the library are all equal to or greater than $-20$, $-18$, $-16$, $-14$, $-12$, $-10$, $-9$, $-8$, $-7$, $-6$, $-5$, $-4$, $-3$, $-2$, or $-1$ kcal/mol.

In various embodiments of any of the aspects of the invention, the library of primers includes one or more primers (e.g., at least 10; 20; 50; 25; 50; 75; 100; 300; 500; 750; 1,000; 2,000; 5,000; 7,500; 10,000; 15,000; 20,000; 25,000; 30,000; 40,000; or 50,000 different primers) with at least 60, 70, 80, 90, 95, 96, 97, 98, 99, 99.5, or 100% identity to the corresponding region (e.g., a region of at least 10, 20, 30, 40, 50, or more contiguous nucleotides) of a primer in FIG. 34 (SEQ ID NOs. 1-3,600), FIG. 35 (SEQ ID NOs. 3,601-11,658), or FIG. 36 (SEQ ID NOs 11,659-44,610). In some embodiments, the library of primers includes one or more primers (e.g., at least 10; 20; 50; 25; 50; 75; 100; 300; 500; 750; 1,000; 2,000; 5,000; 7,500; 10,000; 15,000; 20,000; 25,000; 30,000; 40,000; or 50,000 different primers) with at least 60, 70, 80, 90, 95, 96, 97, 98, 99, 99.5, or 100% identity over the entire length of a primer in FIG. 34 (SEQ ID NOs. 1-3,600), FIG. 35 (SEQ ID NOs. 3,601-11,658), or FIG. 36 (SEQ ID NOs 11,659-44,610). In some embodiments, the library of primers includes at least 10; 20; 50; 75; 100; 300; 500; 750; 1,000; 2,000; 5,000; 7,500; 10,000; 15,000; 20,000; 25,000; 30,000; 40,000; or 50,000 different primers from the primers in FIG. 34 (SEQ ID NOs. 1-3,600), FIG. 35 (SEQ ID NOs. 3,601-11,658), or FIG. 36 (SEQ ID NOs 11,659-44,610. In some embodiments, the library of primers includes one or more primers (e.g., at least 10; 20; 50; 75; 100; 300; 500; 750; 1,000; 2,000; 5,000; 7,500; 10,000; 15,000; 20,000; 25,000; 30,000; 40,000; or 50,000 different primers) that hybridize to the complement of a primer in FIG. 34 (SEQ ID NOs. 1-3,600), FIG. 35 (SEQ ID NOs. 3,601-11,658), or FIG. 36 (SEQ ID NOs 11,659-44, 610) under very high stringency hybridization conditions or under high stringency hybridization conditions.

In various embodiments of any of the aspects of the invention, the concentration of each primer is less than 100, 75, 50, 25, 10, 5, 2, 1, 0.5, 0.1, or 0.05 nM. In various embodiments, the GC content of the primers is between 30 to 80%, such as between 40 to 70%, 20 to 70%, or 50 to 60%, inclusive. In some embodiments, the range of GC content of the primers is less than 30, 20, 10, or 5%. In some embodiments, there are at least 2 (such as 3, 4, or 5) guanines or cytosines in the last 5 bases at the 3' end of the primers. In some embodiments, there are at least 1 (such as 2 or 3) guanines or cytosines in the last 3 bases at the 3' end of the primers. In some embodiments, a maximum of 2 (such as 2, 1, or 0) bases in the last 5 bases at the 3' end of the primers are guanines or cytosines. In some embodiments, the melting temperature of the primers is between 40 to 80° C., such as 50 to 70° C., 55 to 65° C., 54 to 60.5° C., or 57 to 60.5° C., inclusive. In some embodiments, the range of melting temperature of the primers is less than 15, 10, 5, 3, or 1° C. In some embodiments, the length of the primers is between 15 to 100 nucleotides, such as between 15 to 75 nucleotides, 15 to 40 nucleotides, 17 to 35 nucleotides, 18 to 30 nucleotides, or 20 to 65 nucleotides, inclusive. In some embodiments, the primers include a tag that is not target specific, such as a tag that forms an internal loop structure. In some embodiments, the tag is between two DNA binding regions. In various embodiments, the primers include a 5' region that is specific for a target locus, an internal region that is not specific for the target locus and forms a loop structure, and a 3' region that is specific for the target locus. In various embodiments, the length of the 3' region is at least 7 nucleotides. In some embodiments, the length of the 3' region is between 7 and 20 nucleotides, such as between 7 to 15 nucleotides, or 7 to 10 nucleotides, inclusive. In various embodiments, the primers include a 5' region that is not specific for a target locus (such as another tag or a universal primer binding site) followed by a region that is specific for a target locus, an internal region that is not specific for the target locus and forms a loop structure, and a 3' region that is specific for the target locus. In some embodiments, the range of the length of the primers is less than 50, 40, 30, 20, 10, or 5 nucleotides. In some embodiments, the length of the target amplicons is between 50 and 100 nucleotides, such as between 60 and 80 nucleotides, or 60 to 75 nucleotides, inclusive. In some embodiments, the range of the length of the target amplicons is less than 50, 25, 15, 10, or 5 nucleotides. In some embodiments, the target loci are on two or more different chromosomes, such as two or more of chromosomes 13, 18, 21, X and Y. In some embodiments, the target loci are target human loci. In some embodiments, the target loci include a sequence (e.g., a polymorphism or other mutation) associated with an increased risk for the disease or phenotype of interest (such as cancer), or associated with the disease or phenotype of interest (such as cancer). In some embodiments, the polymorphism or mutation is a driver mutation that has a causative role in the disease or phenotype of interest (such as cancer). In some embodiments, the polymorphism or mutation is not a causative mutation. For example, in some cancers, multiple mutations accumulate but some of them are not causative mutations. Polymorphisms or mutations (such as those that are present at a higher frequency in subjects with a disease or phenotype of interest such as cancer than subjects without the disease or phenotype of interest such as cancer) that are not causative can still be useful for diagnosing the disease or phenotype. In some embodiments, the polymorphisms or mutation is present at a higher frequency in subjects with a disease or disorder (such as cancer) than subjects (such as healthy or normal subjects) without the disease or disorder (such as cancer). In some embodiments, the polymorphisms or mutation is indicative of cancer, such as a causative mutation. In some embodiments, the polymorphism(s) or mutation(s) are directly detected. In some embodiments, the polymorphism(s) or mutation(s) are indirectly detected by detection of one or more sequences (e.g., a polymorphic locus such as a SNP) that are linked to the polymorphism or mutation.

In one aspect, the invention provides a composition that includes any of the primer libraries of the invention (such as non-immobilized primers). In some embodiments, the composition includes one or more free nucleotides (such as deoxynucleotides, ATP, CTP, GTP, TTP, UTP, dATP, dCTP, dGTP, dTTP, dUTP an activated nucleotide or deoxynucleotide, or a non-naturally occurring nucleotide or deoxynucleotide). In some embodiments, the composition includes at least one primer (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers) with a polynucleotide sequence of a human nucleic acid and at least one primer (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers) with a polynucleotide sequence that is not found in a human (such as a universal primer, a primer that comprises a region or consists entirely of random nucleotides, or a primer with a region such as a tag or barcode of one or more nucleotides that are not found in a human or are not found in nature as part of the polynucleotide sequence of the primer). In some embodiments, the composition includes at least one primer (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers) with the polynucleotide sequence of a human nucleic acid and one or more non-human or non-naturally occurring enzymes (e.g., ligase or polymerase from a species other than a human, such as a bacterial or non-naturally-occurring ligase or polymerase). In some embodiments, the composition includes at least one primer (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers) with the polynucleotide sequence of a human nucleic acid and a buffer or additive that is non-naturally-occurring or is not found in a human. In some embodiments, the composition comprises, consists essentially of, or consists of one or more of the following: primer(s), amplicon(s) free nucleotide(s), non-human or non-naturally occurring enzyme(s), buffer(s), additive(s), or any combination thereof. In some embodiments, the composition comprises, consists essentially of, or consists of primers and one or more non-human or non-naturally occurring enzymes. Exemplary non-naturally occurring enzymes contain at least one sequence difference compared to naturally occurring (wild-type) enzymes.

In one aspect, the invention provides a composition comprising at least 100 different amplicons (e.g., at least 300, 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical amplicons) in solution in one reaction volume. In some embodiments, the amplicons are produced from the simultaneous PCR amplification of at least 100 different target loci (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical target loci) using at least 100 different primers or primer pairs (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers or primer pairs) in one reaction volume. In some embodiments, (i) less than 60% of the amplified products are primer dimers and at least 40% of the amplified products are target amplicons, (ii) less than 40% of the amplified products are primer dimers and at least 60% of the amplified products are target amplicons, (iii) less than 20% of the amplified products are primer dimers and at least 80% of the amplified products are target amplicons, (iv) less than 10% of the amplified products are primer dimers and at least 90% of the amplified products are target amplicons, or (v) less than 5% of the amplified products are primer dimers and at least 95% of the amplified products are target amplicons. In some embodiments, the length of the target amplicons is between 50 and 100 nucleotides, such as between 60 and 80 nucleotides, or 60 and 75 nucleotides, inclusive. In some embodiments, the range of the length of the target amplicons is less than 50, 25, 15, 10, or 5 nucleotides. In some embodiments, the range of the length of the target amplicons is between 5 to 50 nucleotides, such as 5 to 25 nucleotides, 5 to 15 nucleotides, or 5 to 10 nucleotides, inclusive. In some embodiments, the composition includes at least 1,000 different amplicons in solution in one reaction volume. In some embodiments, the amplicons are produced from the simultaneous PCR amplification of at least 1,000 different target human loci using at least 1,000 different primers in one reaction volume; wherein (i) less than 20% of the amplicons are primer dimers, and (ii) at least 80% of the amplicons comprise one of the target human loci and are between 50 and 100 nucleotides in length, inclusive. In some embodiments, the composition consists essentially of, or consists of one or more of the following: amplicons, primers (such as any of the primers disclosed herein), free nucleotide(s), non-human or non-naturally occurring enzyme(s), buffer(s), or any combination thereof. In some embodiments, at least one amplicon or primer has a non-human or non-naturally occurring sequence, nucleotide, or linkage between nucleotides.

In one aspect, the invention provides a composition comprising at least 100 different primers or primer pairs (e.g., at least 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers or primer pairs) and at least 100 different amplicons (e.g., at least 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical amplicons) in solution in one reaction volume. In some embodiments, the amplicons are produced from the simultaneous PCR amplification of at least 100 different target loci (e.g., at least 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical target loci) using the primers or primer pairs in one reaction volume. In some embodiments, (i) less than 60% of the amplified products are primer dimers and at least 40% of the amplified products are target amplicons, (ii) less than 40% of the amplified products are primer dimers and at least 60% of the amplified products are target amplicons, (iii) less than 20% of the amplified products are primer dimers and at least 80% of the amplified products are target amplicons, (iv) less than 10% of the amplified products are primer dimers and at least 90% of the amplified products are target amplicons, or (v) less than 5% of the amplified products are primer dimers and at least 95% of the amplified products are target amplicons. In some embodiments, the length of the target amplicons is between 50 and 100 nucleotides, such as between 60 and 80 nucleotides, or 60 and 75 nucleotides, inclusive. In some embodiments, the range of the length of the target amplicons is less than 50, 25, 15, 10, or 5 nucleotides. In some embodiments, the range of the length of the target amplicons is between 5 to 50 nucleotides, such as 5 to 25 nucleotides, 5 to 15 nucleotides, or 5 to 10 nucleotides, inclusive. In some embodiments, the composition comprising at least 1,000 different primers and at least 1,000 different amplicons in solution in one reaction volume. In some embodiments, the amplicons are produced from the simultaneous PCR amplification of at least 1,000 different target human loci with the primers in one reaction volume; wherein (i) less than 20% of the amplicons are primer dimers, and (ii) at least 80% of the amplicons comprise one of the target loci and are between 50 and 100 nucleotides in length, inclusive. In some embodiments, the composition consists essentially of, or consists of one or more of the following: amplicons, primers (such as any of the primers disclosed herein), free nucleotide(s), non-human or non-naturally occurring enzyme(s), buffer(s), or any combination thereof. In some embodiments, at least one amplicon or primer has a non-human or non-naturally occurring sequence, nucleotide, or linkage between nucleotides.

In one aspect, the invention provides kits that include any of the primer libraries or compositions of the invention for amplifying target loci in a nucleic acid sample. In some embodiments, the kits consist essentially of, or consists of primers, primers and instructions for using the primers, a composition of the invention, or a composition of the invention and instructions for using the composition. In some embodiments, the kit includes instructions for using the library to amplify the target loci.

In one aspect, the invention provides an apparatus, device, or composition that includes any of the primer libraries or compositions of the invention. In some embodiments, the apparatus, device, or composition includes a physical structure (such as one or more reaction vessels, reaction chambers, or wells) that contains the primer library or composition of the invention (for example, the primers may be dissolved in a solution that is in the physical structure). In some embodiments, the physical structure is a non-naturally occurring physical structure or a physical structure that does not naturally contain a primer library or composition of the invention (such as a physical structure that is not found in nature with nucleic acids in it).

In one aspect, the invention features methods for determining a ploidy status of chromosome in a gestating fetus. In some embodiments, the method involves contacting a nucleic acid sample with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci to produce a reaction mixture; wherein the nucleic acid sample includes maternal DNA from the mother of the fetus and fetal DNA from the fetus. In some embodiments, the reaction mixture is subjected to primer extension reaction conditions to produce amplified products; the amplified products are measured with a high throughput sequencer to produce sequencing data; allele counts at the polymorphic loci are calculated on a computer based on the sequencing data; a plurality of ploidy hypotheses each pertaining to a different possible ploidy state of the chromosome are created on a computer; a joint distribution model for the expected allele counts at the polymorphic loci on the chromosome is built on a computer for each ploidy hypothesis; a relative probability of each of the ploidy hypotheses is determined on a computer using the joint distribution model and the allele counts; and the ploidy state of the fetus is called by selecting the ploidy state corresponding to the hypothesis with the greatest probability.

In one aspect, the invention features methods for determining a ploidy status of a chromosome in a gestating fetus. In an embodiment a method for determining a ploidy status of a chromosome in a gestating fetus includes obtaining a first sample of DNA that comprises maternal DNA from the mother of the fetus and fetal DNA from the fetus, preparing the first sample by isolating the DNA so as to obtain a prepared sample, measuring the DNA in the prepared sample at a plurality of polymorphic loci on the chromosome, calculating, on a computer, allele counts at the plurality of polymorphic loci from the DNA measurements made on the prepared sample, creating, on a computer, a plurality of ploidy hypotheses each pertaining to a different possible ploidy state of the chromosome, building, on a computer, a joint distribution model for the expected allele counts at the plurality of polymorphic loci on the chromosome for each ploidy hypothesis, determining, on a computer, a relative probability of each of the ploidy hypotheses using the joint distribution model and the allele counts measured on the prepared sample, and calling the ploidy state of the fetus by selecting the ploidy state corresponding to the hypothesis with the greatest probability.

In one aspect, the invention features methods of testing for an abnormal distribution of a chromosome in a sample that includes a mixture of maternal and fetal DNA. In some embodiments, the method involves (i) contacting the sample with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci to produce a reaction mixture; wherein the target loci are from a plurality of different chromosomes; and wherein the plurality of different chromosomes include at least one first chromosome suspected of having an abnormal distribution in the sample and at least one second chromosome presumed to be normally distributed in the sample; (ii) subjecting the reaction mixture to primer extension reaction conditions to produce amplified products; (iii) sequencing the amplified products to obtain a plurality of sequence tags aligning to the target loci; wherein the sequence tags are of sufficient length to be assigned to a specific target locus; (iv) assigning on a computer the plurality of sequence tags to their corresponding target loci; (v) determining on a computer a number of sequence tags aligning to the target loci of the first chromosome and a number of sequence tags aligning to the target loci of the second chromosome; and (vi) comparing on a computer the numbers from step (v) to determine the presence or absence of an abnormal distribution of the first chromosome.

In one aspect, the invention provides methods for detecting the presence or absence of a fetal aneuploidy. In some embodiments, the method involves (i) contacting a sample that includes a mixture of maternal and fetal DNA with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different non-polymorphic target loci to produce a reaction mixture; wherein the target loci are from a plurality of different chromosomes; (ii) subjecting the reaction mixture to primer extension reaction conditions to produce amplified products that includes target amplicons; (iii) quantifying on a computer a relative frequency of the target amplicons from the first and second chromosomes of interest; (iv) comparing on a computer the relative frequency of the target amplicons from the first and second chromosomes of interest; and (v) identifying the presence or absence of an aneuploidy based on the compared relative frequencies of the first and second chromosome of interest. In some embodiments, the first chromosome is a chromosome suspected of being euploid. In some embodiments, the second chromosome is a chromosome suspected of being aneuploidy.

In one aspect, a method is disclosed for determining presence or absence of fetal aneuploidy in a maternal tissue sample comprising fetal and maternal genomic DNA, the method including (a) obtaining a mixture of fetal and maternal genomic DNA from said maternal tissue sample, (b) conducting massively parallel DNA sequencing of DNA fragments randomly selected from the mixture of fetal and maternal genomic DNA of step (a) to determine the sequence of said DNA fragments, (c) identifying chromosomes to which the sequences obtained in step (b) belong, (d) using the data of step (c) to determine an amount of at least one first chromosome in said mixture of maternal and fetal genomic DNA, wherein said at least one first chromosome is presumed to be euploid in the fetus, (e) using the data of step (c) to determine an amount of a second chromosome in said mixture of maternal and fetal genomic DNA, wherein said second chromosome is suspected to be aneuploid in the fetus, (f) calculating the fraction of fetal DNA in the mixture of fetal and maternal DNA, (g) calculating an expected distribution of the amount of the second target chromosome if the second target chromosome is euploid, using the number in step (d), (h) calculating an expected distribution of the amount of the second target chromosome if the second target chromosome is aneuploid, using the first number is step (d) and the calculated fraction of fetal DNA in the mixture of fetal and maternal DNA in step (f), and (i) using a maximum likelihood or maximum a posteriori approach to determine whether the amount of the second chromosome as determined in step (e) is more likely to be part of the distribution calculated in step (g) or the distribution calculated in step (h); thereby indicating the presence or absence of a fetal aneuploidy.

In various embodiments of any of the aspects of the invention, the target loci include one or more SNPs in the homologous non-recombining region of chromosome X and/or chromosome Y. In some embodiments, the method includes determining the relative amount of chromosome X and chromosome Y. In some embodiments, the method includes determining the number of copies of chromosome X and/or chromosome Y.

In some embodiments, the method also includes obtaining genotypic data from one or both parents of the fetus. In some embodiments, obtaining genotypic data from one or both parents of the fetus includes preparing the DNA from the parents where the preparing comprises preferentially enriching the DNA at the plurality of polymorphic loci to give prepared parental DNA, optionally amplifying the prepared parental DNA, and measuring the parental DNA in the prepared sample at the plurality of polymorphic loci.

In various embodiments of any of the aspects of the invention, building a joint distribution model for the expected allele count probabilities of the plurality of polymorphic loci on the chromosome is done using the obtained genetic data from the one or both parents. In some embodiments, the sample (e.g., the first sample) has been isolated from maternal plasma and where the obtaining genotypic data from the mother is done by estimating the maternal genotypic data from the DNA measurements made on the prepared sample.

In one aspect, a diagnostic box is disclosed for helping to determine a ploidy status of a chromosome in a gestating fetus where the diagnostic box is capable of executing the preparing and measuring steps of any of the methods of the invention.

In various embodiments of any of the aspects of the invention, the allele counts are probabilistic rather than binary. In some embodiments, measurements of the DNA in the prepared sample at the plurality of polymorphic loci are also used to determine whether or not the fetus has inherited one or a plurality of disease linked haplotypes.

In various embodiments of any of the aspects of the invention, building a joint distribution model for allele count probabilities is done by using data about the probability of chromosomes crossing over at different locations in a chromosome to model dependence between polymorphic alleles on the chromosome. In some embodiments, building a joint distribution model for allele counts and the step of determining the relative probability of each hypothesis are done using a method that does not require the use of a reference chromosome.

In various embodiments of any of the aspects of the invention, determining the relative probability of each hypothesis makes use of an estimated fraction of fetal DNA in the prepared sample. In some embodiments, the DNA measurements from the prepared sample used in calculating allele count probabilities and determining the relative probability of each hypothesis comprise primary genetic data. In some embodiments, selecting the ploidy state corresponding to the hypothesis with the greatest probability is carried out using maximum likelihood estimates or maximum a posteriori estimates.

In various embodiments of any of the aspects of the invention, calling the ploidy state of the fetus also includes combining the relative probabilities of each of the ploidy hypotheses determined using the joint distribution model and the allele count probabilities with relative probabilities of each of the ploidy hypotheses that are calculated using statistical techniques taken from a group consisting of a read count analysis, comparing heterozygosity rates, a statistic that is only available when parental genetic information is used, the probability of normalized genotype signals for certain parent contexts, a statistic that is calculated using an estimated fetal fraction of the sample (e.g., the first sample) or the prepared sample, and combinations thereof.

In various embodiments of any of the aspects of the invention, a confidence estimate is calculated for the called ploidy state. In some embodiments, the method also includes taking a clinical action based on the called ploidy state of the fetus, wherein the clinical action is selected from one of terminating the pregnancy or maintaining the pregnancy.

In various embodiments of any of the aspects of the invention, the method may be performed for fetuses at between 4 and 5 weeks gestation; between 5 and 6 weeks gestation; between 6 and 7 weeks gestation; between 7 and 8 weeks gestation; between 8 and 9 weeks gestation; between 9 and 10 weeks gestation; between 10 and 12 weeks gestation; between 12 and 14 weeks gestation; between 14 and 20 weeks gestation; between 20 and 40 weeks gestation; in the first trimester; in the second trimester; in the third trimester; or combinations thereof.

In various embodiments of any of the aspects of the invention, a report displaying a determined ploidy status of a chromosome in a gestating fetus generated using the method. In some embodiments, a kit is disclosed for determining a ploidy status of a target chromosome in a gestating fetus designed to be used with any of the methods of the invention, the kit including a plurality of inner forward primers and optionally the plurality of inner reverse primers, where each of the primers is designed to hybridize to the region of DNA immediately upstream and/or downstream from one of the polymorphic sites on the target chromosome, and optionally additional chromosomes, where the region of hybridization is separated from the polymorphic site by a small number of bases, where the small number is selected from the group consisting of 1, 2, 3, 4, 5, 6 to 10, 11 to 15, 16 to 20, 21 to 25, 26 to 30, 31 to 60, and combinations thereof.

In one aspect, the invention features methods for establishing whether an alleged father is the biological father of a fetus that is gestating in a pregnant mother. In some embodiments the method involves, (i) simultaneously amplifying a plurality of polymorphic loci that includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci on genetic material from the alleged father to produce a first set of amplified products; (ii) simultaneously amplifying the corresponding plurality of polymorphic loci on a mixed sample of DNA originating from a blood sample from the pregnant mother to produce a second set of amplified products; wherein the mixed sample of DNA includes fetal DNA and maternal DNA; (iii) determining on a computer the probability that the alleged father is the biological father of the fetus using genotypic measurements based on the first and second sets of amplified products; and (iv) establishing whether the alleged father is the biological father of the fetus using the determined probability that the alleged father is the biological father of the fetus. In various embodiments, the method further includes simultaneously amplifying the corresponding plurality of polymorphic loci on genetic material from the mother to produce a third set of amplified products; wherein the probability that the alleged father is the biological father of the fetus is determined using genotypic measurements based on the first, second, and third sets of amplified products.

In one aspect, the invention provides methods of estimating relative likelihoods that each embryo from a set of embryos will develop as desired. In some embodiments, the method involves contacting a sample from each embryo with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci to produce a reaction mixture for each embryo, wherein the samples are each derived from one or more cells from an embryo. In some embodiments, each reaction mixture is subjected to primer extension reaction conditions to produce amplified products. In some embodiments, the method includes determining on a computer one or more characteristics of at least one cell from each embryo based on the amplified products; and estimating on a computer the relative likelihoods that each embryo will develop as desired, based on the one or more characteristics of the at least one cell for each embryo.

In one aspect, the invention features methods of measuring the amount of two or more target loci in a nucleic acid sample. In some embodiments, the method involves (i) using PCR to amplify a nucleic acid sample that includes a first standard locus, a second standard locus, a first target locus, and a second target locus to form amplified products; wherein the first standard locus and the first target locus have the same number of nucleotides but have a sequence that differs at one or more nucleotides; and wherein the second standard locus and the second target locus have the same number of nucleotides but have a sequence that differs at one or more nucleotides; (ii) sequencing the amplified products to determine a standard ratio that compares the relative amount of the amplified first standard locus compared to the amplified second standard locus; wherein the standard ratio indicates the difference in PCR efficiency for the amplification of the first standard locus and the second standard locus; (iii) determining a target ratio that compares the relative amount of the amplified first target locus compared to the amplified second target locus; and (iv) adjusting the target ratio from step (iii) based on the standard ratio from step (ii) to determine the relative amount of the first target locus and the second target locus in the sample. In various embodiments, the method involves determining the absolute amount of the first target locus and the second target locus in the sample. In various embodiments, the method further includes determining the presence or absence of a target locus (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci) in the sample. In various embodiments, the method involves using any of the primer libraries of the invention. In various embodiments, the method involves simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci.

In one aspect, the invention features methods of quantitatively measuring a plurality of genetic targets in a sample for analysis. In some embodiments, the method includes (i) mixing genetic material derived from the sample for analysis with a plurality of target specific amplification reagents, and a plurality of standard sequences corresponding to the target specific amplification reagent targets; (ii) amplifying target regions of the genetic material and the standard sequences to produce target amplicons and standard sequence amplicons; and (iii) measuring the quantity of target amplicons and standard sequence amplicons produced. In some embodiments, the genetic material is present in a genetic library. In some embodiments, the genetic targets are polymorphic loci (such as SNPs). In some embodiments, the measuring of quantity is achieved by counting sequences. In some embodiments, the method further includes determining the estimated copy number of at least one chromosome in a sample from which the genetic library was derived, wherein the determination involves comparing the number of sequence reads of a target amplicon with the number of sequence reads of a standard amplicon. In some embodiments, the standard sequences and the genetic library include universal priming sites cable of being primed by the same primer. In some embodiments, the mixing step includes at least 10; 100; 500; 1,000; 2,000; 5,000; 7,500; 10,000; 15,000; 19,000; 20,000; 25,000; 27,000; 28,000; 30,000; 40,000; 50,000; 75,000; or 100,000 different target specific amplification reagents and at least 10; 100; 500; 1,000; 2,000; 5,000; 7,500; 10,000; 15,000; 19,000; 20,000; 25,000; 27,000; 28,000; 30,000; 40,000; 50,000; 75,000; or 100,000 standard sequences. In various embodiments, the method involves using any of the primer libraries of the invention. In various embodiments, the method involves simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target regions. In some embodiments, the relative amounts of each of the standard sequences are known. In some embodiments, the relative amounts of each of the sequences is has been calibrated with respect to a reference genome. In some embodiments, the sample for analysis includes a mixture of fetal and maternal genomes. In some embodiments, the sample for analysis is derived from the blood of a pregnant woman or derived from blood plasma. In some embodiments, the reference genome has at least one aneuploidy, such as an aneuploidy at chromosome 13, 18, 21, X, or Y. In some embodiments, the reference genome is diploid.

In one aspect, the invention features a mixture that includes a plurality of genetic standard sequences, wherein the relative amount of each genetic standard sequence in the mixture has been determined by calibration to a reference genome. In various embodiments, the mixture includes at least 10; 100, 500; 1,000; 2,000; 5,000; 7,500; 10,000; 15,000; 19,000; 20,000; 25,000; 27,000; 28,000; 30,000; 40,000; 50,000; 75,000; or 100,000 genetic standard sequences. In various embodiments, the genetic standard sequences include a first universal priming site, a second universal priming site, a first target specific priming site, a second target specific priming site, and a marker sequence located between the first and second target specific priming sites, wherein the first target specific site and the second target specific priming site are located between the first and second universal priming sites. In various embodiments, the calibration involves using any of the primer libraries of the invention. In various embodiments, the calibration involves simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target regions. In some embodiments, the reference genome has at least one aneuploidy, such as an aneuploidy at chromosome 13, 18, 21, X, or Y. In some embodiments, the reference genome is diploid.

In one aspect, the invention features methods of producing a set of calibrated genetic standard sequences. In some embodiments, the method includes (i) forming an amplification reaction mixture that includes a genetic library prepared from a reference genome, a plurality of target-specific amplification primer reagent sets, and a plurality of genetic standard sequences corresponding to the target specific amplification reagent sets, (ii) amplifying the genetic library and the genetic standard sequences to produce amplicons from the target sequences and amplicons from the genetic standard sequences, (iii) measuring the quantity of the amplicons from the target sequences and amplicons from the genetic standard sequences, and (iv) determining the relative amount of each of genetic standard sequences with respect to each other, whereby the plurality of genetic standard sequences is calibrated. In various embodiments, at least 10; 100, 500; 1,000; 2,000; 5,000; 7,500; 10,000; 15,000; 19,000; 20,000; 25,000; 27,000; 28,000; 30,000; 40,000; 50,000; 75,000; or 100,000 genetic standard sequences are used. In various embodiments, the method involves using any of the primer libraries of the invention. In various embodiments, the method involves simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different sequences. In some embodiments, the reference genome has at least one aneuploidy, such as an aneuploidy at chromosome 13, 18, 21, X, or Y. In some embodiments, the reference genome is diploid.

In one aspect, the invention provides a set of genetic standard sequences that have been calibrated according to any of the methods of the invention. In one aspect, the invention provides a set of genetic standard sequences that may be calibrated either before, during or after the method is performed.

In one aspect, the invention features methods of measuring the number of copies of a gene of interest having at least one allele that has a deletion. In some embodiments, the method includes (i) mixing genetic material derived from a sample for analysis with an amplification reagent specific for the gene of interest and not capable of significantly amplifying the deletion comprising allele of the gene of interest, a standard sequence corresponding to gene of interest, an amplification reagent specific for a reference sequence, and a standard sequence corresponding to the reference sequence; (ii) amplifying the gene sequence of interest, the standard sequence corresponding to the gene of interest, the reference sequence, and the standard sequence corresponding to the reference sequence to produce gene of interest amplicons, reference sequence amplicons, and standard sequence amplicons; and (iii) measuring the quantity of target amplicons and standard sequence amplicons produced. In some embodiments, the measuring of quantity is achieved by counting sequence reads. In some embodiments, the method further includes determining the estimated copy number of at least one chromosome in the sample from which the genetic library was derived, wherein the determination involves comparing the number of sequences of target amplicons with the number of sequences of standard amplicons. In some embodiments, the standard sequences and the genetic library include universal priming sites capable of being primed by the same primer. In some embodiments, the relative amounts of each of the sequences have been calibrated with respect to a reference genome. In various embodiments, at least 10; 100; 500; 1,000; 2,000; 5,000; 7,500; 10,000; 15,000; 19,000; 20,000; 25,000; 27,000; 28,000; 30,000; 40,000; 50,000; 75,000; or 100,000 genetic standard sequences are used. In various embodiments, the method involves using any of the primer libraries of the invention. In various embodiments, the method involves simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target regions. In some embodiments, the reference genome is diploid. In some embodiments, the sample for analysis is derived from blood.

In some embodiments of any of the aspects of the invention, preferentially enriching the DNA in the sample (e.g., the first sample) at the target loci (e.g., the plurality of polymorphic loci) includes obtaining a plurality of pre-circularized probes where each probe targets one of the loci (e.g., polymorphic loci), where the 3' and 5' end of the probes are preferably designed to hybridize to a region of DNA that is separated from the polymorphic site of the locus by a small number of bases, where the small number is 1, 2, 3, 4, 5, 6, 7, 8, 9, 10, 11, 12, 13, 14, 15, 16, 17, 18, 19, 20, 21 to 25, 26 to 30, 31 to 60, or a combination thereof, hybridizing the pre-circularized probes to DNA from the sample (e.g., the first sample), filling the gap between the hybridized probe ends using DNA polymerase, circularizing the pre-circularized probe, and amplifying the circularized probe.

In some embodiments of any of the aspects of the invention, the preferentially enriching the DNA at the target loci (e.g., the plurality of polymorphic loci) includes obtaining a plurality of ligation-mediated PCR probes where each PCR probe targets one of the target loci (e.g., the polymorphic loci), and where the upstream and downstream PCR probes are designed to hybridize to a region of DNA on one strand of DNA that is preferably separated from the polymorphic site of the locus by a small number of bases, where the small number is 1, 2, 3, 4, 5, 6, 7, 8, 9, 10, 11, 12, 13, 14, 15, 16, 17, 18, 19, 20, 21 to 25, 26 to 30, 31 to 60, or a combination thereof, hybridizing the ligation-mediated PCR probes to the DNA from the sample (e.g., the first sample), filling the gap between the ligation-mediated PCR probe ends using DNA polymerase, ligating the ligation-mediated PCR probes, and amplifying the ligated ligation-mediated PCR probes.

In some embodiments of various aspects of the invention, preferentially enriching the DNA at the target loci (e.g., plurality of polymorphic loci) includes obtaining a plurality of hybrid capture probes that target the loci (e.g., the polymorphic loci), hybridizing the hybrid capture probes to the DNA in the sample (e.g., the first sample) and physically removing some or all of the unhybridized DNA from the sample (e.g., the first sample) of DNA.

In some embodiments of any of the aspects of the invention, the hybrid capture probes are designed to hybridize to a region that is flanking but not overlapping the polymorphic site. In some embodiments, the hybrid capture probes are designed to hybridize to a region that is flanking but not overlapping the polymorphic site, and where the length of the flanking capture probe may be selected from the group consisting of less than about 120 bases, less than about 110 bases, less than about 100 bases, less than about 90 bases, less than about 80 bases, less than about 70 bases, less than about 60 bases, less than about 50 bases, less than about 40 bases, less than about 30 bases, and less than about 25 bases. In some embodiments, the hybrid capture probes are designed to hybridize to a region that overlaps the polymorphic site, and where the plurality of hybrid capture probes comprise at least two hybrid capture probes for each polymorphic loci, and where each hybrid capture probe is designed to be complementary to a different allele at that polymorphic locus.

In some embodiments of any of the aspects of the invention, preferentially enriching the DNA a plurality of polymorphic loci includes obtaining a plurality of inner forward primers where each primer targets one of the polymorphic loci, and where the 3' end of the inner forward primers are designed to hybridize to a region of DNA upstream from the polymorphic site, and separated from the polymorphic site by a small number of bases, where the small number is selected from the group consisting of 1, 2, 3, 4, 5, 6 to 10, 11 to 15, 16 to 20, 21 to 25, 26 to 30, or 31 to 60 base pairs, optionally obtaining a plurality of inner reverse primers where each primer targets one of the polymorphic loci, and where the 3' end of the inner reverse primers are designed to hybridize to a region of DNA upstream from the polymorphic site, and separated from the polymorphic site by a small number of bases, where the small number is selected from the group consisting of 1, 2, 3, 4, 5, 6 to 10, 11 to 15, 16 to 20, 21 to 25, 26 to 30, or 31 to 60 base pairs, hybridizing the inner primers to the DNA, and amplifying the DNA using the polymerase chain reaction to form amplicons.

In some embodiments of any of the aspects of the invention, the method also includes obtaining a plurality of outer forward primers where each primer targets one of the target (e.g., polymorphic loci), and where the outer forward primers are designed to hybridize to the region of DNA upstream from the inner forward primer, optionally obtaining a plurality of outer reverse primers where each primer targets one of the target loci (e.g., polymorphic loci), and where the outer reverse primers are designed to hybridize to the region of DNA immediately downstream from the inner reverse primer, hybridizing the first primers to the DNA, and amplifying the DNA using the polymerase chain reaction.

In some embodiments of any of the aspects of the invention, the method also includes obtaining a plurality of outer reverse primers where each primer targets one of the polymorphic loci, and where the outer reverse primers are designed to hybridize to the region of DNA immediately downstream from the inner reverse primer, optionally obtaining a plurality of outer forward primers where each primer targets one of the target loci (e.g., the polymorphic loci), and where the outer forward primers are designed to hybridize to the region of DNA upstream from the inner forward primer, hybridizing the first primers to the DNA, and amplifying the DNA using the polymerase chain reaction.

In some embodiments of any of the aspects of the invention, preparing the sample (e.g., the first sample) further includes appending universal adapters to the DNA in the sample (e.g., the first sample) and amplifying the DNA in the sample (e.g., the first sample) using the polymerase chain reaction. In some embodiments, at least a fraction of the amplicons that are amplified are less than 100 bp, less than 90 bp, less than 80 bp, less than 70 bp, less than 65 bp, less than 60 bp, less than 55 bp, less than 50 bp, or less than 45 bp, and where the fraction is 10%, 20%, 30%, 40%, 50%, 60%, 70%, 80%, 90%, or 99%.

In some embodiments of any of the aspects of the invention, amplifying the DNA is done in one or a plurality of individual reaction volumes, and where each individual reaction volume contains more than 100 different forward and reverse primer pairs, more than 200 different forward and reverse primer pairs, more than 500 different forward and reverse primer pairs, more than 1,000 different forward and reverse primer pairs, more than 2,000 different forward and reverse primer pairs, more than 5,000 different forward and reverse primer pairs, more than 10,000 different forward and reverse primer pairs, more than 20,000 different forward and reverse primer pairs, more than 50,000 different forward and reverse primer pairs, or more than 100,000 different forward and reverse primer pairs. In various embodiments of any of the aspects of the invention, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primer pairs are used.

In some embodiments of any of the aspects of the invention, preparing the sample (e.g., the first sample) further comprises dividing the sample (e.g., the first sample) into a plurality of portions, and where the DNA in each portion is preferentially enriched at a subset of the target loci (e.g., plurality of polymorphic loci). In some embodiments, the inner primers are selected by identifying primer pairs likely to form undesired primer duplexes and removing from the plurality of primers at least one of the pair of primers identified as being likely to form undesired primer duplexes. In some embodiments, the inner primers contain a region that is designed to hybridize either upstream or downstream of the targeted locus (e.g., the polymorphic locus), and optionally contain a universal priming sequence designed to allow PCR amplification. In some embodiments, at least some of the primers additionally contain a random region that differs for each individual primer molecule. In some embodiments, at least some of the primers additionally contain a molecular barcode.

In some embodiments of any of the aspects of the invention, preferential enrichment results in average degree of allelic bias between the prepared sample and the sample (e.g., the first sample) of a factor selected from the group consisting of no more than a factor of 2, no more than a factor of 1.5, no more than a factor of 1.2, no more than a factor of 1.1, no more than a factor of 1.05, no more than a factor of 1.02, no more than a factor of 1.01, no more than a factor of 1.005, no more than a factor of 1.002, no more than a factor of 1.001 and no more than a factor of 1.0001. In some embodiments, the plurality of polymorphic loci are SNPs. In some embodiments, measuring the DNA in the prepared sample is done by sequencing.

In some embodiments, the nucleic acids in the sample are non-specifically amplified prior to amplification of the target loci (such as specific amplification of the target loci with a primer library of the invention). In some embodiments, the non-specific amplification includes whole genome application (WGA), such as ligation-mediated PCR (LM-PCR), degenerate oligonucleotide primer PCR (DOP-PCR), or multiple displacement amplification (MDA). In some embodiments, the non-specific amplification includes universal PCR, such as adaptor-mediated universal PCR.

In some embodiments of any of the aspects of the invention, the target loci are present on the same nucleic acid of interest (e.g., the same chromosome or the same region of a chromosome). In some embodiments, at least some of the target loci are present on different nucleic acids of interest (e.g., different chromosomes). In some embodiments, the nucleic acid sample includes fragmented or digested nucleic acids. In some embodiments, the nucleic acid sample includes DNA, such as genomic DNA, cDNA, cell-free DNA (cfDNA), cell-free mitochondrial DNA (cf mDNA), cell-free DNA that originated from nuclear DNA (cf nDNA), cellular DNA, or mitochondrial DNA. In some embodiments, nucleic acid sample includes RNA, such as cfRNA, cellular RNA, cytoplasmic RNA, coding cytoplasmic RNA, non-coding cytoplasmic RNA, mRNA, miRNA, mitochondrial RNA, rRNA, or tRNA. In some embodiments, the nucleic acid sample includes DNA from a single cell, 2 cells, 3 cells, 4 cells, 5 cells, 6 cells, 7 cells, 8 cells, 9 cell, 10 cells, or more than 10 cells. In some embodiments, the nucleic acid sample is a blood or plasma sample that is substantially free of cells. In some embodiments, the nucleic acid sample includes or is derived from blood, plasma, saliva, semen, sperm, cell culture supernatant, mucus secretion, dental plaque, gastrointestinal tract tissue, stool, urine, hair, bone, body fluids, tears, tissue, skin, fingernails, blastomeres, embryos, amniotic fluid, chorionic villus samples, bile, lymph, cervical mucus, or a forensic sample. In some embodiments, the target loci are segments of human nucleic acids. In some embodiments, the target loci are segments of human nucleic acids found in the human genome. In some embodiments, the target loci comprise or consist of single nucleotide polymorphisms (SNPs). In some embodiments, the primers are DNA molecules.

In some embodiments of any of the aspects of the invention, the DNA in the sample (e.g., the first sample) originates from maternal plasma. In some embodiments, preparing the sample (e.g., the first sample) further comprises amplifying the DNA. In some embodiments, preparing the sample (e.g., the first sample) further comprises preferentially enriching the DNA in the sample (e.g., the first sample) at the target loci (e.g., a plurality of polymorphic loci).

In various embodiments, the primer extension reaction or the polymerase chain reaction includes the addition of one or more nucleotides by a polymerase. In some embodiments, greater than or equal to 5, 10, 20, 30, 40, 50, or 60 cycles of PCR are performed. In some embodiments, the amplification of loci is performed using a polymerase (e.g., a DNA polymerase, RNA polymerase, or reverse transcriptase) with low 5'→3' exonuclease and/or low strand displacement activity. In some embodiments, a DNA polymerase is used produce DNA amplicons using DNA as a template. In some embodiments, a RNA polymerase is used produce RNA amplicons using DNA as a template. In some embodiments, a reverse transcriptase is used produce cDNA amplicons using RNA as a template.

In various embodiments, the primer extension reaction or the polymerase chain reaction does not include ligation-mediated PCR. In various embodiments, the primer extension reaction or the polymerase chain reaction does not include the joining of two primers by a ligase. In various embodiments, the primers do not include Linked Inverted Probes (LIPs), which can also be called pre-circularized probes, pre-circularizing probes, circularizing probes, Padlock Probes, or Molecular Inversion Probes (MIPs). In some embodiments, the primers are not loopable primers. In some embodiments, the primers do not form a loop structure, for example, the primers do not comprise a 3' target specific portion, a stem (comprising a first loop forming region and a second loop forming region), and a loop portion. In various embodiments, the primer library, composition, kit, or method does not include an array (such as a microarray) or do no use an array (such as a microarray). In some embodiments, multiplex PCR and/or sequencing is performed without use of an array (such as a microarray). In some embodiments, the primer library, composition, kit, or method comprises a microarray. In some embodiments, the primers or the target loci do not comprise an STR allele (for example, the target loci may be non-polymorphic loci or the loci may comprise a polymorphism other than an STR allele). In some embodiments, some or all of the target loci comprise an STR allele.

It is understood that all of the aspects and embodiments of the invention described herein include "comprising," "consisting," and "consisting essentially of" aspects and embodiments. It is understood that aspects and embodiments of the invention described herein include combinations of any two or more of the aspects or embodiments of the invention.

Definitions

Single Nucleotide Polymorphism (SNP) refers to a single nucleotide that may differ between the genomes of two members of the same species. The usage of the term should not imply any limit on the frequency with which each variant occurs.

Sequence refers to a DNA sequence or a genetic sequence. It may refer to the primary, physical structure of the DNA molecule or strand in an individual. It may refer to the sequence of nucleotides found in that DNA molecule, or the complementary strand to the DNA molecule. It may refer to the information contained in the DNA molecule as its representation in silico.

Locus refers to a particular region of interest on the DNA (or corresponding RNA) of an individual, which may refer to a SNP, the site of a possible insertion or deletion, or the site of some other relevant genetic variation. Disease-linked SNPs may also refer to disease-linked loci.

Polymorphic Allele, also "Polymorphic Locus," refers to an allele or locus where the genotype varies between individuals within a given species. Some examples of polymorphic alleles include single nucleotide polymorphisms, short tandem repeats, deletions, duplications, and inversions.

Polymorphic Site refers to the specific nucleotides found in a polymorphic region that vary between individuals.

Allele refers to the genes that occupy a particular locus.

Genetic Data also "Genotypic Data" refers to the data describing aspects of the genome of one or more individuals. It may refer to one or a set of loci, partial or entire sequences, partial or entire chromosomes, or the entire genome. It may refer to the identity of one or a plurality of nucleotides; it may refer to a set of sequential nucleotides, or nucleotides from different locations in the genome, or a combination thereof. Genotypic data is typically in silico, however, it is also possible to consider physical nucleotides in a sequence as chemically encoded genetic data. Genotypic Data may be said to be "on," "of," "at," "from" or "on" the individual(s). Genotypic Data may refer to output measurements from a genotyping platform where those measurements are made on genetic material.

Genetic Material also "Genetic Sample" refers to physical matter, such as tissue or blood, from one or more individuals comprising DNA or RNA Noisy Genetic Data refers to genetic data with any of the following: allele dropouts, uncertain base pair measurements, incorrect base pair measurements, missing base pair measurements, uncertain measurements of insertions or deletions, uncertain measurements of chromosome segment copy numbers, spurious signals, missing measurements, other errors, or combinations thereof.

Confidence refers to the statistical likelihood that the called SNP, allele, set of alleles, ploidy call, or determined number of chromosome segment copies correctly represents the real genetic state of the individual.

Ploidy Calling, also "Chromosome Copy Number Calling," or "Copy Number Calling" (CNC), may refer to the act of determining the quantity and/or chromosomal identity of one or more chromosomes present in a cell.

Aneuploidy refers to the state where the wrong number of chromosomes (e.g., the wrong number of full chromosomes or the wrong number of chromosome segments, such as the presence of deletions or duplications of a chromosome segment) is present in a cell. In the case of a somatic human cell it may refer to the case where a cell does not contain 22 pairs of autosomal chromosomes and one pair of sex chromosomes. In the case of a human gamete, it may refer to the case where a cell does not contain one of each of the 23 chromosomes. In the case of a single chromosome type, it may refer to the case where more or less than two homologous but non-identical chromosome copies are present, or where there are two chromosome copies present that originate from the same parent. In some embodiments, the deletion of a chromosome segment is a microdeletion.

Ploidy State refers to the quantity and/or chromosomal identity of one or more chromosomes types in a cell.

Chromosome may refer to a single chromosome copy, meaning a single molecule of DNA of which there are 46 in a normal somatic cell; an example is 'the maternally derived chromosome 18'. Chromosome may also refer to a chromosome type, of which there are 23 in a normal human somatic cell; an example is 'chromosome 18'.

Chromosomal Identity may refer to the referent chromosome number, i.e. the chromosome type. Normal humans have 22 types of numbered autosomal chromosome types, and two types of sex chromosomes. It may also refer to the parental origin of the chromosome. It may also refer to a specific chromosome inherited from the parent. It may also refer to other identifying features of a chromosome.

The State of the Genetic Material or simply "Genetic State" may refer to the identity of a set of SNPs on the DNA, to the phased haplotypes of the genetic material, and to the sequence of the DNA, including insertions, deletions, repeats and mutations. It may also refer to the ploidy state of one or more chromosomes, chromosomal segments, or set of chromosomal segments.

Allelic Data refers to a set of genotypic data concerning a set of one or more alleles. It may refer to the phased, haplotypic data. It may refer to SNP identities, and it may refer to the sequence data of the DNA, including insertions, deletions, repeats and mutations. It may include the parental origin of each allele.

Allelic State refers to the actual state of the genes in a set of one or more alleles. It may refer to the actual state of the genes described by the allelic data.

Allelic Ratio or allele ratio, refers to the ratio between the amount of each allele at a locus that is present in a sample or in an individual. When the sample was measured by sequencing, the allelic ratio may refer to the ratio of sequence reads that map to each allele at the locus. When the sample was measured by an intensity based measurement method, the allele ratio may refer to the ratio of the amounts of each allele present at that locus as estimated by the measurement method.

Allele Count refers to the number of sequences that map to a particular locus, and if that locus is polymorphic, it refers to the number of sequences that map to each of the alleles. If each allele is counted in a binary fashion, then the allele count will be whole number. If the alleles are counted probabilistically, then the allele count can be a fractional number.

Allele Count Probability refers to the number of sequences that are likely to map to a particular locus or a set of alleles at a polymorphic locus, combined with the probability of the mapping. Note that allele counts are equivalent to allele count probabilities where the probability of the mapping for each counted sequence is binary (zero or one). In some embodiments, the allele count probabilities may be binary. In some embodiments, the allele count probabilities may be set to be equal to the DNA measurements.

Allelic Distribution, or 'allele count distribution' refers to the relative amount of each allele that is present for each locus in a set of loci. An allelic distribution can refer to an individual, to a sample, or to a set of measurements made on a sample. In the context of sequencing, the allelic distribution refers to the number or probable number of reads that map to a particular allele for each allele in a set of polymorphic loci. The allele measurements may be treated probabilistically, that is, the likelihood that a given allele is present for a give sequence read is a fraction between 0 and 1, or they may be treated in a binary fashion, that is, any given read is considered to be exactly zero or one copies of a particular allele.

Allelic Distribution Pattern refers to a set of different allele distributions for different parental contexts. Certain allelic distribution patterns may be indicative of certain ploidy states.

Allelic Bias refers to the degree to which the measured ratio of alleles at a heterozygous locus is different to the ratio that was present in the original sample, such as a sample of DNA. The degree of allelic bias at a particular locus is equal to the observed allelic ratio at that locus, as measured, divided by the ratio of alleles in the original DNA or RNA sample at that locus. Allelic bias may be defined to be greater than one, such that if the calculation of the degree of allelic bias returns a value, x, that is less than 1, then the degree of allelic bias may be restated as 1/x. Allelic bias maybe due to amplification bias, purification bias, or some other phenomenon that affects different alleles differently.

Primer, also "PCR probe" refers to a single DNA molecule (a DNA oligomer) or a collection of DNA molecules (DNA oligomers) where the DNA molecules are identical, or nearly so, and where the primer contains a region that is designed to hybridize to a targeted locus (e.g., a targeted polymorphic locus or a nonpolymorphic locus), and may contain a priming sequence designed to allow PCR amplification. A primer may also contain a molecular barcode. A primer may contain a random region that differs for each individual molecule. The terms "test primer" and "candidate primer" are not meant to be limiting and may refer to any of the primers disclosed herein.

Library of primers refers to a population of two or more primers. In various embodiments, the library includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primers. In various embodiments, the library includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primer pairs, wherein each pair of primers includes a forward test primer and a reverse test primer where each pair of test primers hybridize to a target locus. In some embodiments, the library of primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different individual primers that each hybridize to a different target locus, wherein the individual primers are not part of primer pairs. In some embodiments, the library has both (i) primer pairs and (ii) individual primers (such as universal primers) that are not part of primer pairs.

Different primers refers to non-identical primers.

Different pools refers to non-identical pools.

Different target loci refers to non-identical target loci.

Different amplicons refers to non-identical amplicons.

Hybrid Capture Probe refers to any nucleic acid sequence, possibly modified, that is generated by various methods such as PCR or direct synthesis and intended to be complementary to one strand of a specific target DNA sequence in a sample. The exogenous hybrid capture probes may be added to a prepared sample and hybridized through a deanture-reannealing process to form duplexes of exogenous-endogenous fragments. These duplexes may then be physically separated from the sample by various means.

Sequence Read refers to data representing a sequence of nucleotide bases that were measured using a clonal sequencing method. Clonal sequencing may produce sequence data representing single, or clones, or clusters of one original DNA molecule. A sequence read may also have associated quality score at each base position of the sequence indicating the probability that nucleotide has been called correctly.

Mapping a sequence read is the process of determining a sequence read's location of origin in the genome sequence of a particular organism. The location of origin of sequence reads is based on similarity of nucleotide sequence of the read and the genome sequence.

Matched Copy Error, also "Matching Chromosome Aneuploidy" (MCA), refers to a state of aneuploidy where one cell contains two identical or nearly identical chromosomes. This type of aneuploidy may arise during the formation of the gametes in meiosis, and may be referred to as a meiotic non-disjunction error. This type of error may arise in mitosis. Matching trisomy may refer to the case where three copies of a given chromosome are present in an individual and two of the copies are identical.

Unmatched Copy Error, also "Unique Chromosome Aneuploidy" (UCA), refers to a state of aneuploidy where one cell contains two chromosomes that are from the same parent, and that may be homologous but not identical. This type of aneuploidy may arise during meiosis, and may be referred to as a meiotic error. Unmatching trisomy may refer to the case where three copies of a given chromosome are present in an individual and two of the copies are from the same parent, and are homologous, but are not identical. Note that unmatching trisomy may refer to the case where two homologous chromosomes from one parent are present, and where some segments of the chromosomes are identical while other segments are merely homologous.

Homologous Chromosomes refers to chromosome copies that contain the same set of genes that normally pair up during meiosis.

Identical Chromosomes refers to chromosome copies that contain the same set of genes, and for each gene they have the same set of alleles that are identical, or nearly identical.

Allele Drop Out (ADO) refers to the situation where at least one of the base pairs in a set of base pairs from homologous chromosomes at a given allele is not detected.

Locus Drop Out (LDO) refers to the situation where both base pairs in a set of base pairs from homologous chromosomes at a given allele are not detected.

Homozygous refers to having similar alleles as corresponding chromosomal loci.

Heterozygous refers to having dissimilar alleles as corresponding chromosomal loci.

Heterozygosity Rate refers to the rate of individuals in the population having heterozygous alleles at a given locus. The heterozygosity rate may also refer to the expected or measured ratio of alleles, at a given locus in an individual, or a sample of DNA.

Highly Informative Single Nucleotide Polymorphism (HISNP) refers to a SNP where the fetus has an allele that is not present in the mother's genotype.

Chromosomal Region refers to a segment of a chromosome, or a full chromosome.

Segment of a Chromosome refers to a section of a chromosome that can range in size from one base pair to the entire chromosome.

Chromosome refers to either a full chromosome, or a segment or section of a chromosome.

Copies refers to the number of copies of a chromosome segment. It may refer to identical copies, or to non-identical, homologous copies of a chromosome segment wherein the different copies of the chromosome segment contain a substantially similar set of loci, and where one or more of the alleles are different. Note that in some cases of aneuploidy, such as the M2 copy error, it is possible to have some copies of the given chromosome segment that are identical as well as some copies of the same chromosome segment that are not identical.

Haplotype refers to a combination of alleles at multiple loci that are typically inherited together on the same chromosome. Haplotype may refer to as few as two loci or to an entire chromosome depending on the number of recombination events that have occurred between a given set of loci. Haplotype can also refer to a set of single nucleotide polymorphisms (SNPs) on a single chromatid that are statistically associated.

Haplotypic Data, also "Phased Data" or "Ordered Genetic Data," refers to data from a single chromosome in a diploid or polyploid genome, i.e., either the segregated maternal or paternal copy of a chromosome in a diploid genome.

Phasing refers to the act of determining the haplotypic genetic data of an individual given unordered, diploid (or polyploidy) genetic data. It may refer to the act of determining which of two genes at an allele, for a set of alleles found on one chromosome, are associated with each of the two homologous chromosomes in an individual.

Phased Data refers to genetic data where one or more haplotypes have been determined.

Hypothesis refers to a possible ploidy state at a given set of chromosomes, or a set of possible allelic states at a given set of loci. The set of possibilities may comprise one or more elements.

Copy Number Hypothesis, also "Ploidy State Hypothesis," refers to a hypothesis concerning the number of copies of a chromosome in an individual. It may also refer to a hypothesis concerning the identity of each of the chromosomes, including the parent of origin of each chromosome, and which of the parent's two chromosomes are present in the individual. It may also refer to a hypothesis concerning which chromosomes, or chromosome segments, if any, from a related individual correspond genetically to a given chromosome from an individual.

Target Individual refers to the individual whose genetic state is being determined. In some embodiments, only a limited amount of DNA is available from the target individual. In some embodiments, the target individual is a fetus. In some embodiments, there may be more than one target individual. In some embodiments, each fetus that originated from a pair of parents may be considered to be target individuals. In some embodiments, the genetic data that is being determined is one or a set of allele calls. In some embodiments, the genetic data that is being determined is a ploidy call.

Related Individual refers to any individual who is genetically related to, and thus shares haplotype blocks with, the target individual. In one context, the related individual may be a genetic parent of the target individual, or any genetic material derived from a parent, such as a sperm, a polar body, an embryo, a fetus, or a child. It may also refer to a sibling, parent or a grandparent.

Sibling refers to any individual whose genetic parents are the same as the individual in question. In some embodiments, it may refer to a born child, an embryo, or a fetus, or one or more cells originating from a born child, an embryo, or a fetus. A sibling may also refer to a haploid individual that originates from one of the parents, such as a sperm, a polar body, or any other set of haplotypic genetic matter. An individual may be considered to be a sibling of itself.

Fetal refers to "of the fetus," or "of the region of the placenta that is genetically similar to the fetus". In a pregnant woman, some portion of the placenta is genetically similar to the fetus, and the free floating fetal DNA found in maternal blood may have originated from the portion of the placenta with a genotype that matches the fetus. Note that the genetic information in half of the chromosomes in a fetus is inherited from the mother of the fetus. In some embodiments, the DNA from these maternally inherited chromosomes that came from a fetal cell is considered to be "of fetal origin," not "of maternal origin."

DNA of Fetal Origin refers to DNA that was originally part of a cell whose genotype was essentially equivalent to that of the fetus.

DNA of Maternal Origin refers to DNA that was originally part of a cell whose genotype was essentially equivalent to that of the mother.

Child may refer to an embryo, a blastomere, or a fetus. Note that in the presently disclosed embodiments, the concepts described apply equally well to individuals who are a born child, a fetus, an embryo or a set of cells therefrom. The use of the term child may simply be meant to connote that the individual referred to as the child is the genetic offspring of the parents.

Parent refers to the genetic mother or father of an individual. An individual typically has two parents, a mother and a father, though this may not necessarily be the case such as in genetic or chromosomal chimerism. A parent may be considered to be an individual.

Parental Context refers to the genetic state of a given SNP, on each of the two relevant chromosomes for one or both of the two parents of the target.

Develop As Desired, also "Develop Normally," refers to a viable embryo implanting in a uterus and resulting in a pregnancy, and/or to a pregnancy continuing and resulting in a live birth, and/or to a born child being free of chromosomal abnormalities, and/or to a born child being free of other undesired genetic conditions such as disease-linked genes. The term "develop as desired" is meant to encompass anything that may be desired by parents or healthcare facilitators. In some cases, "develop as desired" may refer to an unviable or viable embryo that is useful for medical research or other purposes.

Insertion into a Uterus refers to the process of transferring an embryo into the uterine cavity in the context of in vitro fertilization.

Maternal Plasma refers to the plasma portion of the blood from a female who is pregnant.

Clinical Decision refers to any decision to take or not take an action that has an outcome that affects the health or survival of an individual. In the context of prenatal diagnosis, a clinical decision may refer to a decision to abort or not abort a fetus. A clinical decision may also refer to a decision to conduct further testing, to take actions to mitigate an undesirable phenotype, or to take actions to prepare for the birth of a child with abnormalities.

Diagnostic Box refers to one or a combination of machines designed to perform one or a plurality of aspects of the methods disclosed herein. In an embodiment, the diagnostic box may be placed at a point of patient care. In an embodiment, the diagnostic box may perform targeted amplification followed by sequencing. In an embodiment the diagnostic box may function alone or with the help of a technician.

Informatics Based Method refers to a method that relies heavily on statistics to make sense of a large amount of data. In the context of prenatal diagnosis, it refers to a method designed to determine the ploidy state at one or more chromosomes or the allelic state at one or more alleles by statistically inferring the most likely state, rather than by directly physically measuring the state, given a large amount of genetic data, for example from a molecular array or sequencing. In an embodiment of the present disclosure, the informatics based technique may be one disclosed in this patent. In an embodiment of the present disclosure it may be PARENTAL SUPPORT™.

Primary Genetic Data refers to the analog intensity signals that are output by a genotyping platform. In the context of SNP arrays, primary genetic data refers to the intensity signals before any genotype calling has been done. In the context of sequencing, primary genetic data refers to the analog measurements, analogous to the chromatogram, that comes off the sequencer before the identity of any base pairs have been determined, and before the sequence has been mapped to the genome.

Secondary Genetic Data refers to processed genetic data that are output by a genotyping platform. In the context of a SNP array, the secondary genetic data refers to the allele calls made by software associated with the SNP array reader, wherein the software has made a call whether a given allele is present or not present in the sample. In the context of sequencing, the secondary genetic data refers to the base pair identities of the sequences have been determined, and possibly also where the sequences have been mapped to the genome.

Non-Invasive Prenatal Diagnosis (NPD), or also "Non-Invasive Prenatal Screening" (NPS), refers to a method of determining the genetic state of a fetus that is gestating in a mother using genetic material found in the mother's blood, where the genetic material is obtained by drawing the mother's intravenous blood.

Preferential Enrichment of DNA that corresponds to a locus, or preferential enrichment of DNA at a locus, refers to any method that results in the percentage of molecules of DNA in a post-enrichment DNA mixture that correspond to the locus being higher than the percentage of molecules of DNA in the pre-enrichment DNA mixture that correspond to the locus. The method may involve selective amplification of DNA molecules that correspond to a locus. The method may involve removing DNA molecules that do not correspond to the locus. The method may involve a combination of methods. The degree of enrichment is defined as the percentage of molecules of DNA in the post-enrichment mixture that correspond to the locus divided by the percentage of molecules of DNA in the pre-enrichment mixture that correspond to the locus. Preferential enrichment may be carried out at a plurality of loci. In some embodiments of the present disclosure, the degree of enrichment is greater than 20. In some embodiments of the present disclosure, the degree of enrichment is greater than 200. In some embodiments of the present disclosure, the degree of enrichment is greater than 2,000. When preferential enrichment is carried out at a plurality of loci, the degree of enrichment may refer to the average degree of enrichment of all of the loci in the set of loci.

Amplification refers to a method that increases the number of copies of a molecule, such as a molecule of DNA.

Selective Amplification may refer to a method that increases the number of copies of a particular molecule of DNA, or molecules of DNA that correspond to a particular region of DNA. It may also refer to a method that increases the number of copies of a particular targeted molecule of DNA, or targeted region of DNA more than it increases non-targeted molecules or regions of DNA. Selective amplification may be a method of preferential enrichment.

Universal Priming Sequence refers to a DNA sequence that may be appended to a population of target DNA molecules, for example by ligation, PCR, or ligation mediated PCR. Once added to the population of target molecules, primers specific to the universal priming sequences can be used to amplify the target population using a single pair of amplification primers. Universal priming sequences are typically not related to the target sequences.

Universal Adapters, or 'ligation adaptors' or 'library tags' are DNA molecules containing a universal priming sequence that can be covalently linked to the 5-prime and 3-prime end of a population of target double stranded DNA molecules. The addition of the adapters provides universal priming sequences to the 5-prime and 3-prime end of the target population from which PCR amplification can take place, amplifying all molecules from the target population, using a single pair of amplification primers.

Targeting refers to a method used to selectively amplify or otherwise preferentially enrich those molecules of DNA that correspond to a set of loci, in a mixture of DNA.

Joint Distribution Model refers to a model that defines the probability of events defined in terms of multiple random variables, given a plurality of random variables defined on the same probability space, where the probabilities of the variable are linked. In some embodiments, the degenerate case where the probabilities of the variables are not linked may be used.

Percent identity in reference to nucleic acid sequences refers to the degree of sequence identity between nucleic acid sequences.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

The presently disclosed embodiments will be further explained with reference to the attached drawings, wherein like structures are referred to by like numerals throughout the several views. The drawings shown are not necessarily to scale, with emphasis instead generally being placed upon illustrating the principles of the presently disclosed embodiments.

FIG. 12: An example of some primers with internal tags. FIG. 12 discloses nucleotide sequences as SEQ ID NOS: 44,611 to 44,622, respectively, in order of appearance.

FIGS. 29A-29E: Cartoon depiction of a method of the invention for the determination of a fetal aneuploidy (FIG. 29A). Maternal and paternal genotype data (from blood or buccal swabs) and crossover frequency data from the Hap-Map database are utilized to generate (FIG. 29B) multiple independent hypotheses for each potential fetal ploidy state in silico (FIG. 29C). Each of these hypotheses is expanded to include sub-hypotheses with take into consideration the different possible crossover points. The data model predicts what the sequencing data would look like (the expected allele distributions) given each hypothetical fetal genotype and at different fetal cfDNA fractions, and is compared to the actual sequencing data; the likelihood for each hypothesis is determined using Bayesian statistics. In this hypothetical example, the hypotheses with the highest likelihoods (euploidy) are determined (FIG. 29D and FIG. 29E). The individual likelihoods from FIG. 29C are summed for each copy number hypothesis family (monosomy, disomy, or triploidy). The hypothesis with the maximum likelihood is called as the ploidy state, reveals the fetal fraction, and represents the sample-specific calculated accuracy.

FIG. 30A: Generated plots when two chromosomes are present and the fetal cfDNA fraction is 0%. This plot is from a non-pregnant woman, and thus represents the pattern when the genotype is entirely maternal. Allele clusters are thus centered around 1 (AA alleles), 0.5 (AB alleles), and 0 (BB alleles). FIG. 30B: Generated plot when two chromosomes are present and the fetal fraction is 12%. The contribution of fetal alleles to the fraction of A allele reads shifts the position of some allele spots up or down along the y-axis, such that the bands are centered around 1 (AA1AA alleles), 0.94 (AA|AB alleles), 0.56 (AB|AA alleles), 0.50 (AB|AB alleles), 0.44 (AB|BB alleles), 0.06 (BB|AB alleles), and 0 (BB|BB alleles). FIG. 30C. Generated plot when two chromosomes are present and the fetal fraction is 26%. The pattern, including two red and two blue peripheral bands and a trio of central green bands, is readily apparent. Bands are centered around 1 (AA|AA alleles), 0.87 (AA|AB alleles), 0.63 (AB|AA alleles), 0.50 (AB|AB alleles), 0.37 (AB|BB alleles), 0.13 (BB|AB alleles), and 0 (BB|BB alleles). FIG. 30D: Generated plot when one chromosome is present and the fetal fraction is 26%. The hallmark pattern of one external red and one external blue peripheral band as well as two central green bands indicated maternally-inherited monosomy. Because the fetus only contributes a single allele (A or B) to the allele reads, the internal peripheral red and blue bands are not present, and the center trio of bands condenses into two bands. Bands that are centered around 1 (AA|A alleles), 0.57 (AB|A alleles), 0.43 (AB|B alleles), and 0 (BB|B alleles). FIG. 30E: Generated plot when three chromosomes are present and the fetal fraction is 27%. This pattern of two red and two blue peripheral bands as well as two central green bands indicates maternally-inherited meiotic trisomy. Bands are centered around 1 (AA|AAA alleles), 0.88 (AA|AAB alleles), 0.56 (AB|AAB alleles), 0.44 (AB|ABB alleles), 0.12 (BB|ABB alleles), and 0 (BB|BBB alleles). FIG. 30F: Generated plot when three chromosomes are present and the fetal fraction is 14%. This pattern of three red and three blue peripheral bands, as well as two central green bands, indicates paternally-inherited meiotic trisomy. Bands are centered around 1 (AA|AAA alleles), 0.93 (AA|AAB alleles), 0.87 (AA|ABB alleles), 0.60 (AB|AAA alleles), 0.53 (AB|AAB alleles), 0.47 (AB|ABB alleles), 0.40 (AB|BBB alleles), 0.13 (BB|AAB alleles), 0.07 (BB|ABB alleles), and 0 (BB|BBB alleles). FIG. 30G: Generated plot when three chromosomes are present and the fetal fraction is 35%. This pattern of two red and two blue peripheral bands and four central green bands indicates maternally-inherited mitotic trisomy. Bands are centered around 1 (AA|AAA alleles), 0.85 (AA|AAB alleles), 0.72 (AB|AAA alleles), 0.57 (AB|AAB alleles), 0.43 (AB|ABB alleles), 0.28 (AB|BBB alleles), 0.15 (BB|ABB alleles), and 0 (BB|BBB alleles). FIG. 30H: Generated plot when three chromosomes are present and the fetal fraction is 25%. This pattern of two red and two blue peripheral bands as well as four central green bands indicates paternally-inherited mitotic trisomy. This pattern can be distinguished from that of maternally-inherited mitotic trisomy (as in FIG. 30G) by the position of the internal peripheral bands. Specifically, bands are centered around 1 (AA|AAA alleles), 0.78 (AA|ABB alleles), 0.67 (AB|AAA alleles), 0.56 (AB|AAB alleles), 0.44 (AB|ABB alleles), 0.33 (AB|BBB alleles), 0.22 (BB|AAB alleles), and 0 (BB|BBB alleles).

FIG. 33A shows the first two bases (dinucleotide) of a primer that align to the other primer for calculation of ΔG. Iterate over the remainder of the primer that aligns with the other primer by sliding the bases being observing one base to the right. Continue until ΔG has been calculated for all pairs of bases that align (FIG. 33B). Shift the alignment of the two primers (FIGS. 33C and 33D). Determine ΔG for the new alignment (FIGS. 33E and 33F).

Figure 34A2:
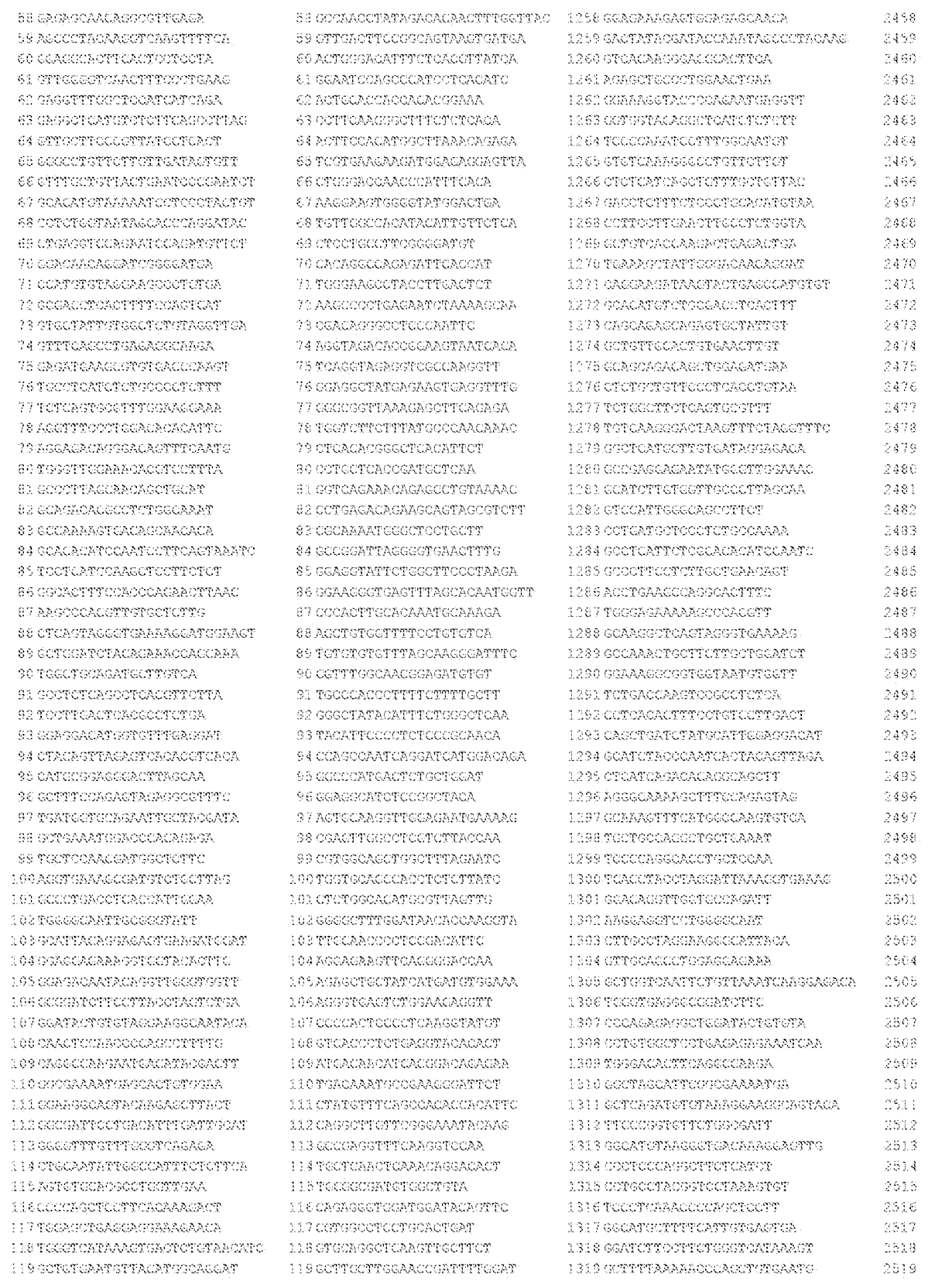
Figure 34A3:
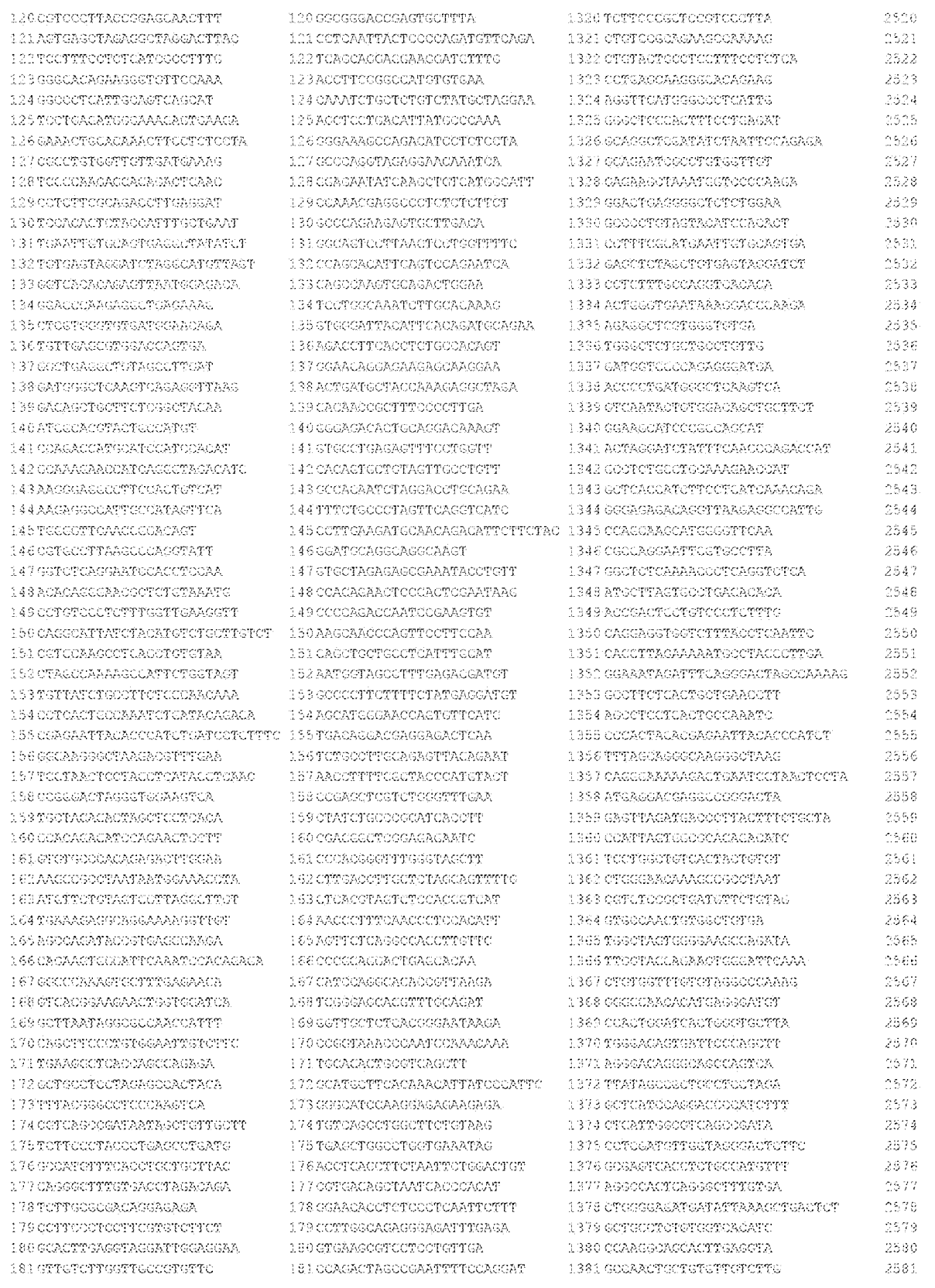
Figure 34A4:
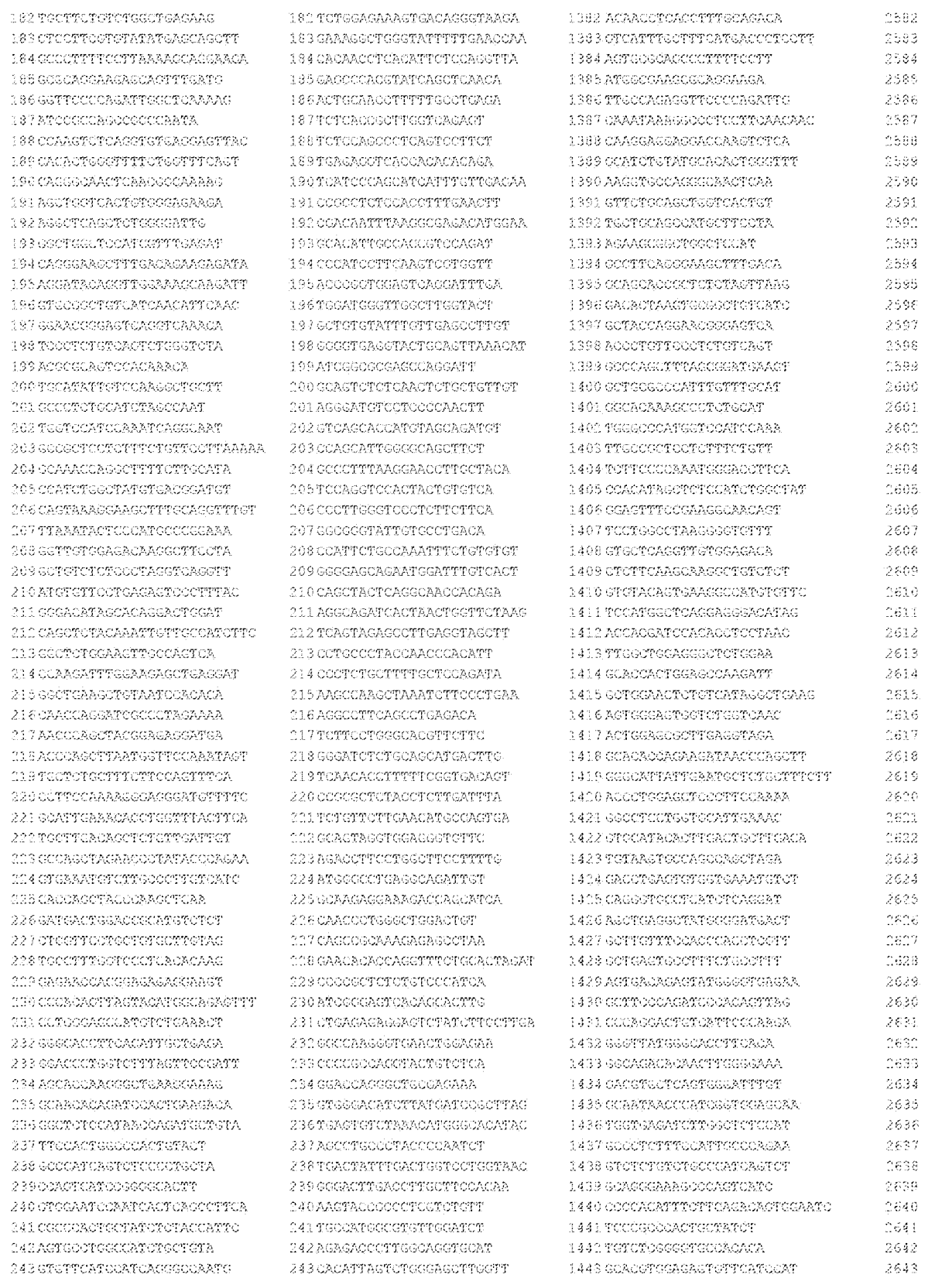
Figure 34A5:
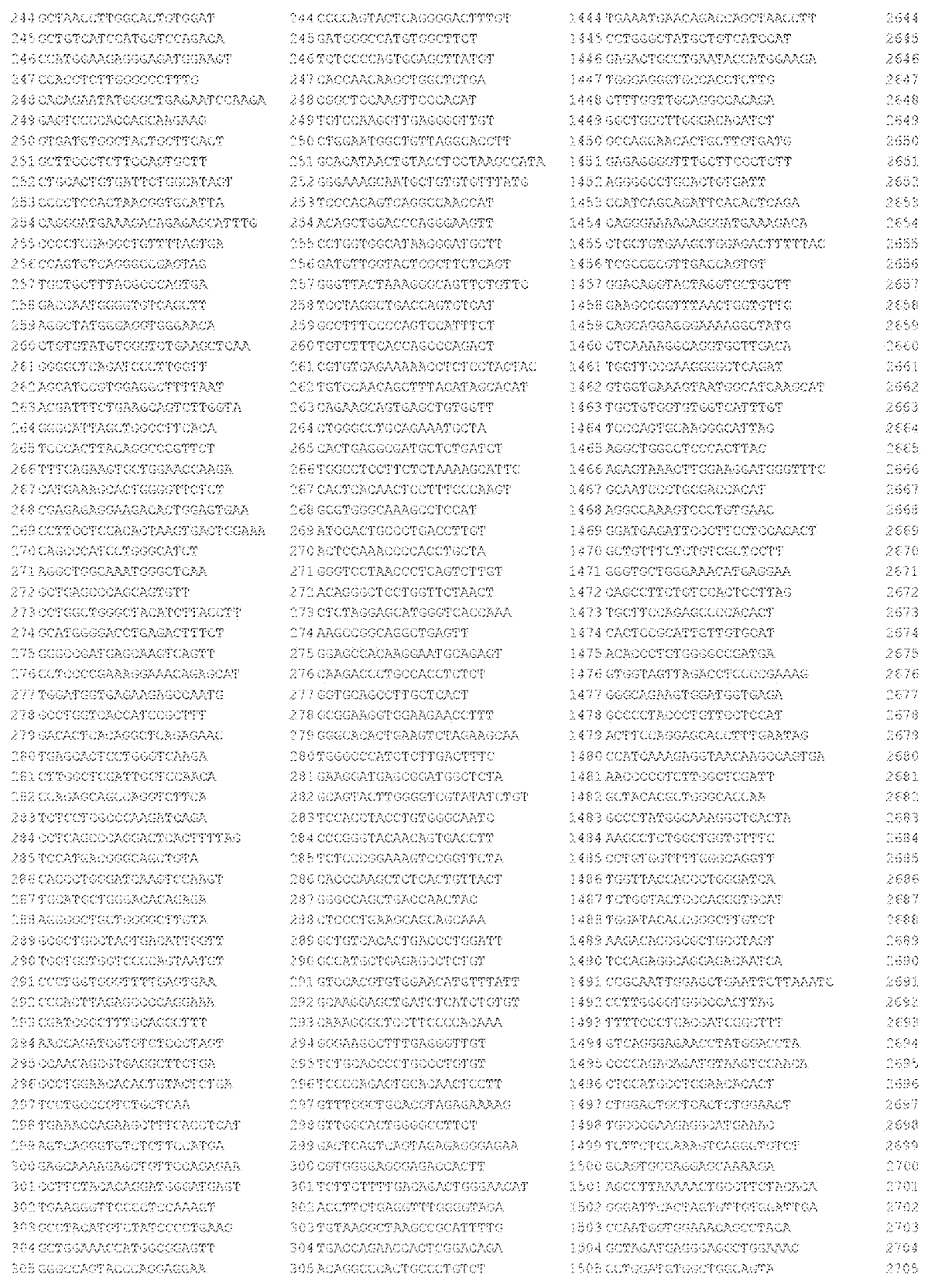
Figure 34A6:
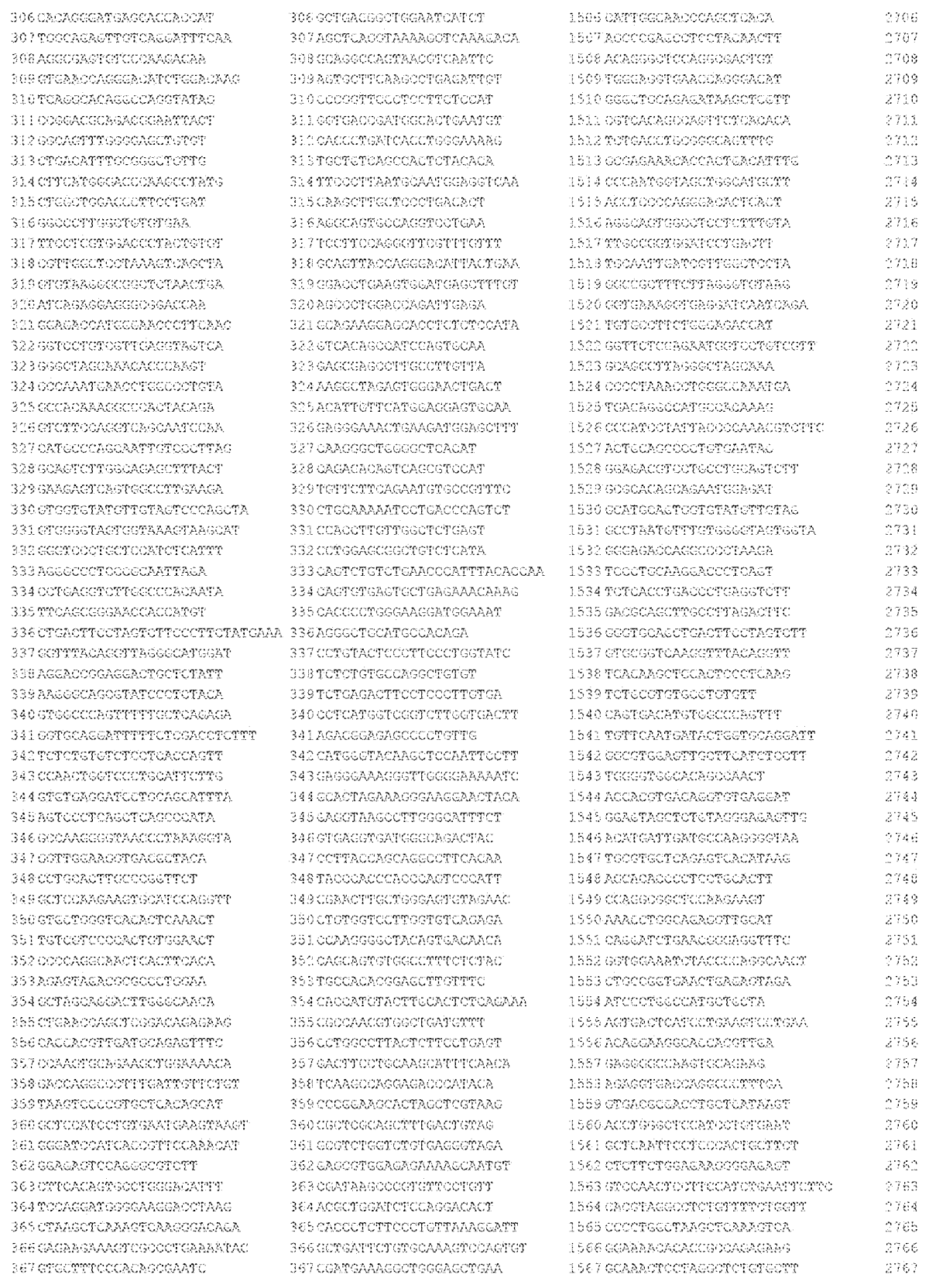
Figure 34A7:
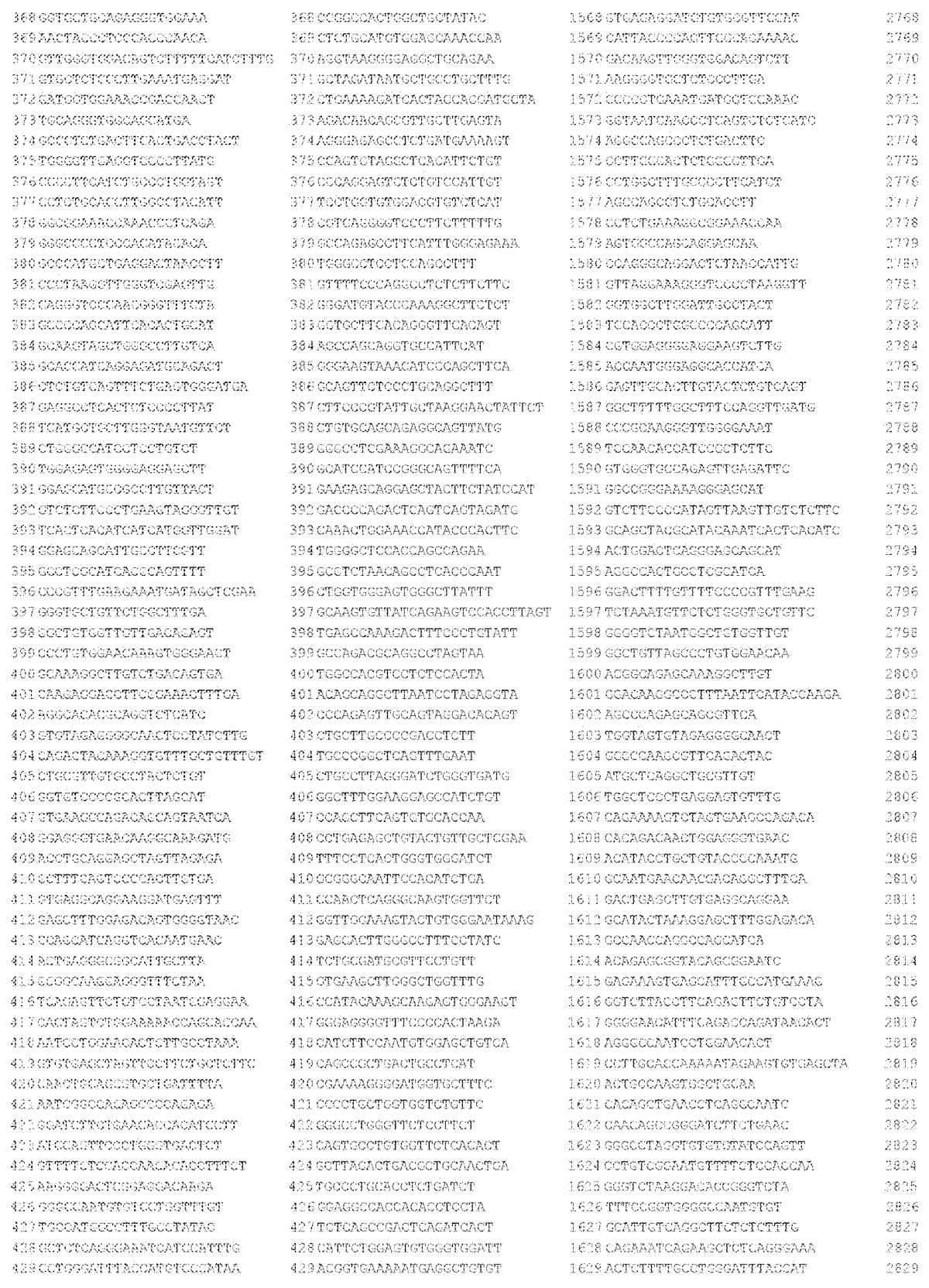
Figure 34A8:
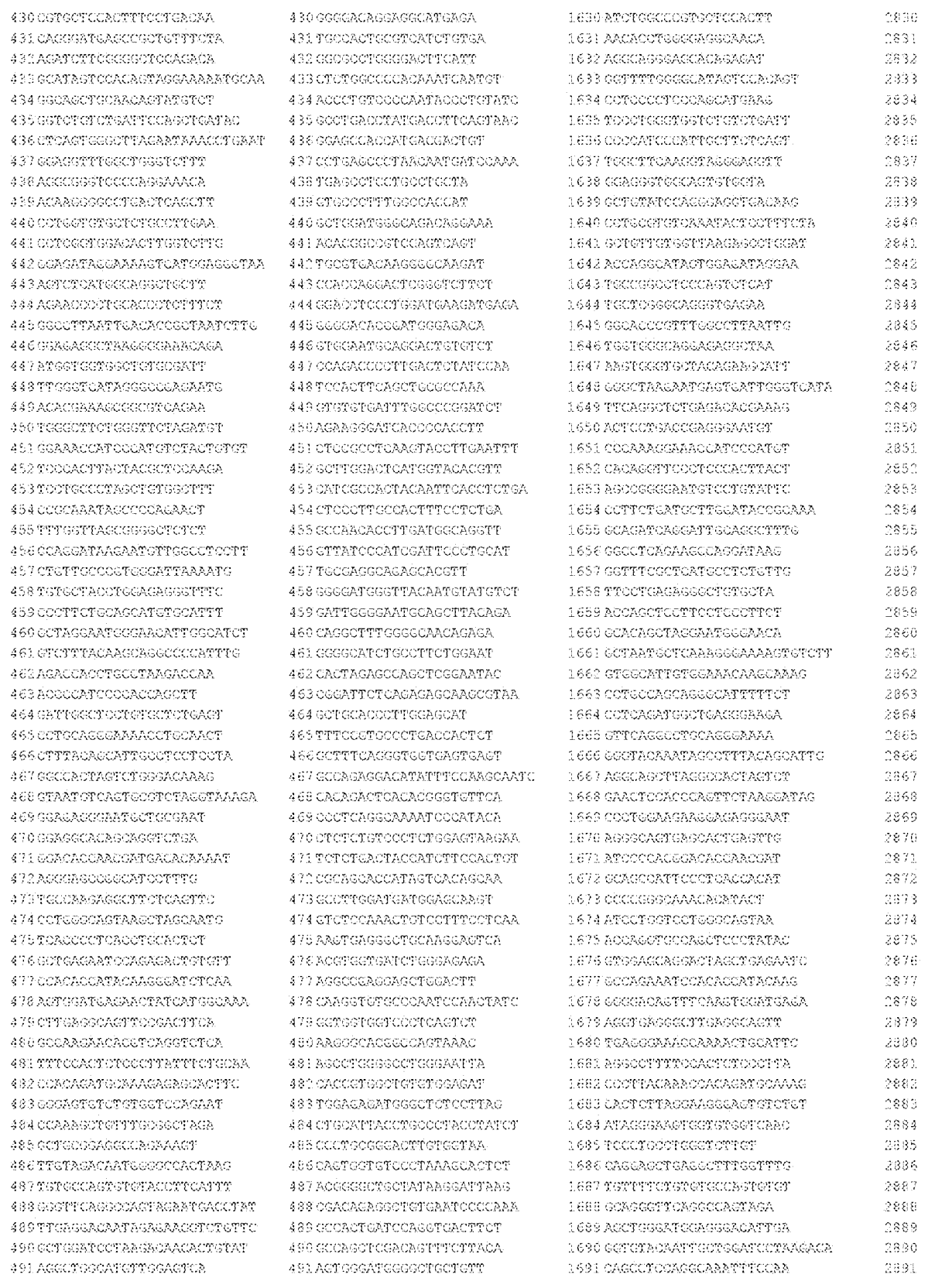
Figure 34A9:
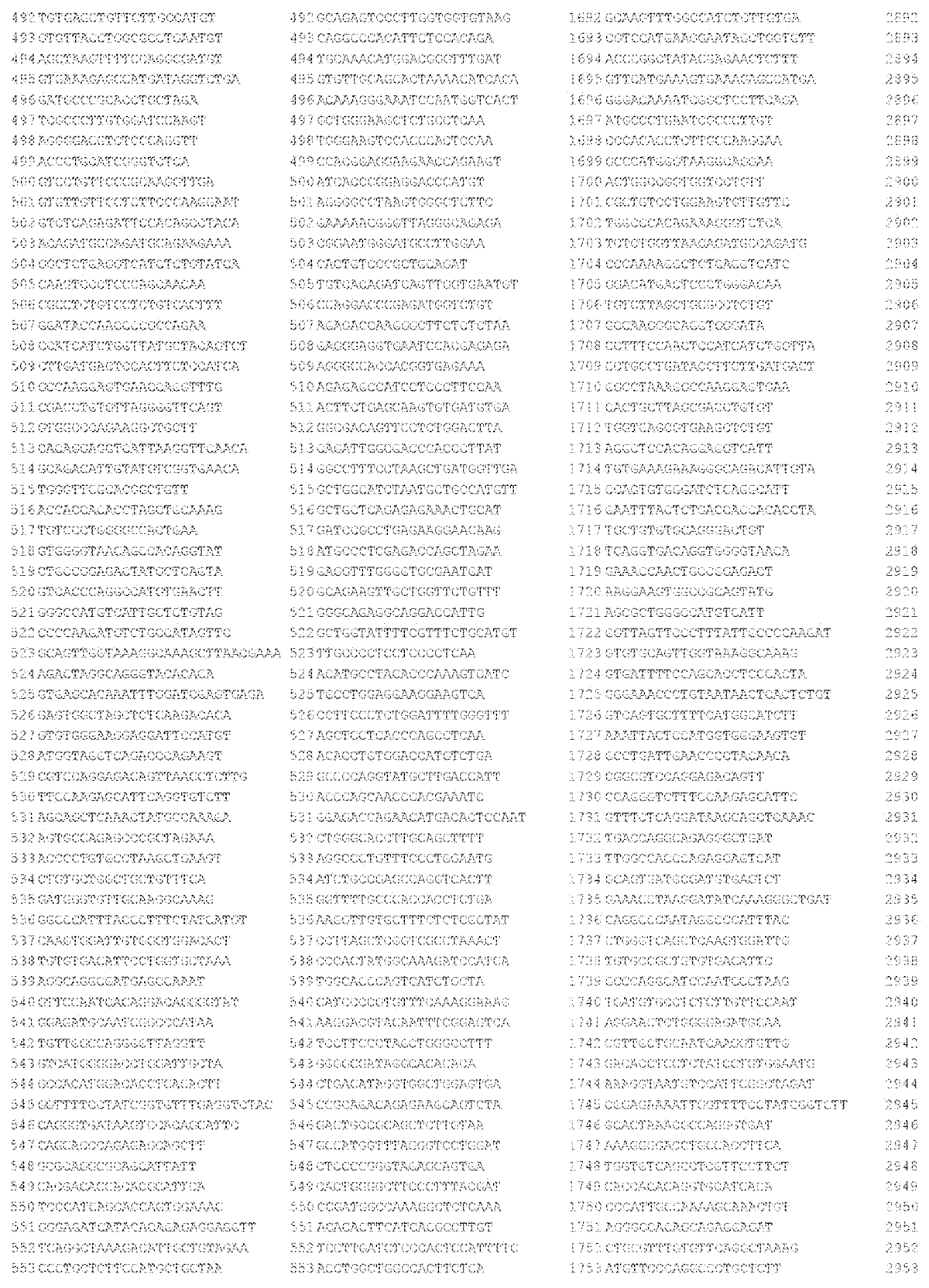
Figure 34A10:
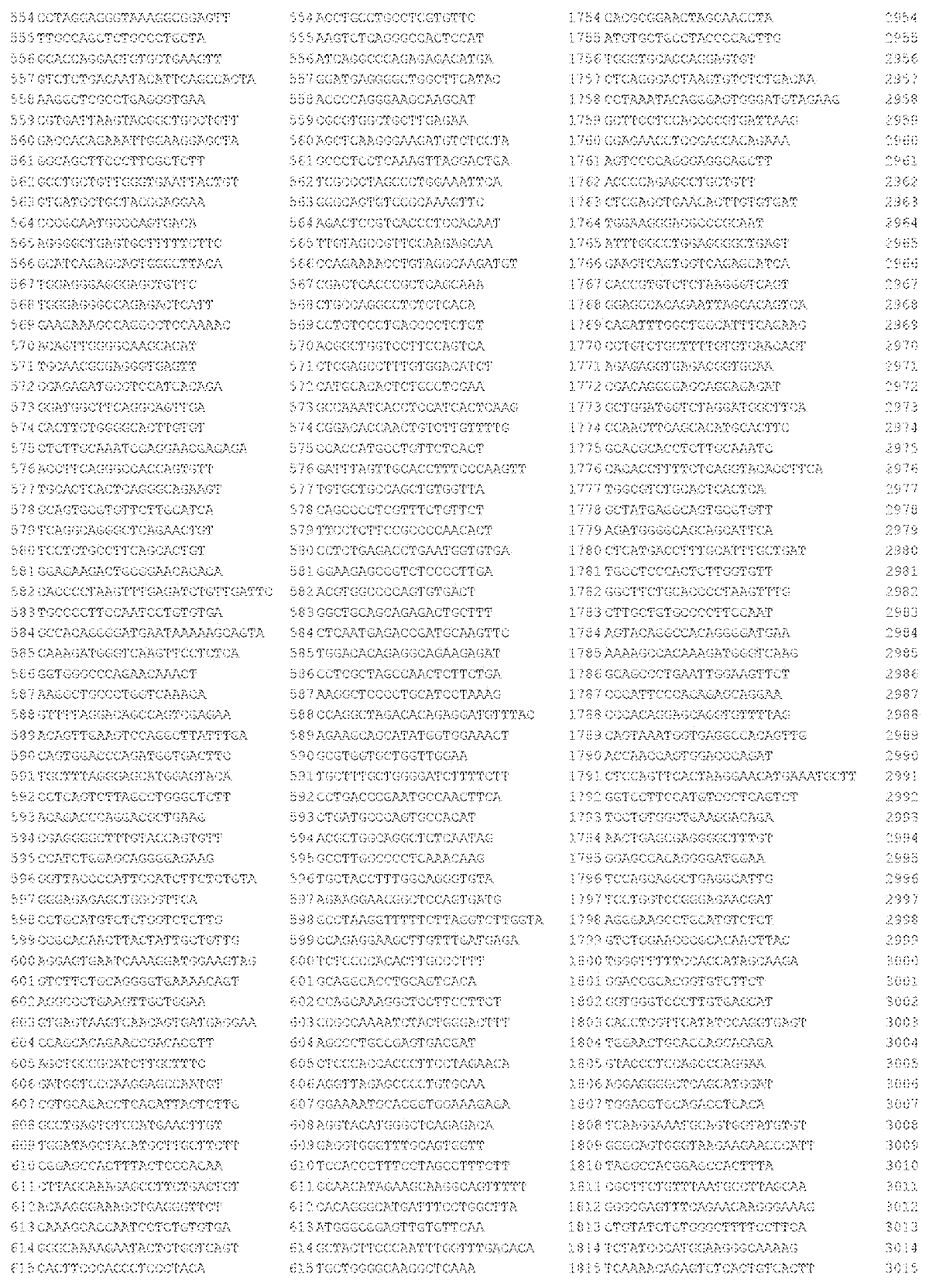
Figure 34B1:
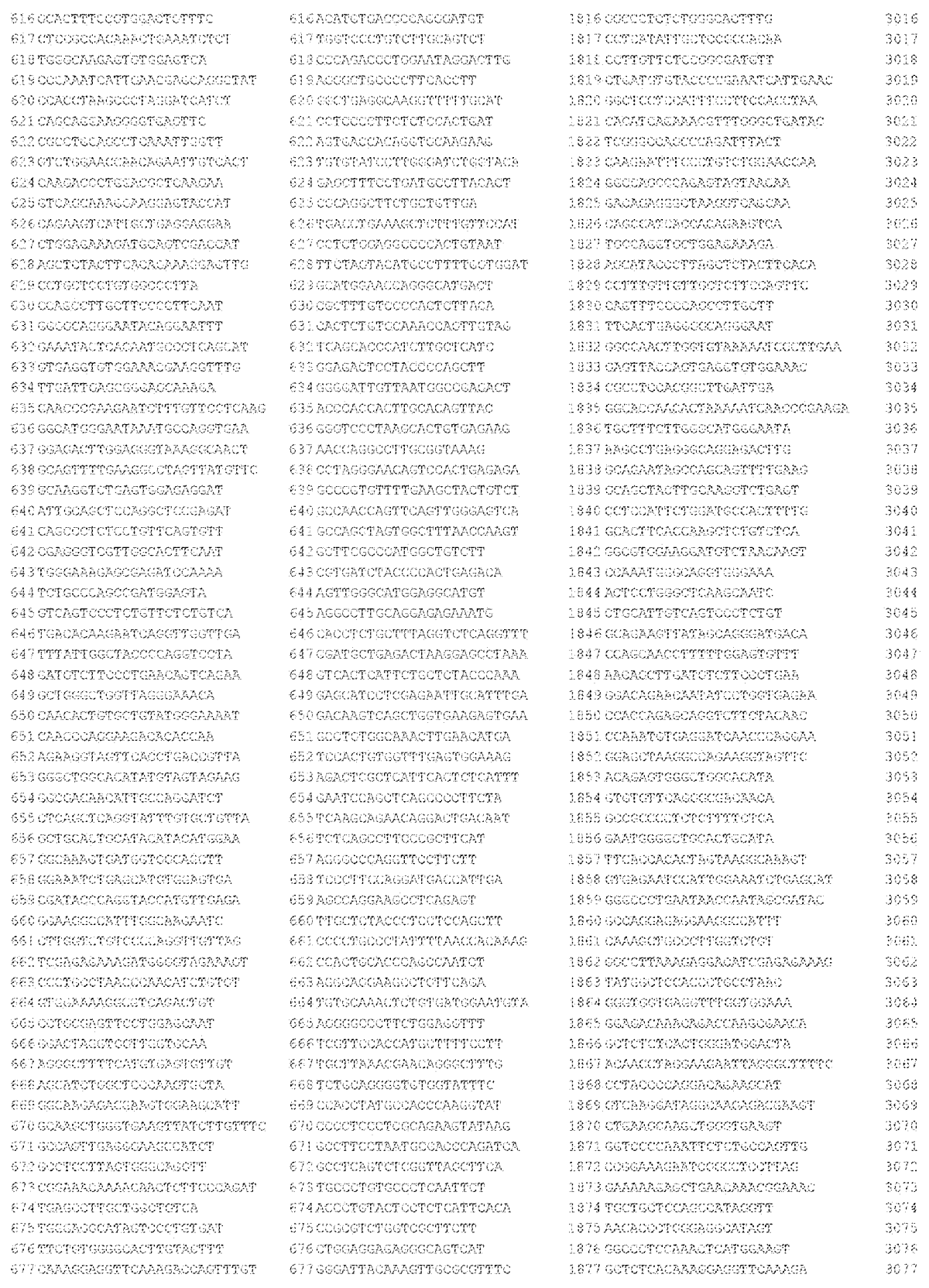
Figure 34B3:
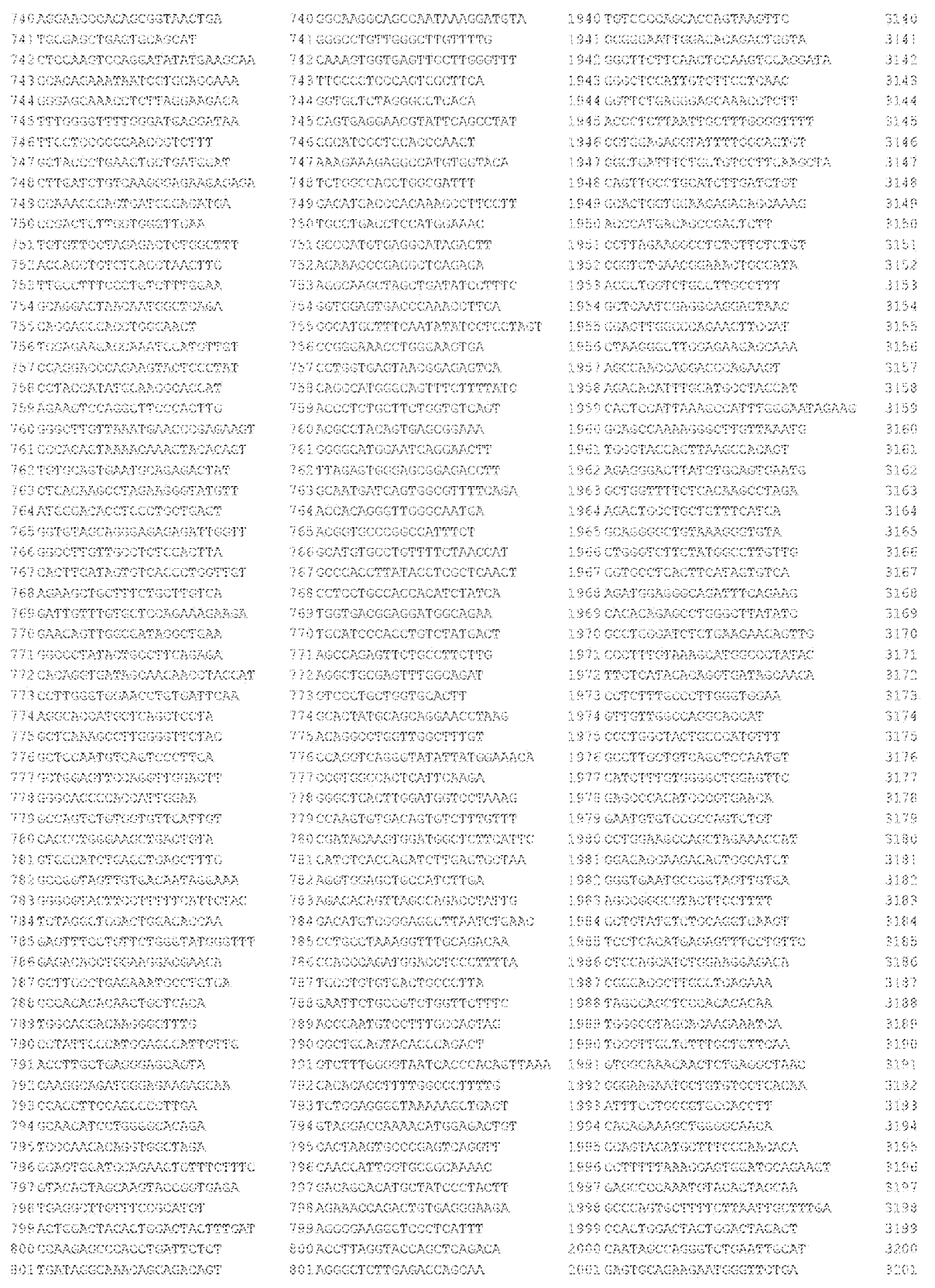
Figure 34B4:
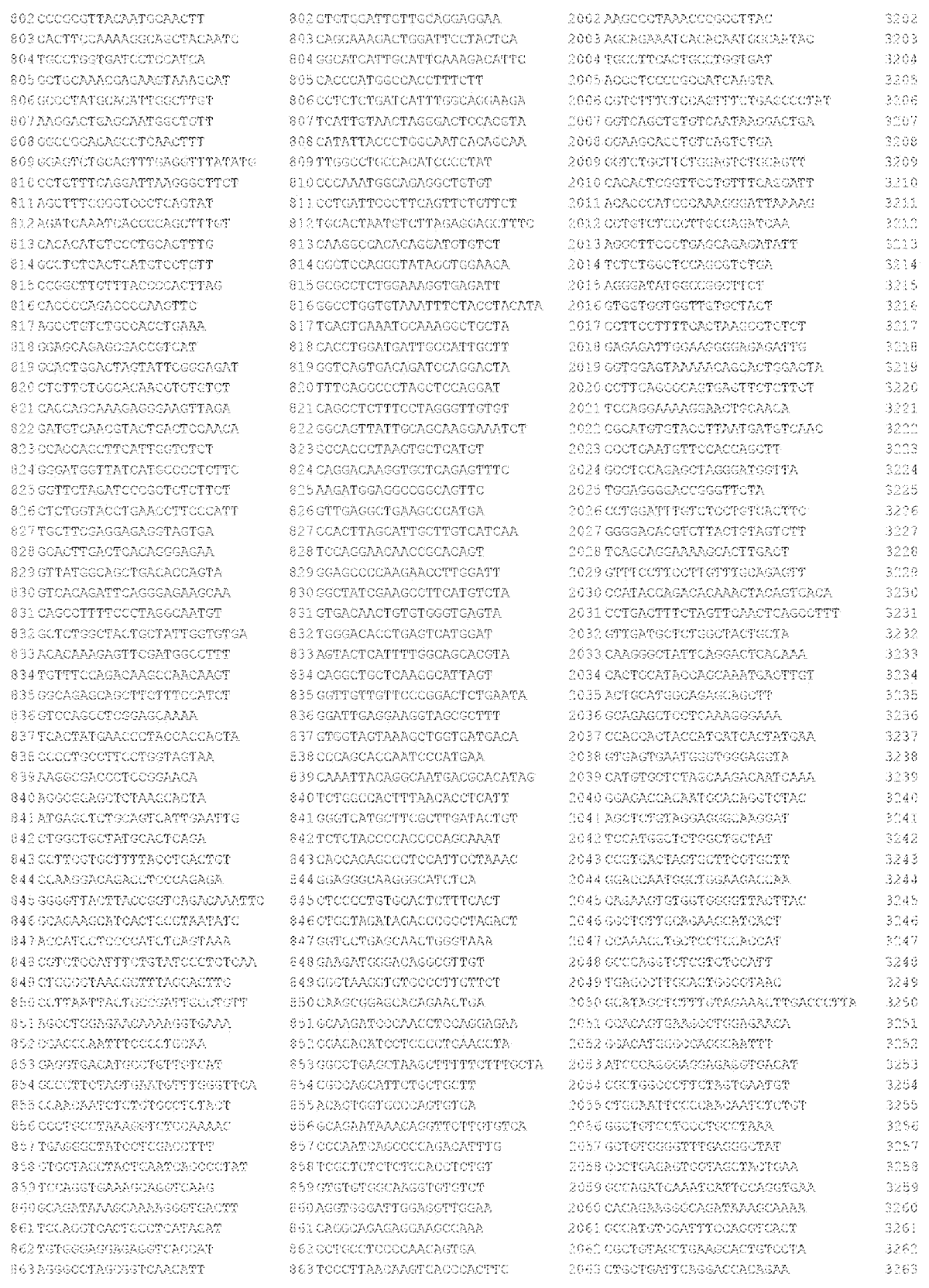
Figure 34B6:
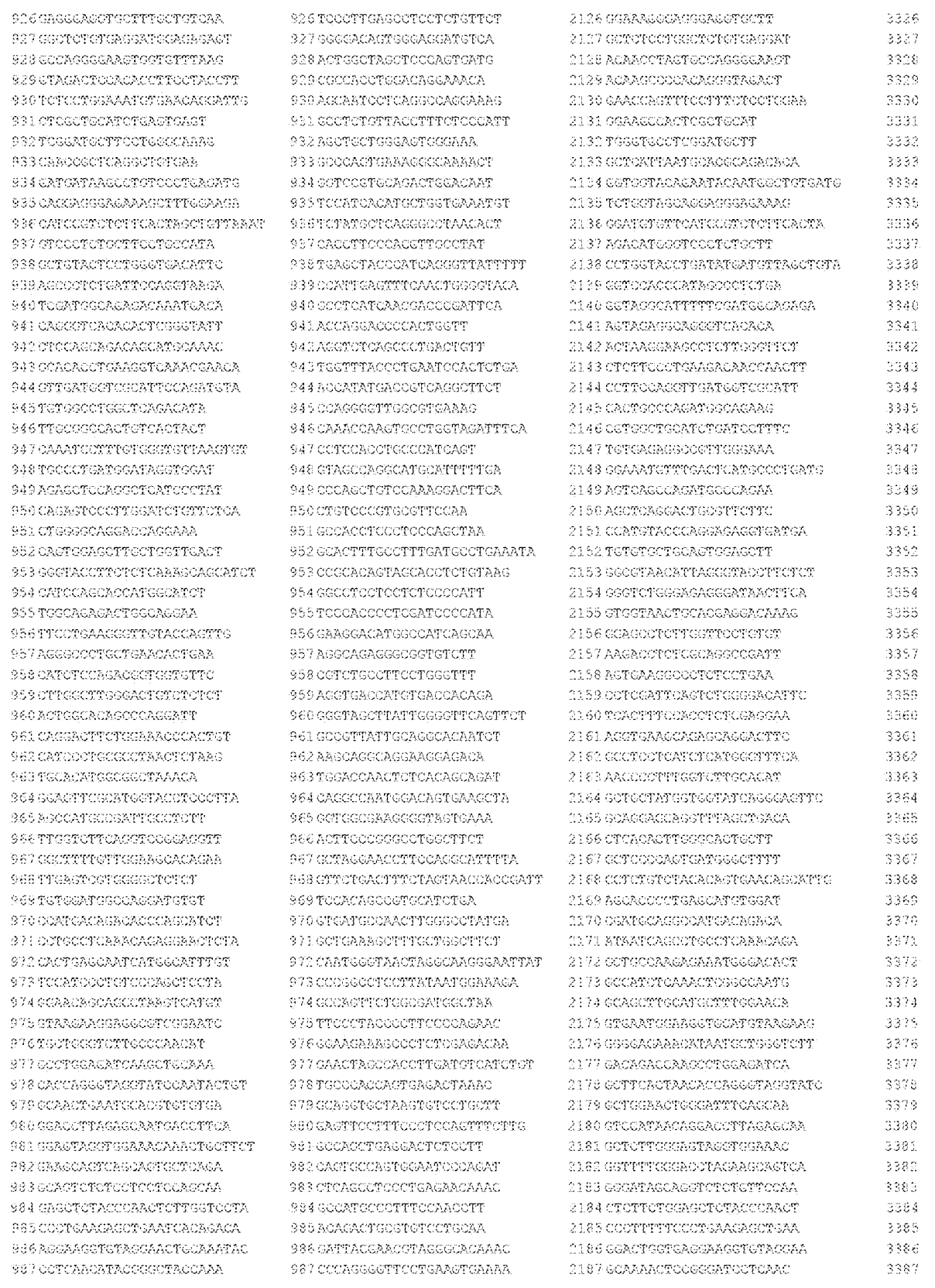
Figure 34B7:
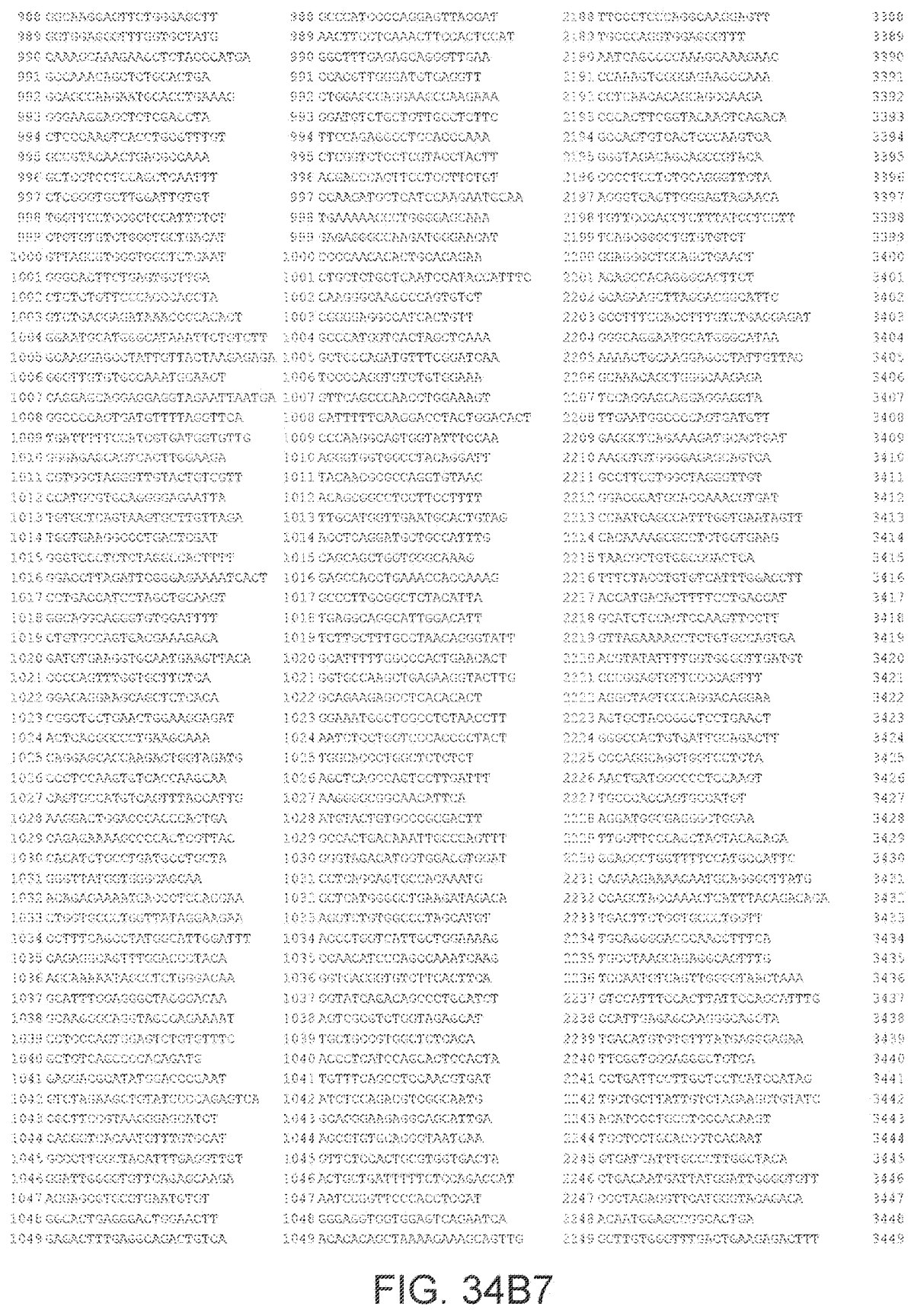
Figure 34B8:
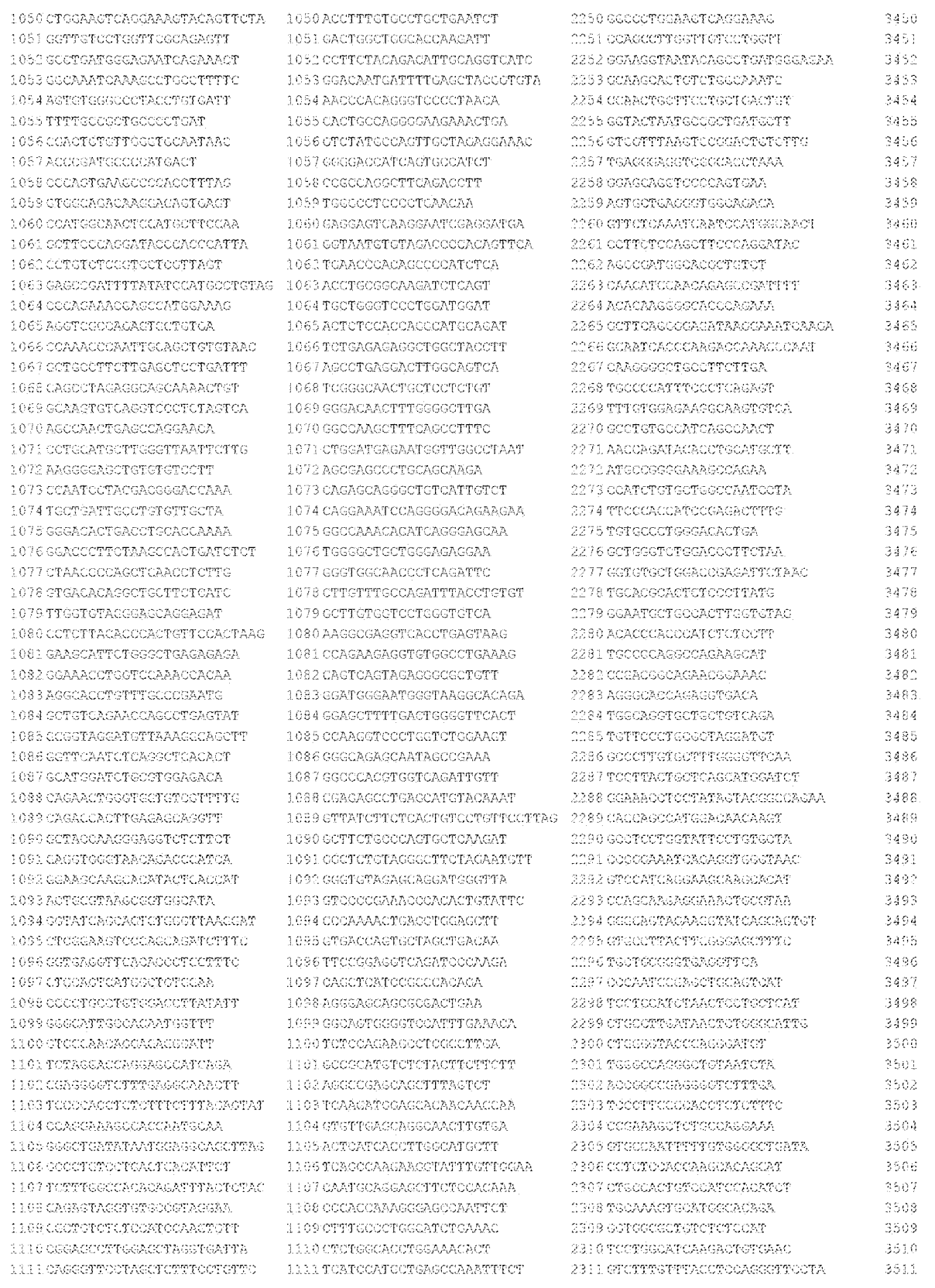
Figure 34B9:
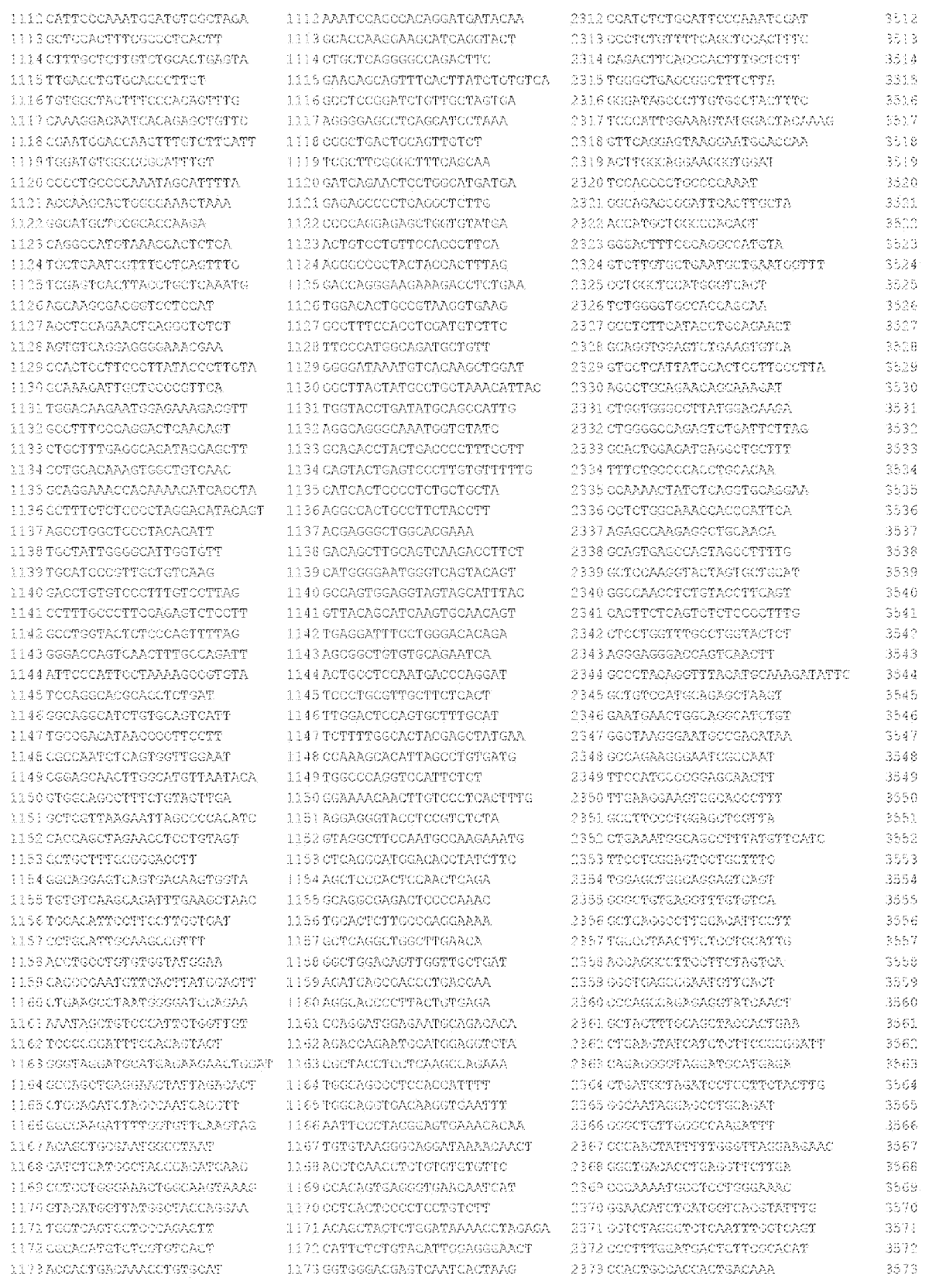

FIG. 34A1-A10, FIG. 34B1-B10: Sequences of an exemplary 1,200-plex primer library (SEQ ID NOs. 1-3,600). The three primers (one from pool A, one from pool B, and one from pool C) in each row all hybridize to the same target locus.

Figure 35A1:
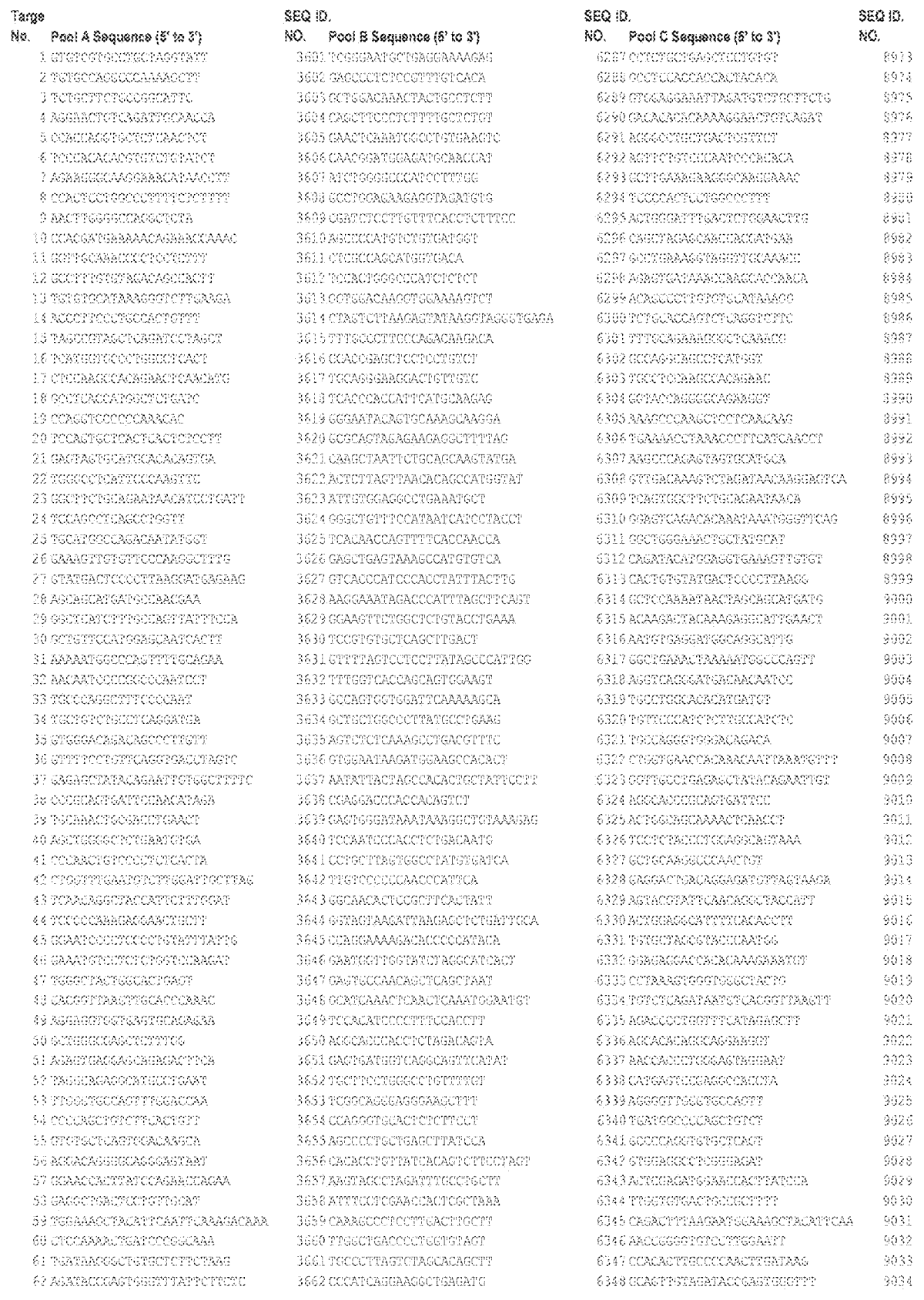
Figure 35A2:
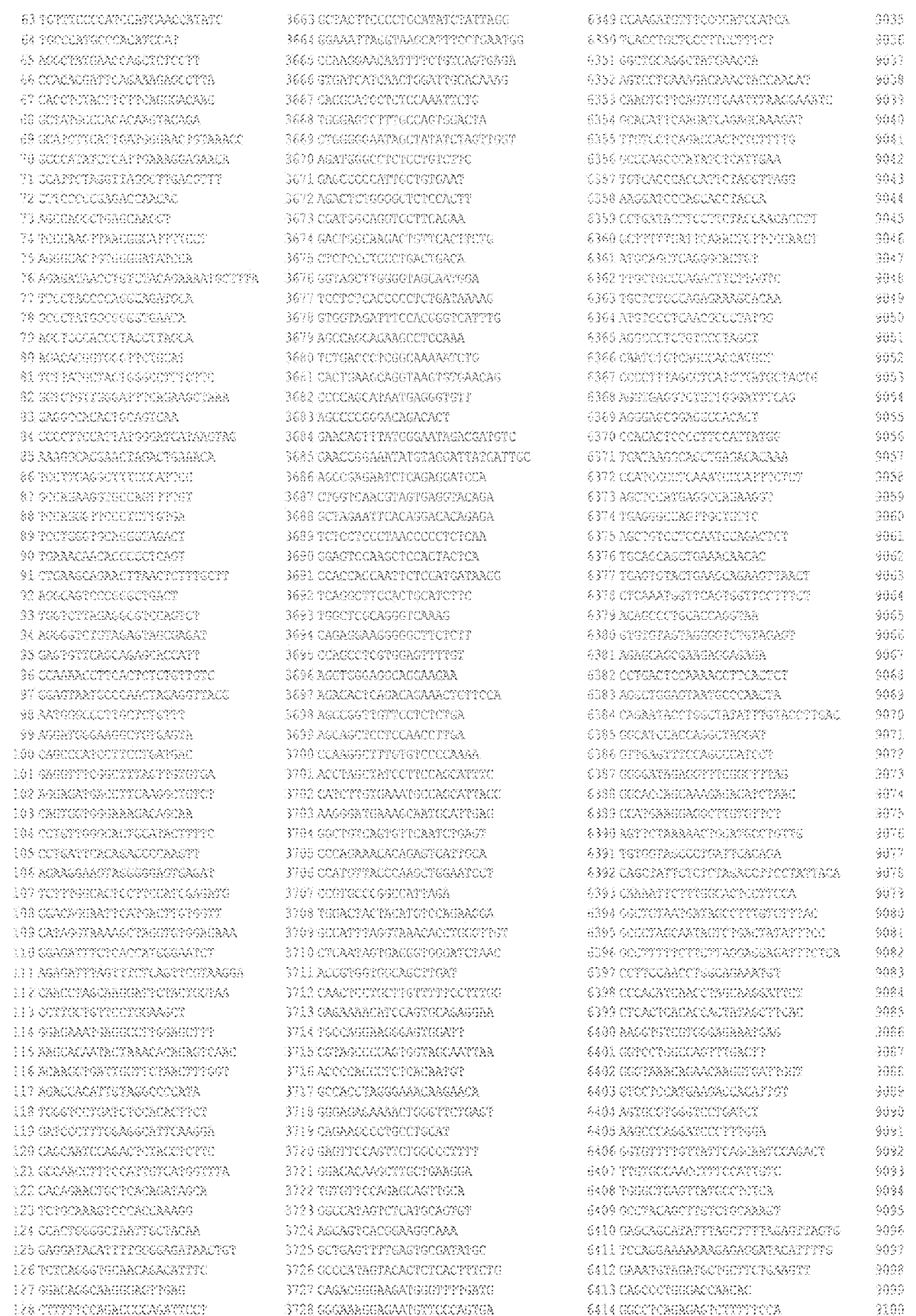
Figure 35A3:
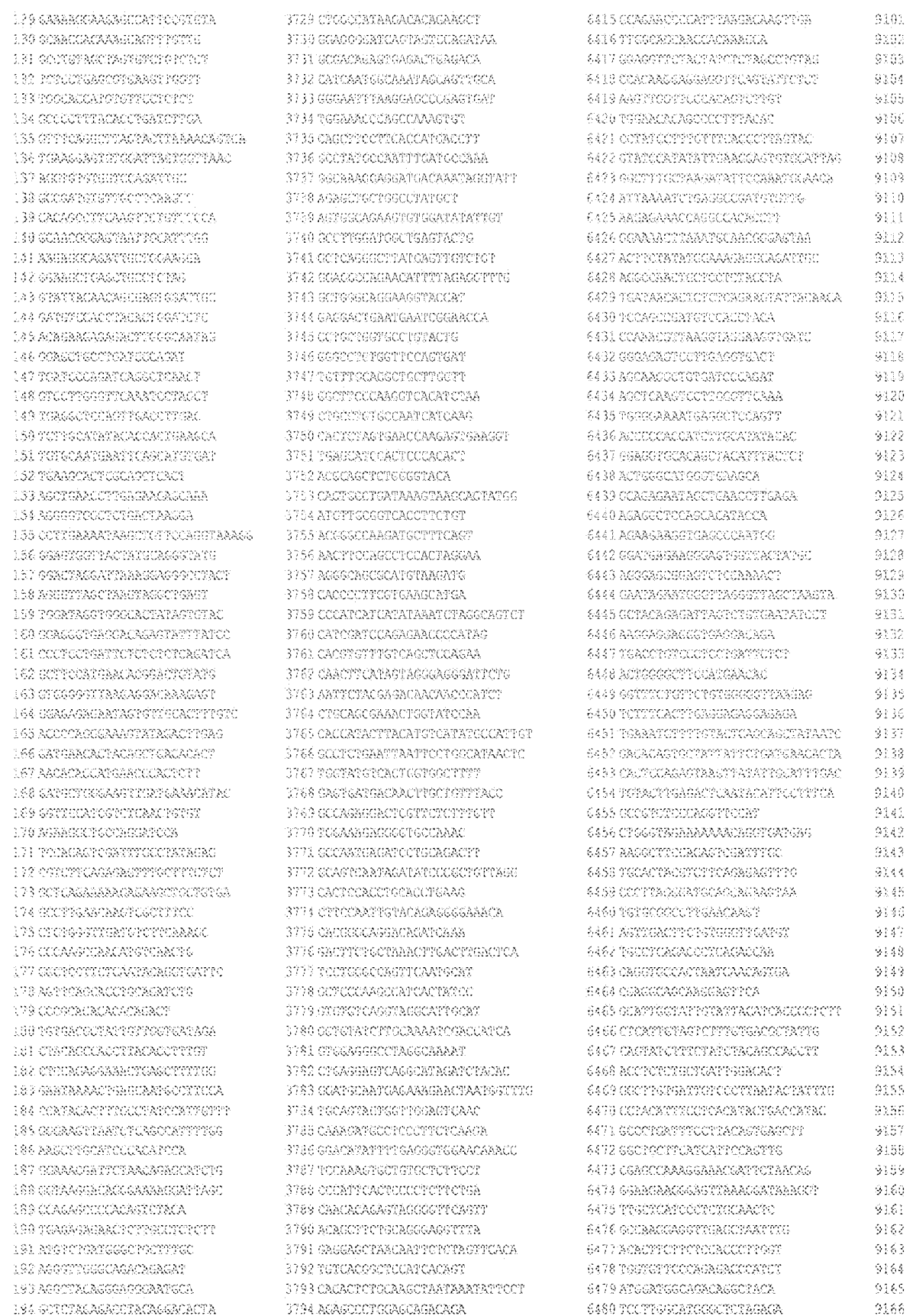
Figure 35A4:
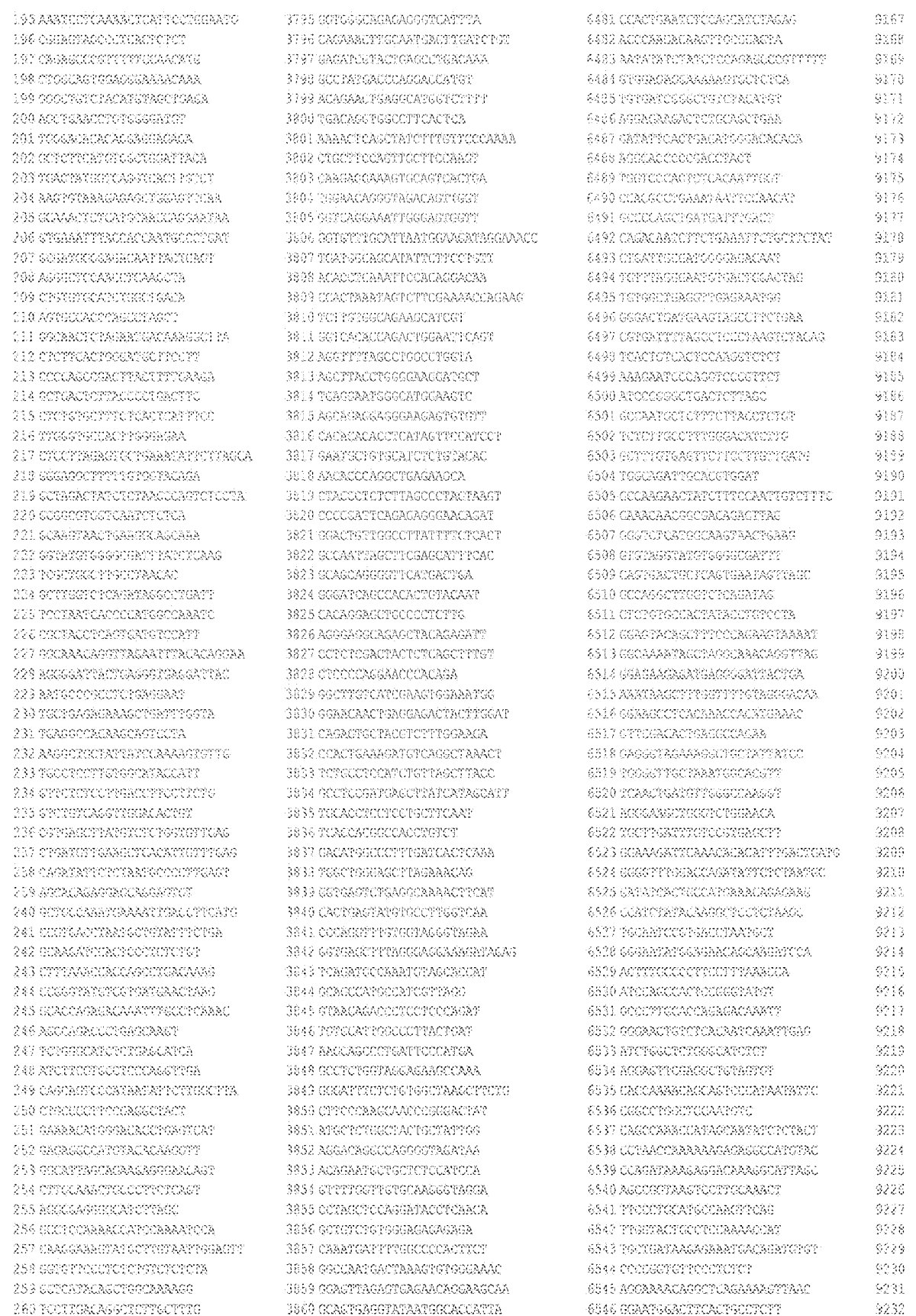
Figure 35A5:
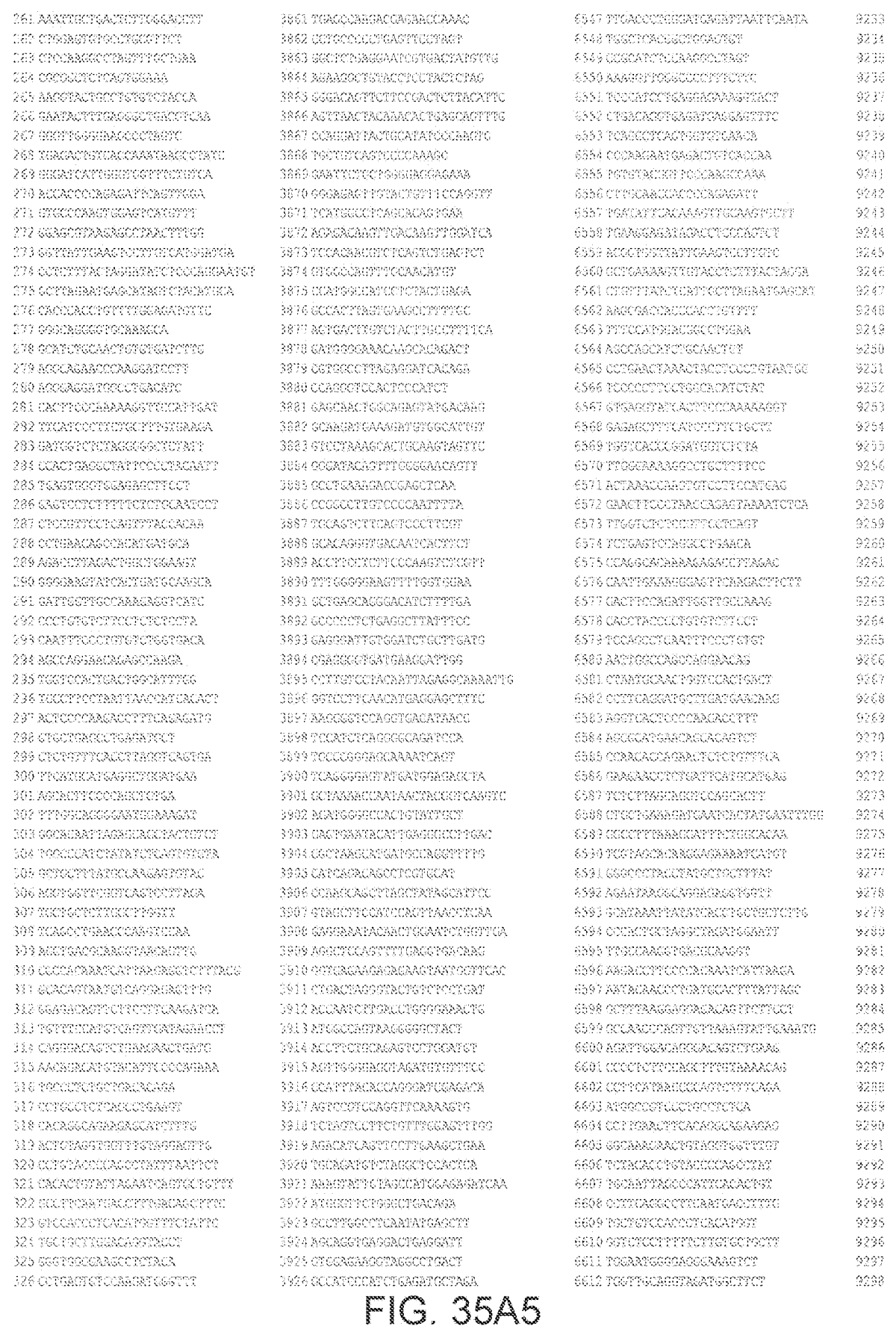
Figure 35A7:
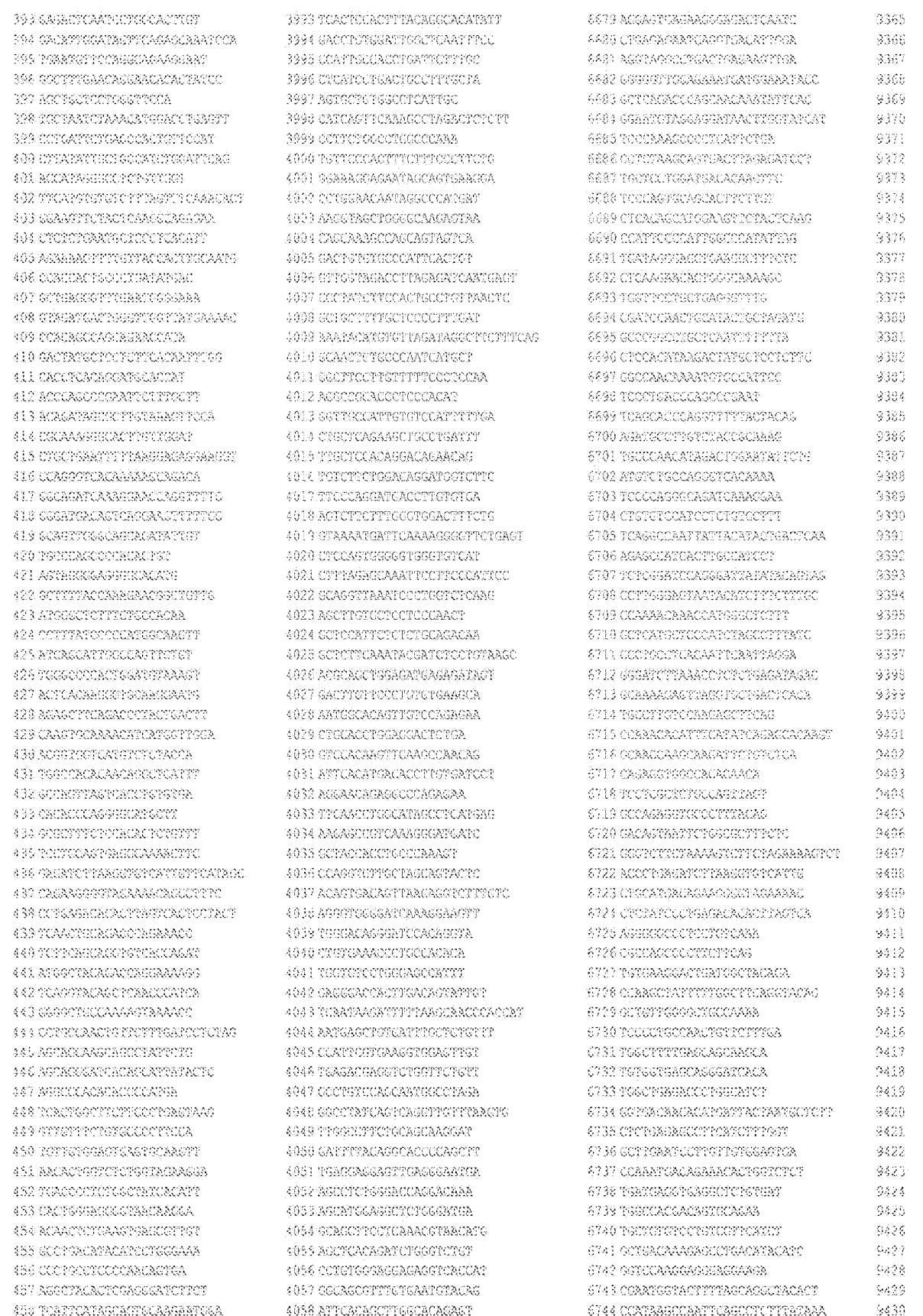
Figure 35A8:
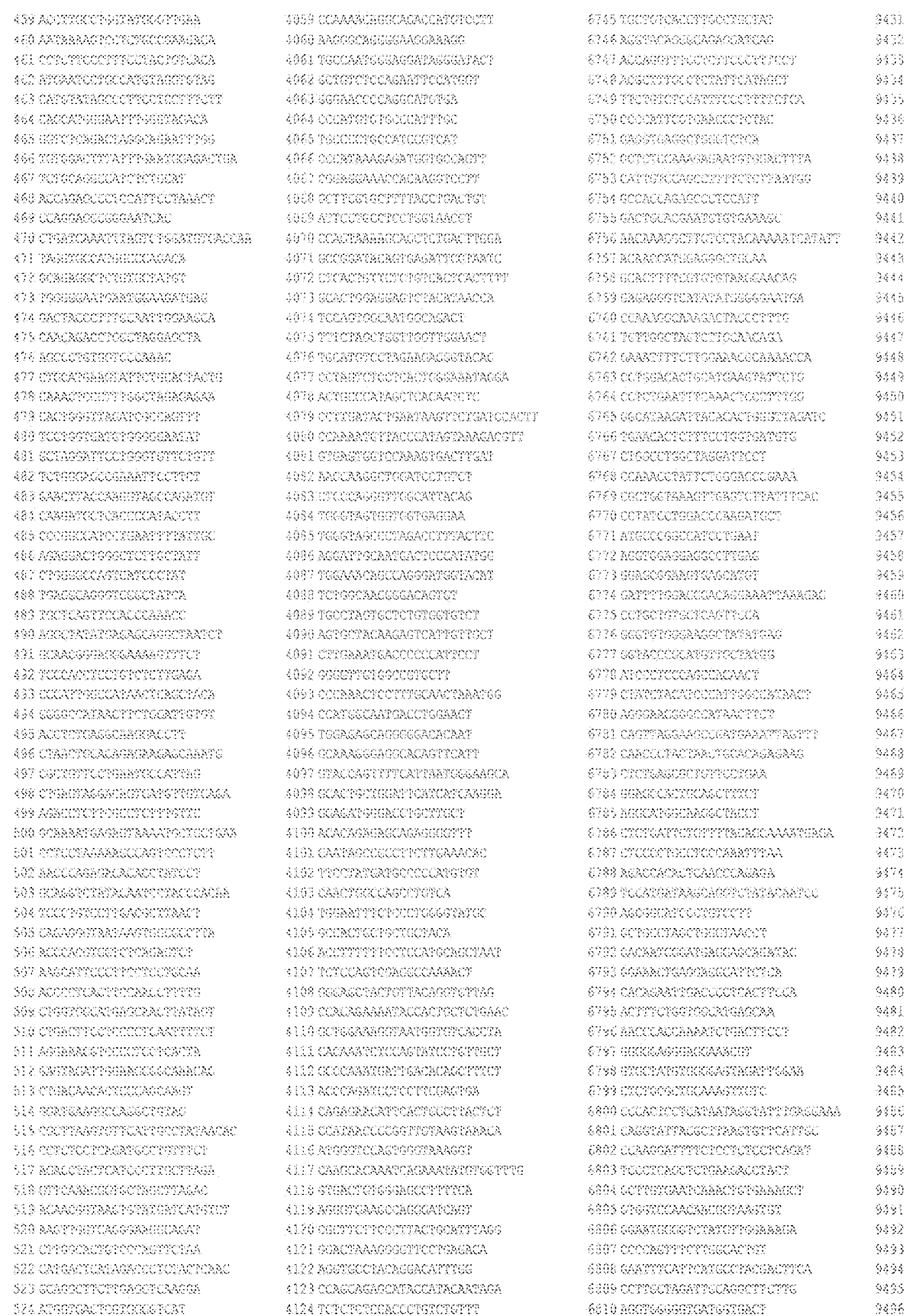
Figure 35A9:
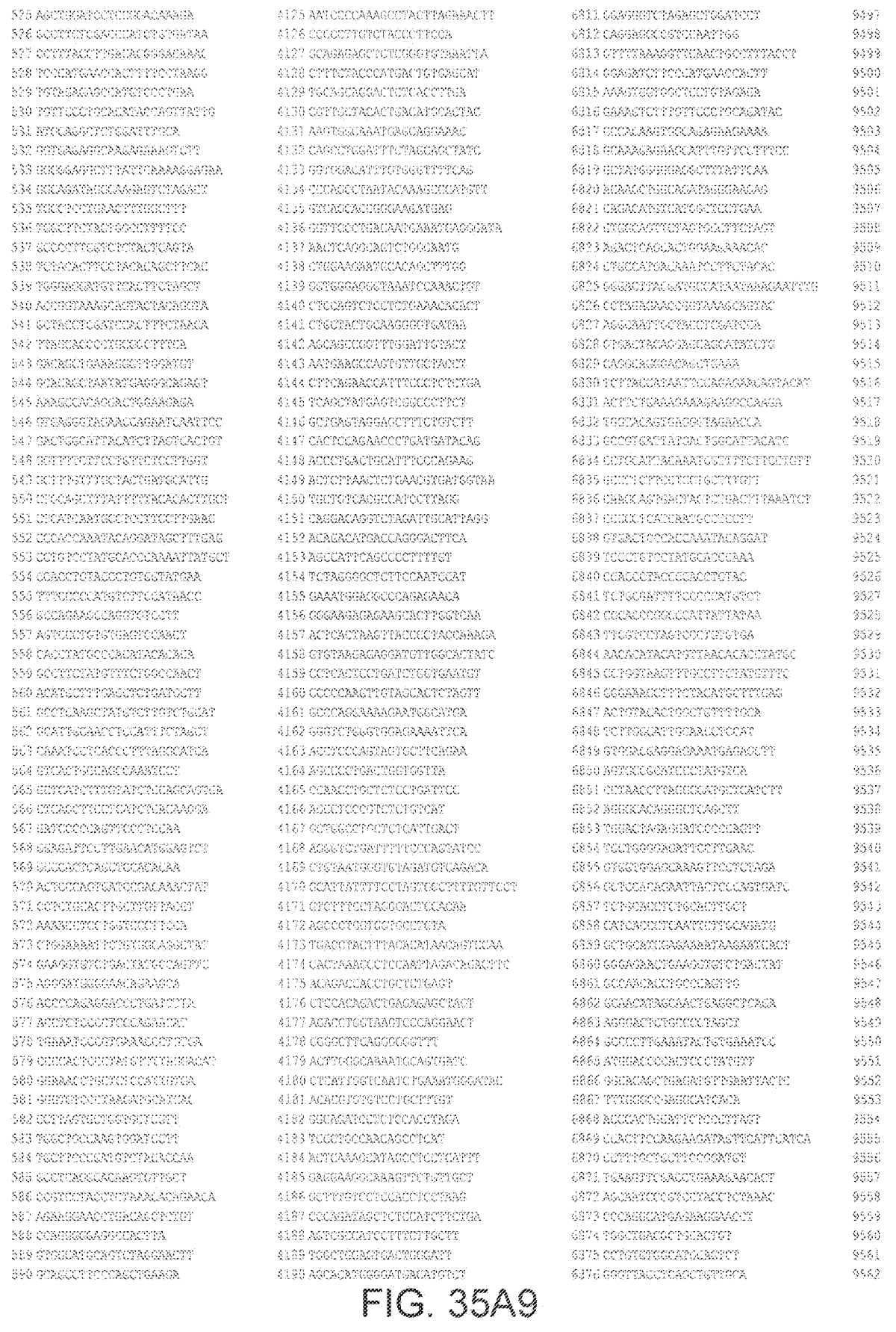
Figure 35A10:
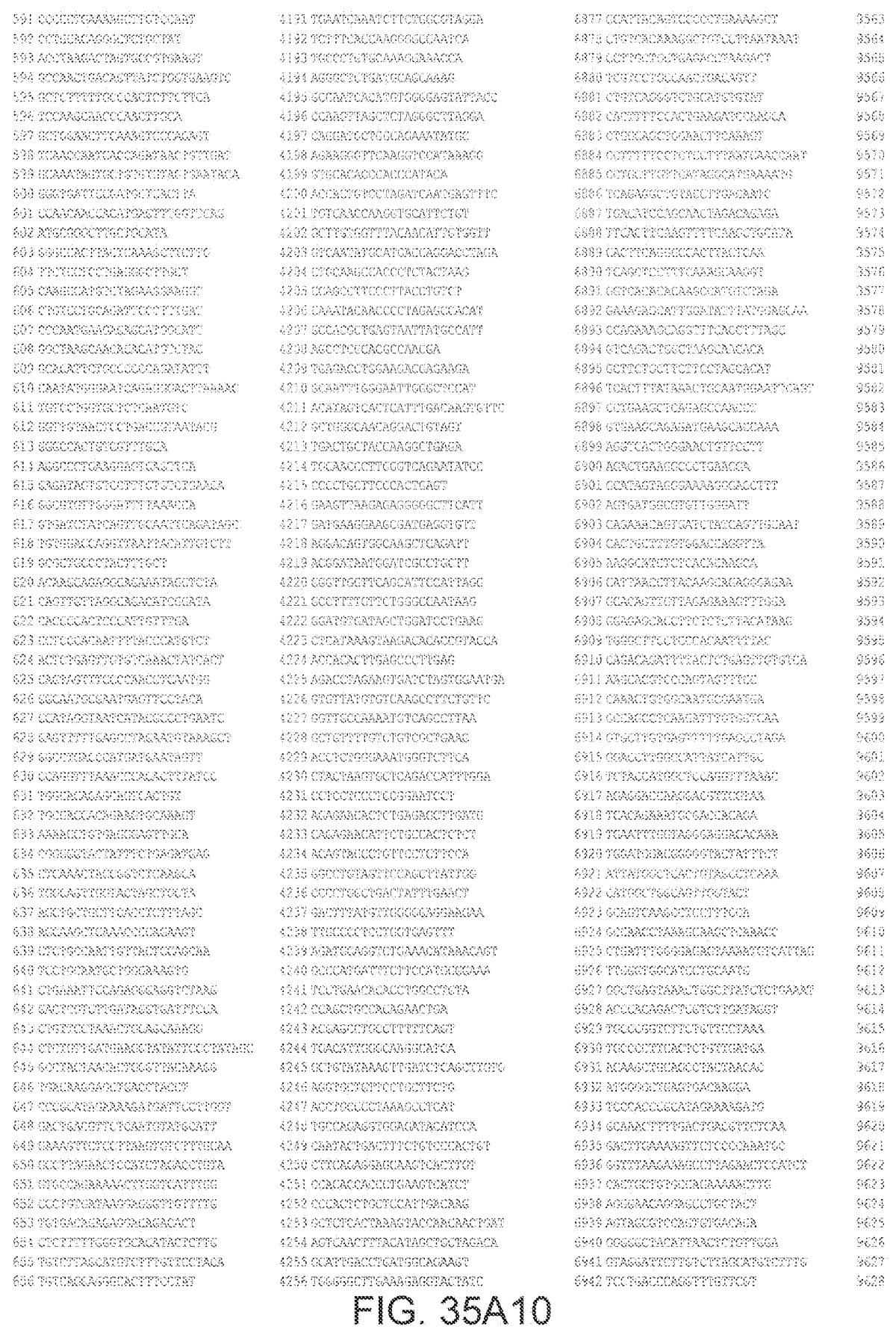
Figure 35B1:
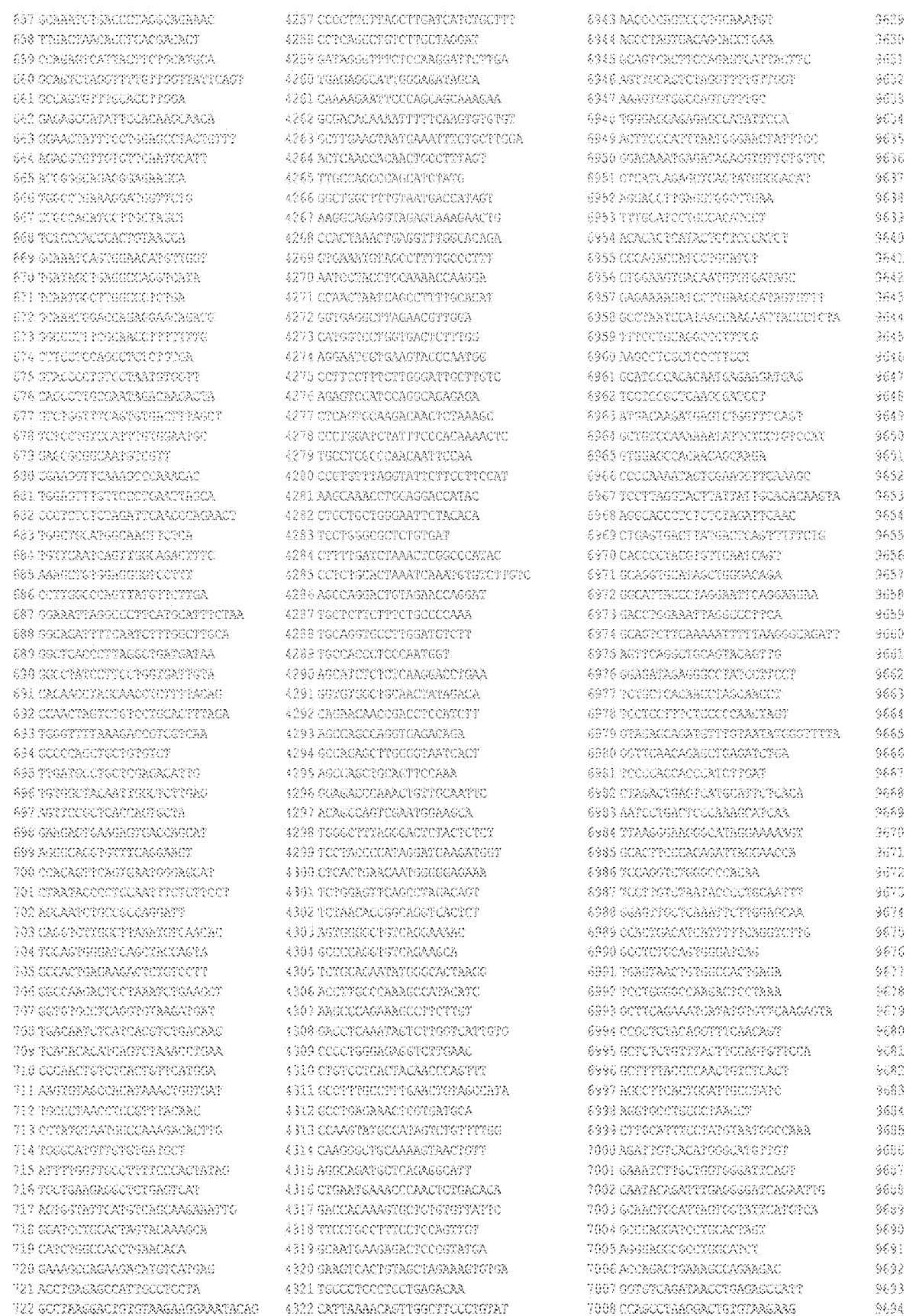
Figure 35B3:
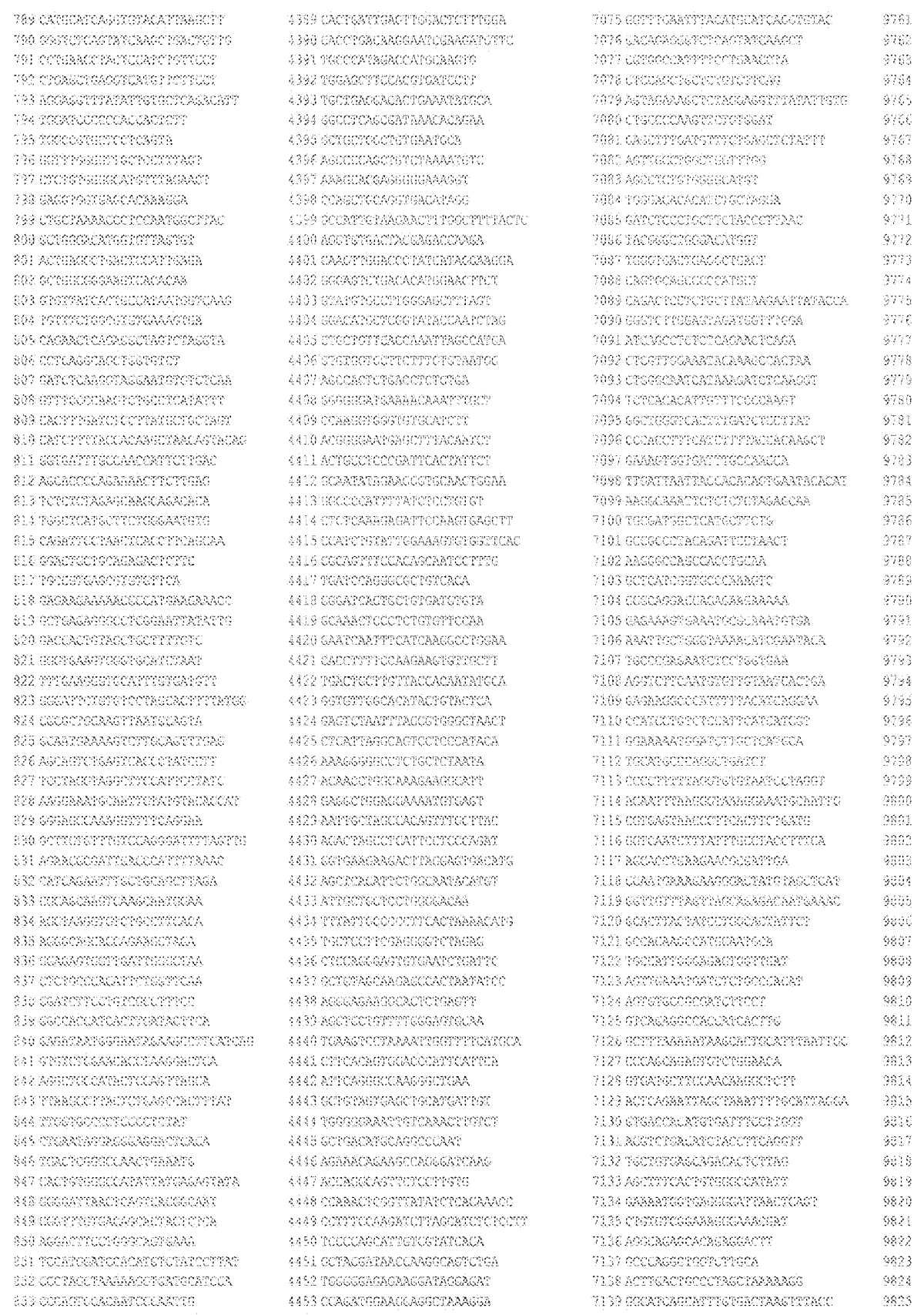
Figure 35B5:
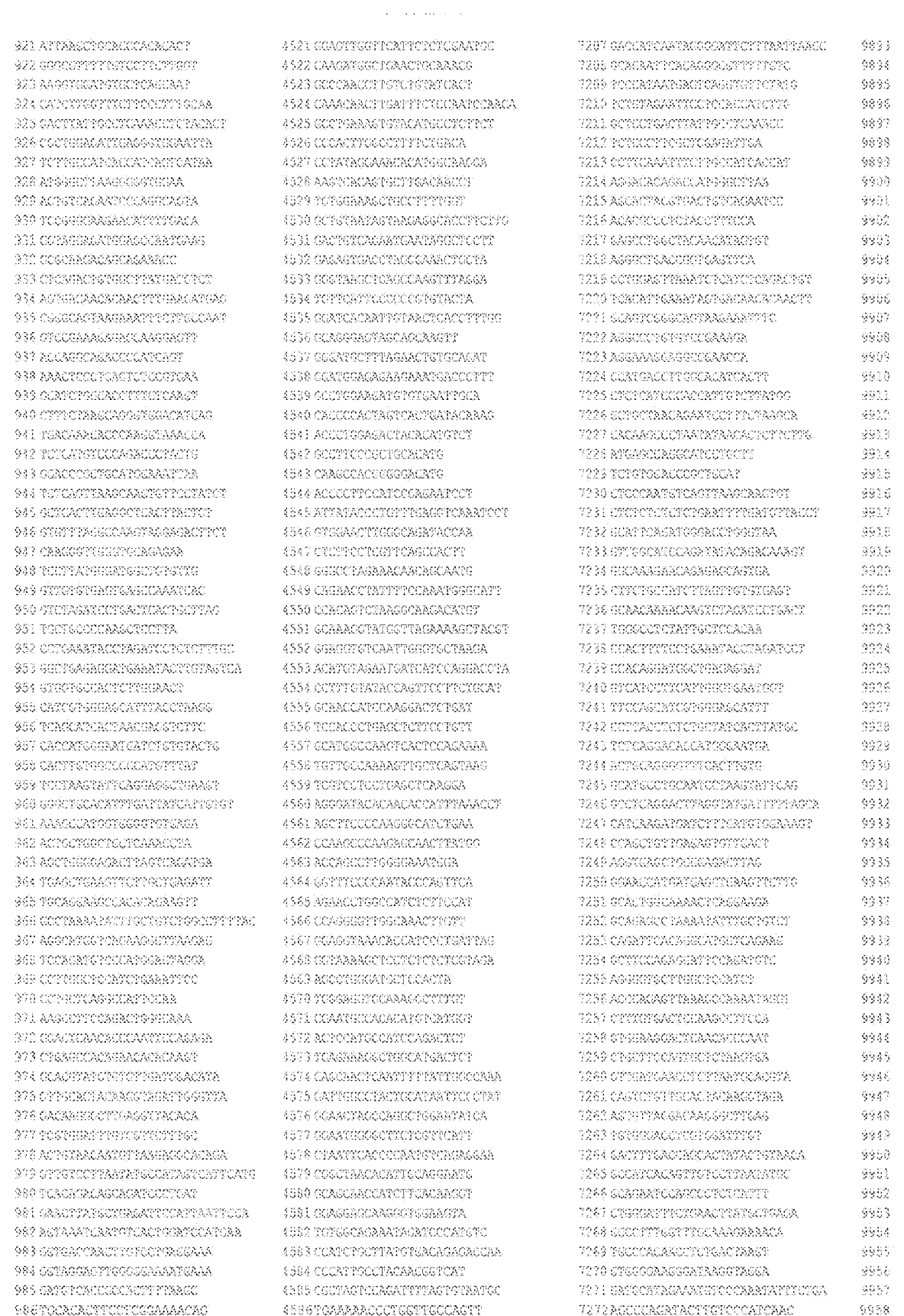
Figure 35B6:
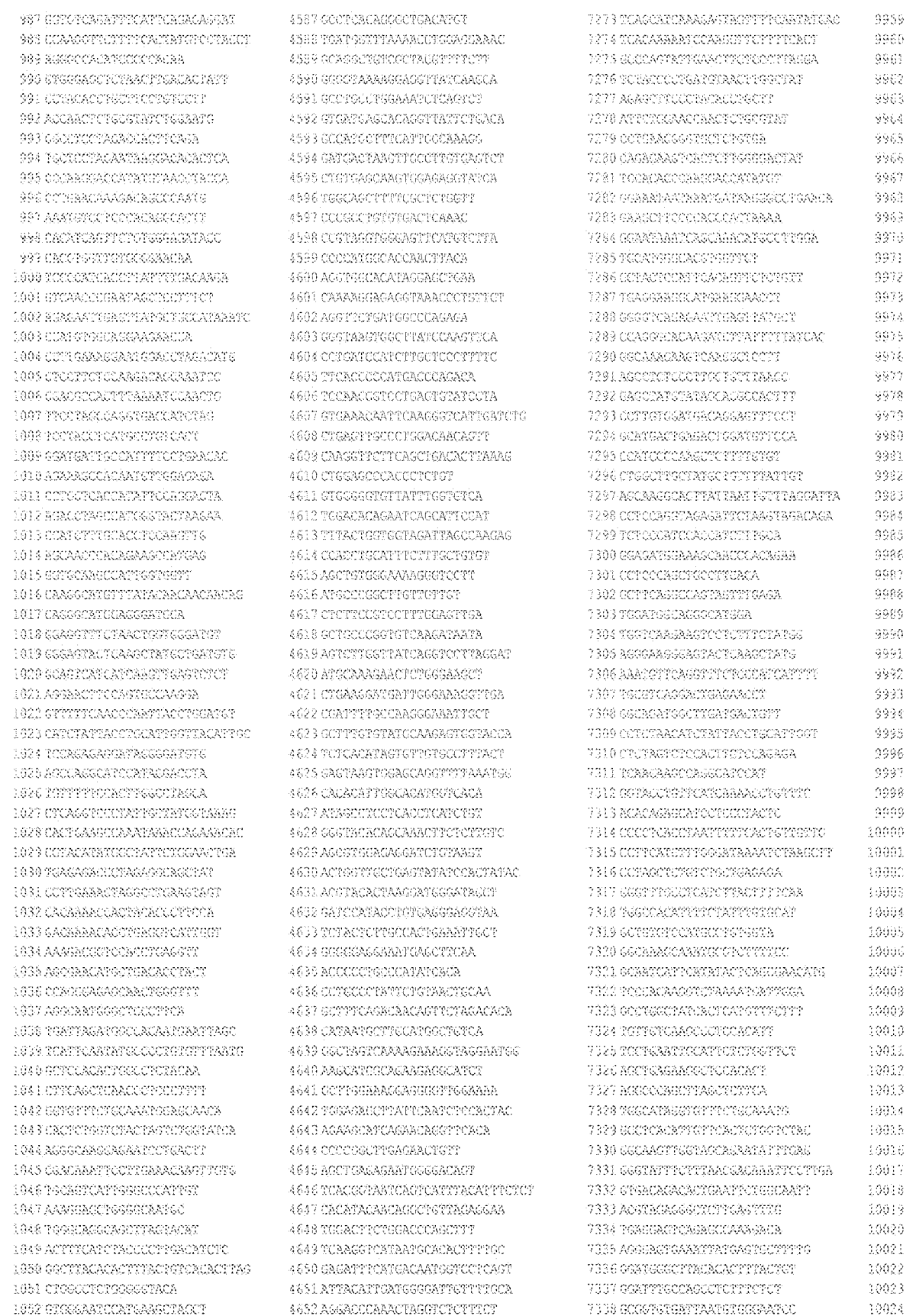
Figure 35B8:
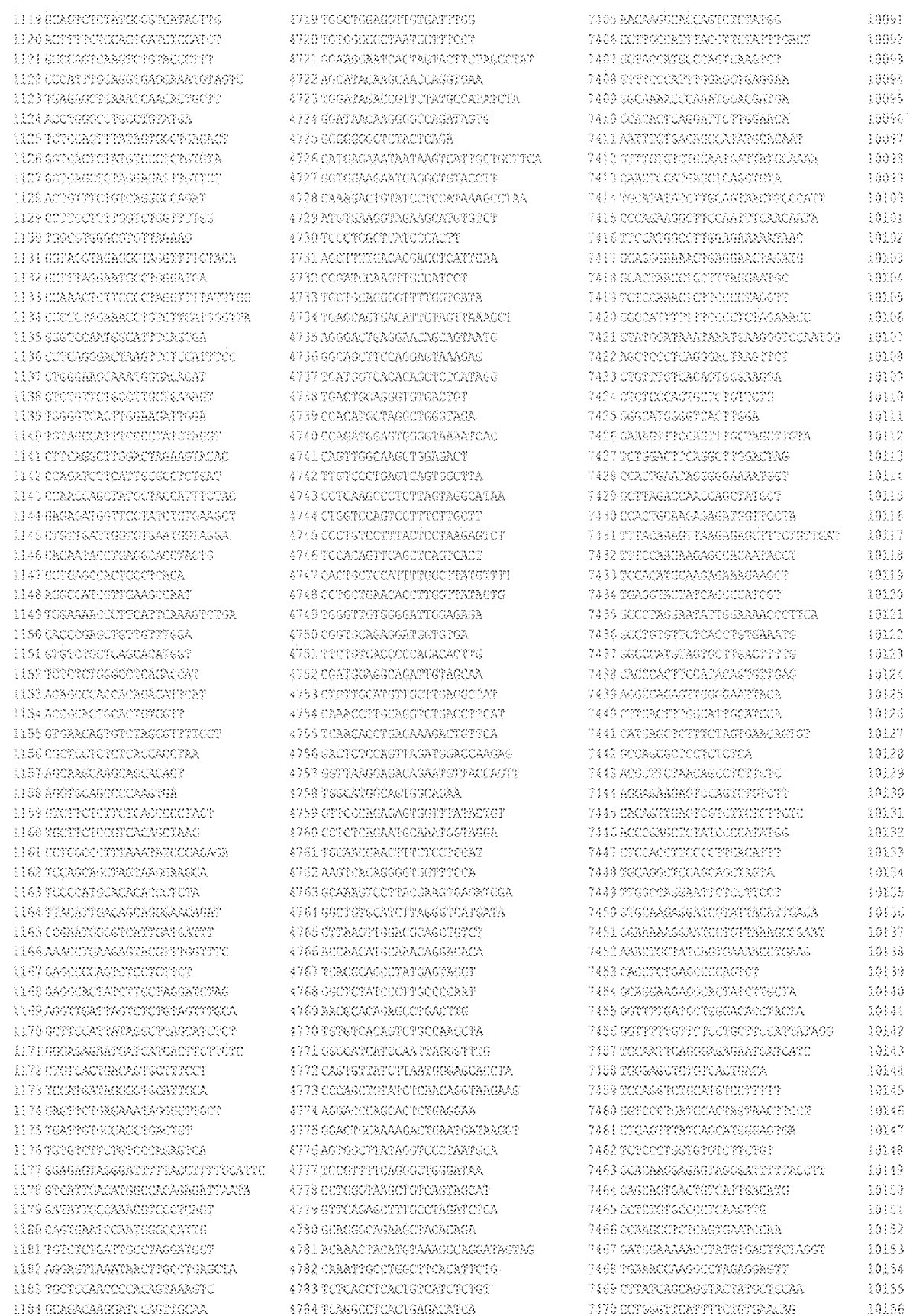
Figure 35B9:
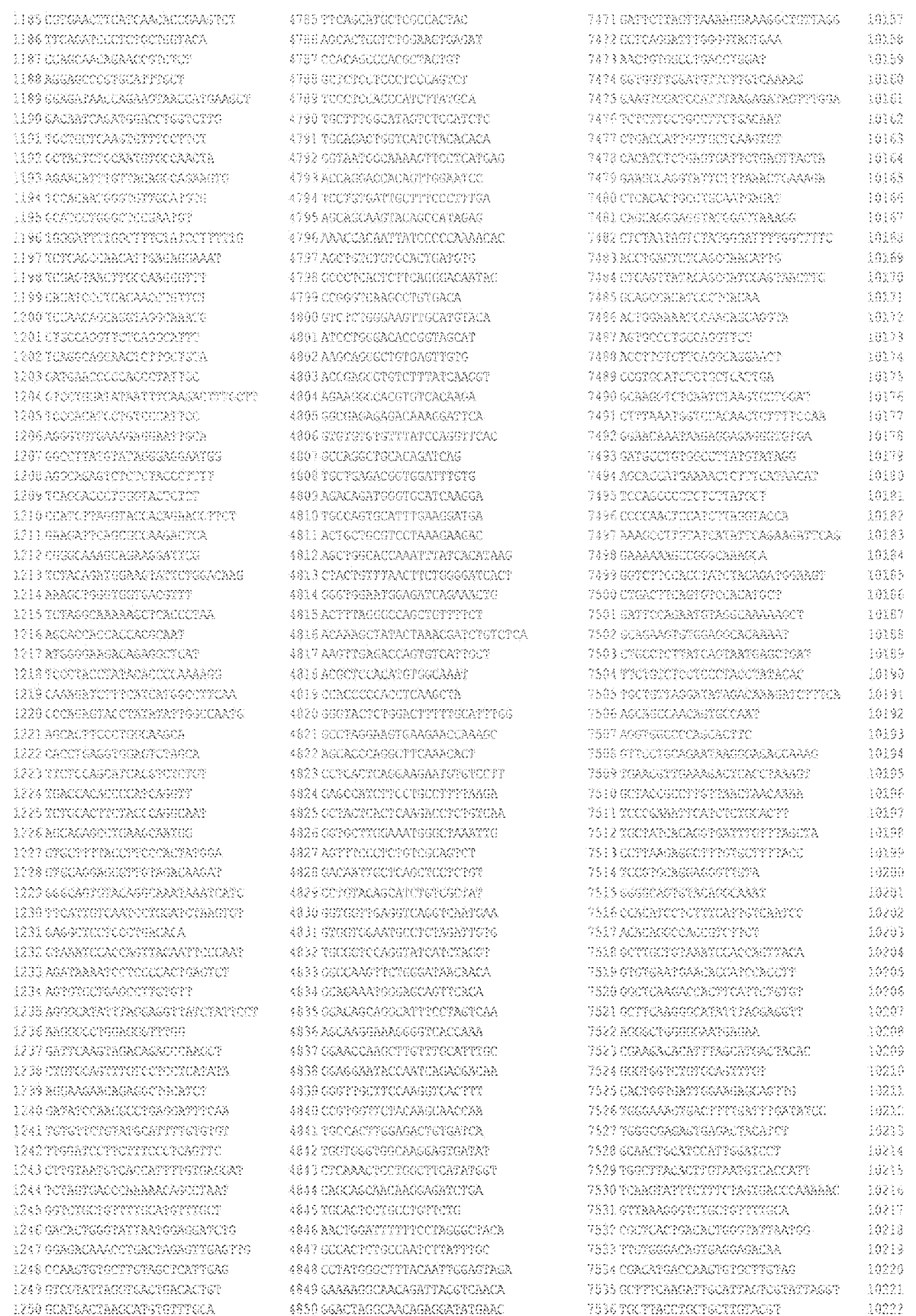
Figure 35C2:
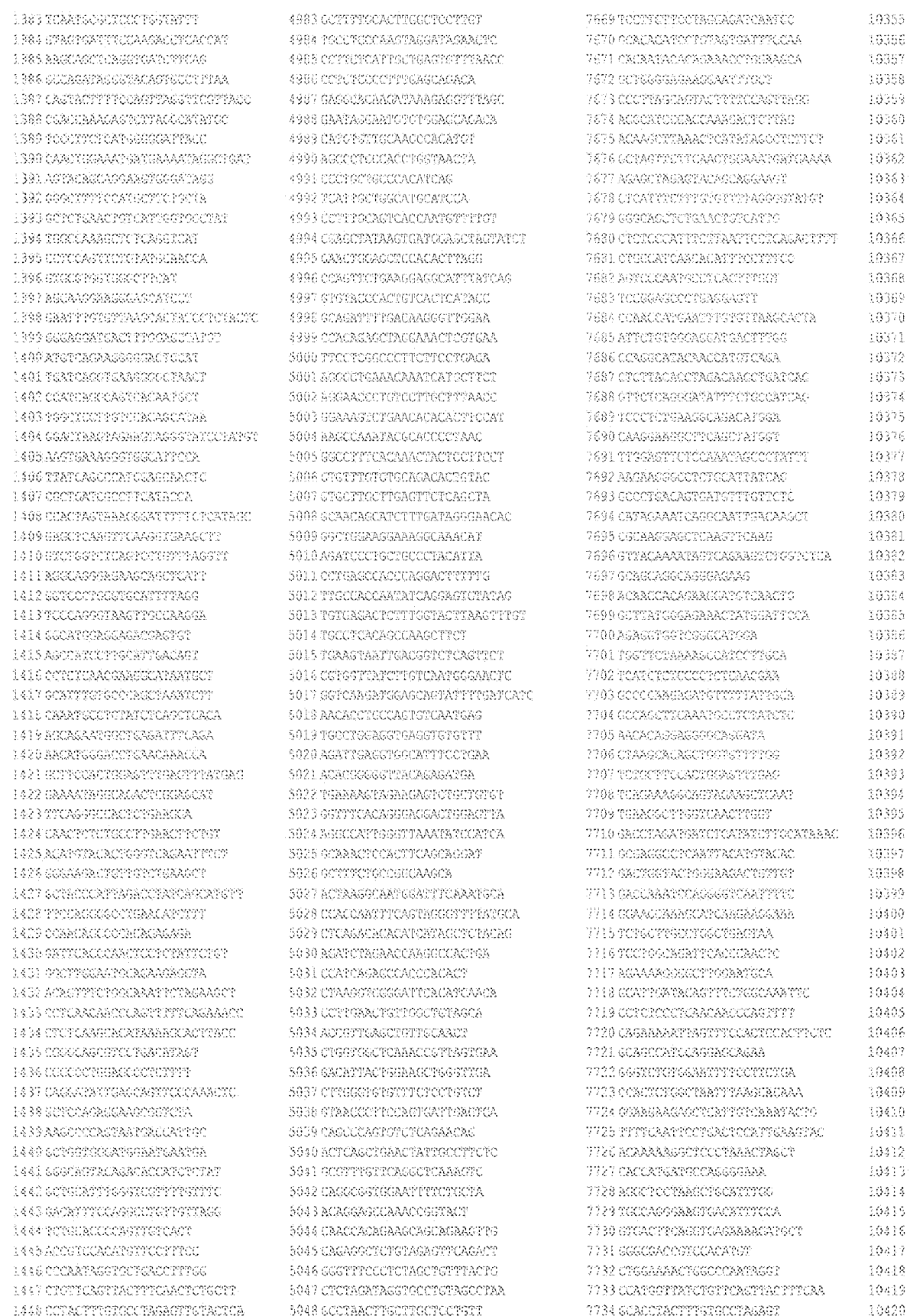
Figure 35C3:
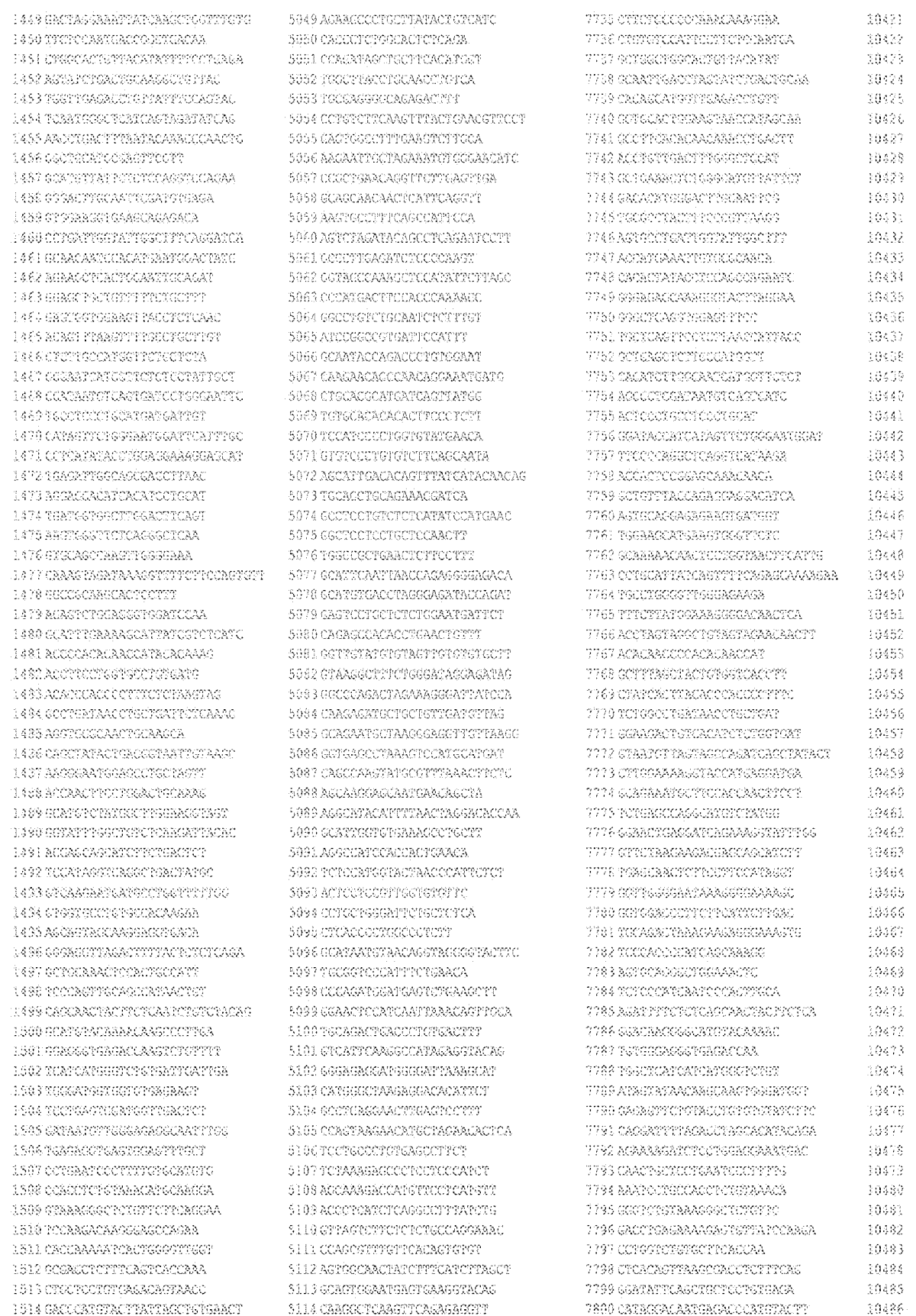
Figure 35C4:
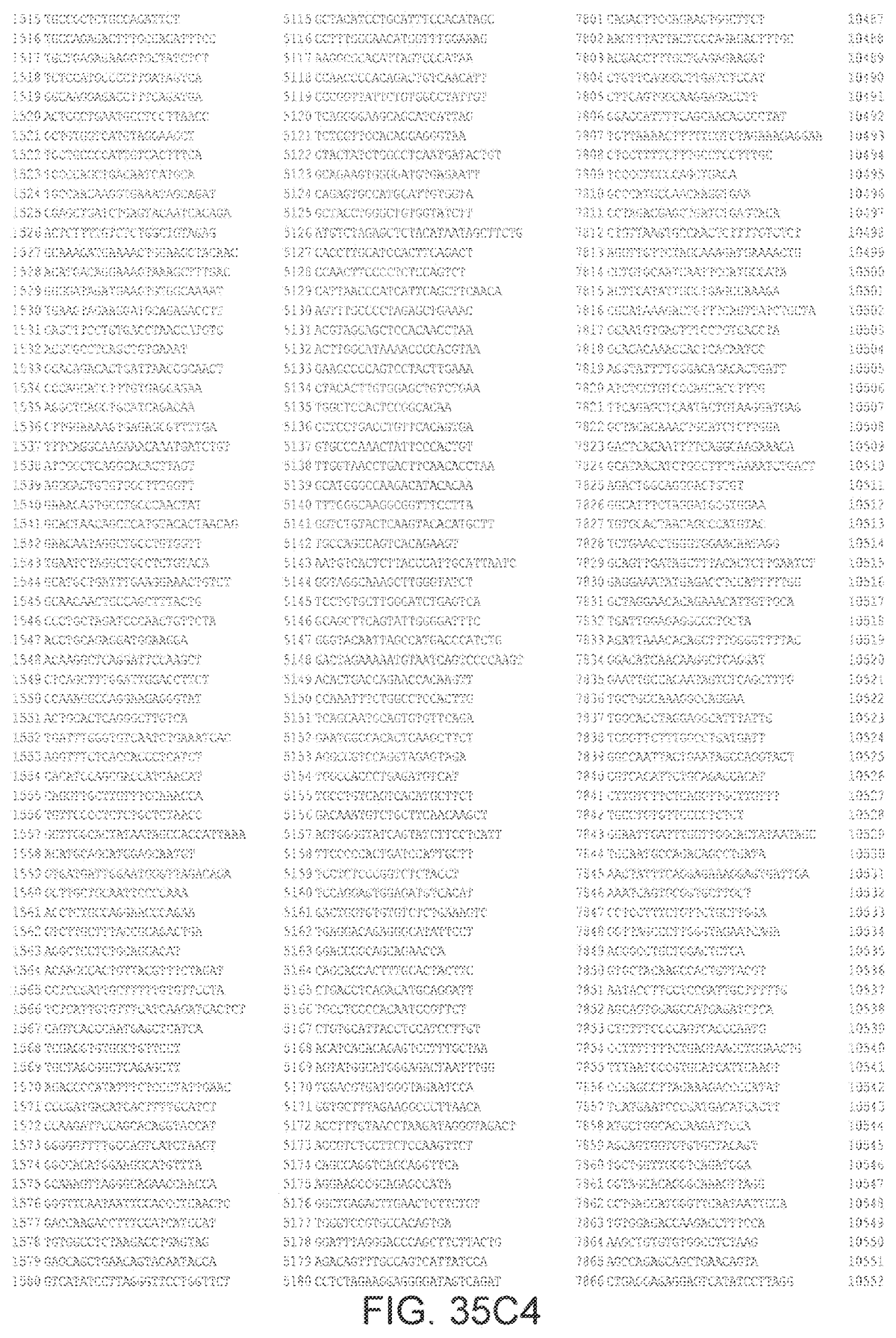
Figure 35C5:
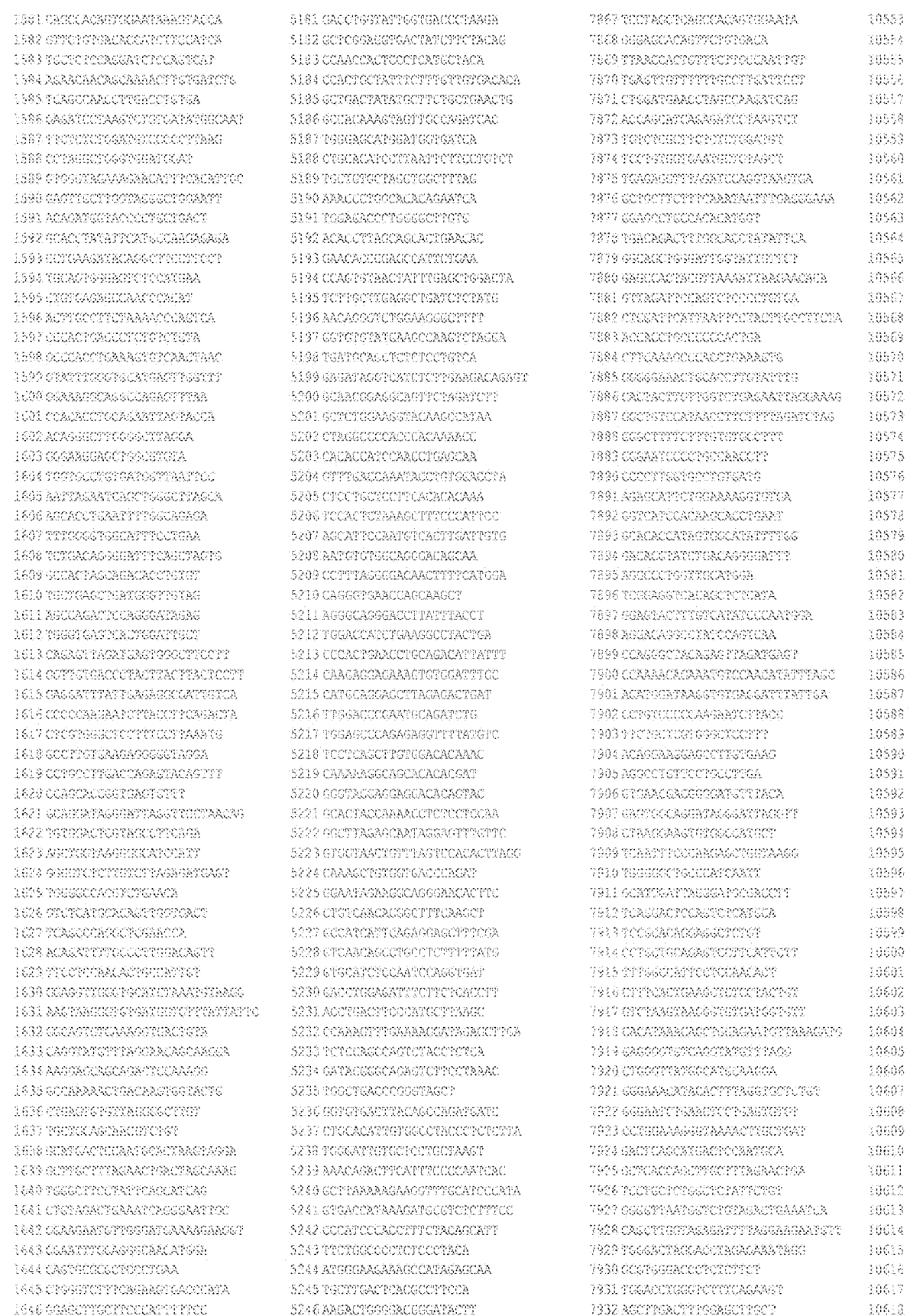
Figure 35C7:
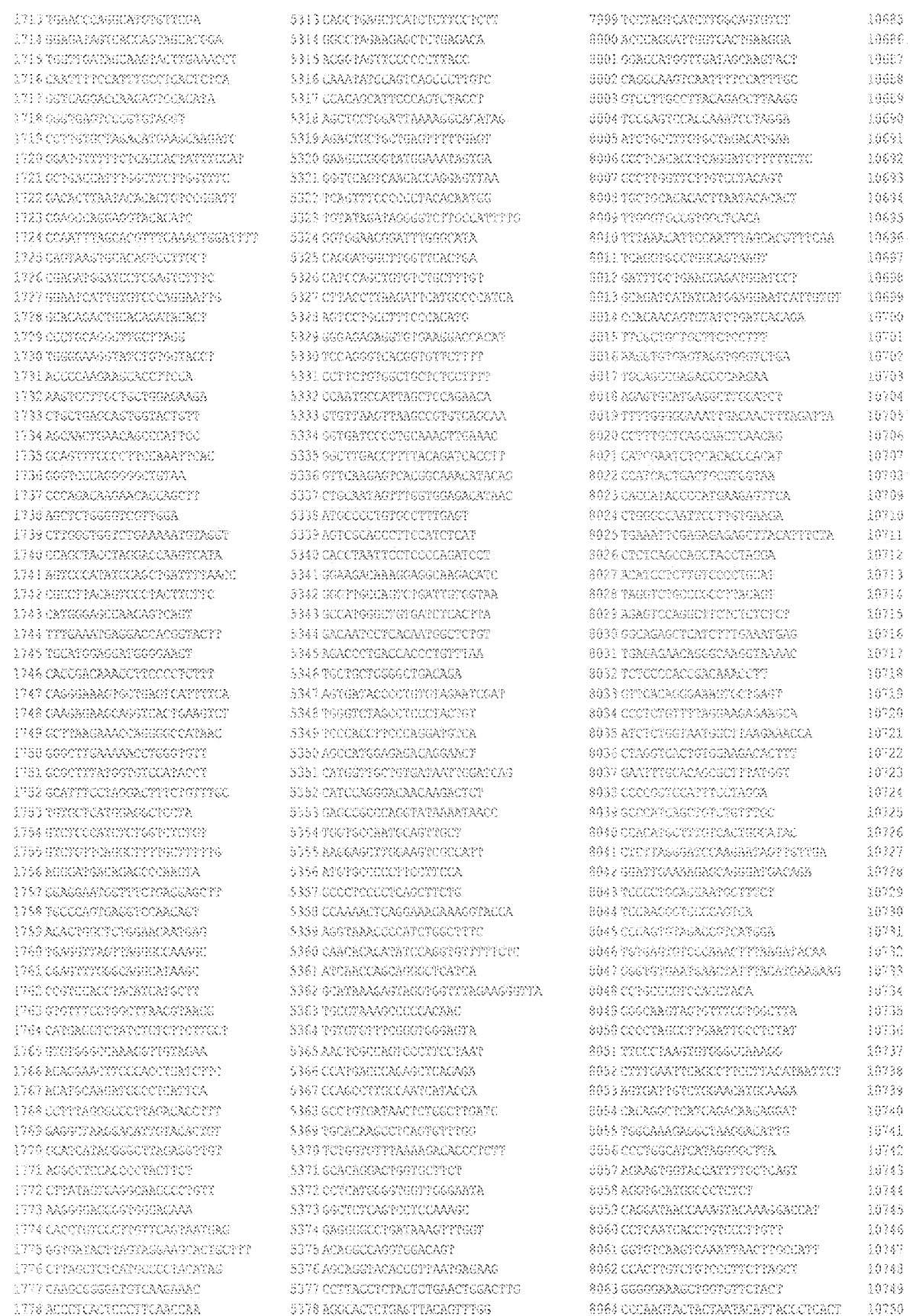
Figure 35C8:
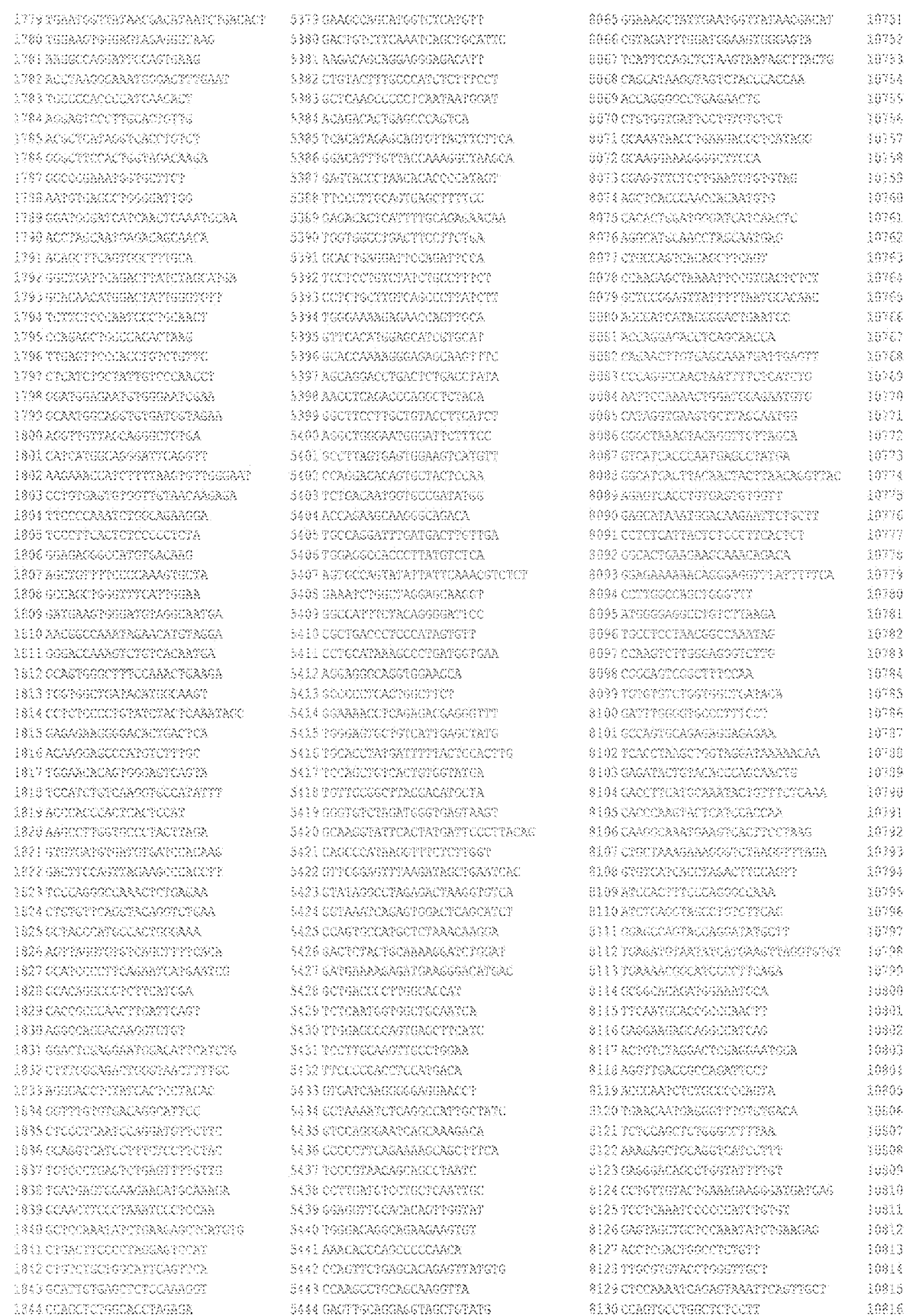
Figure 35C9:
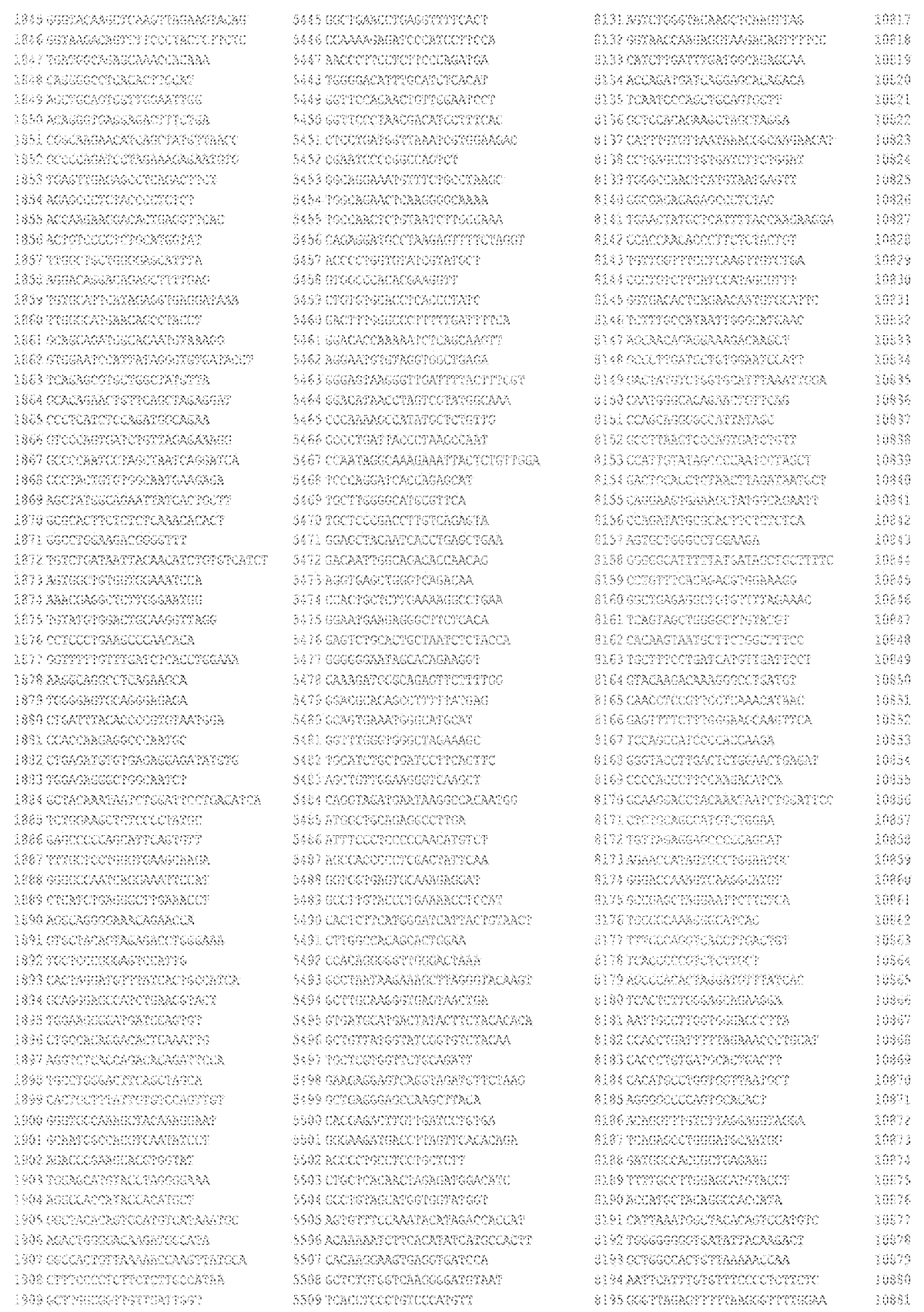
Figure 35D2:
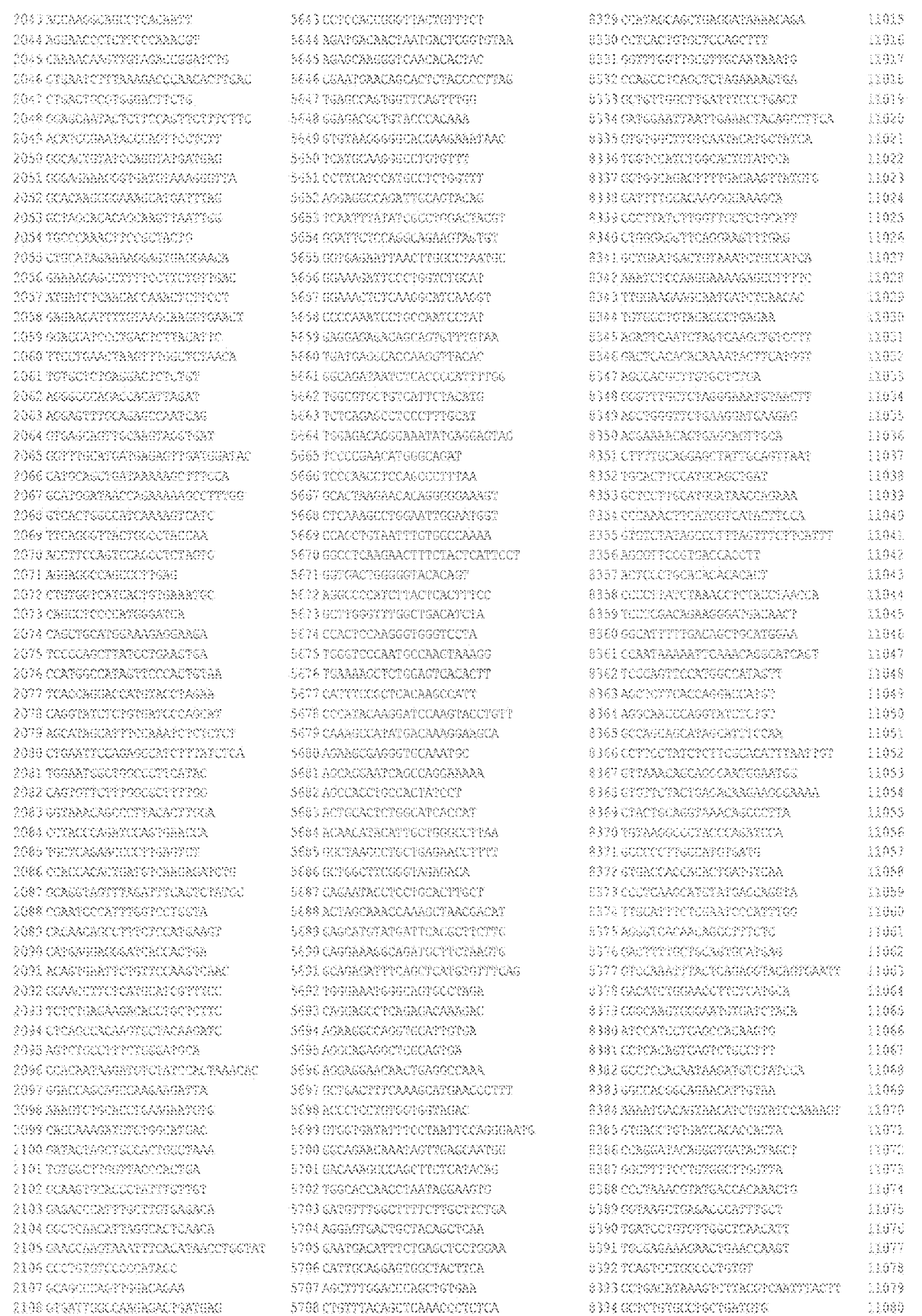
Figure 35D3:
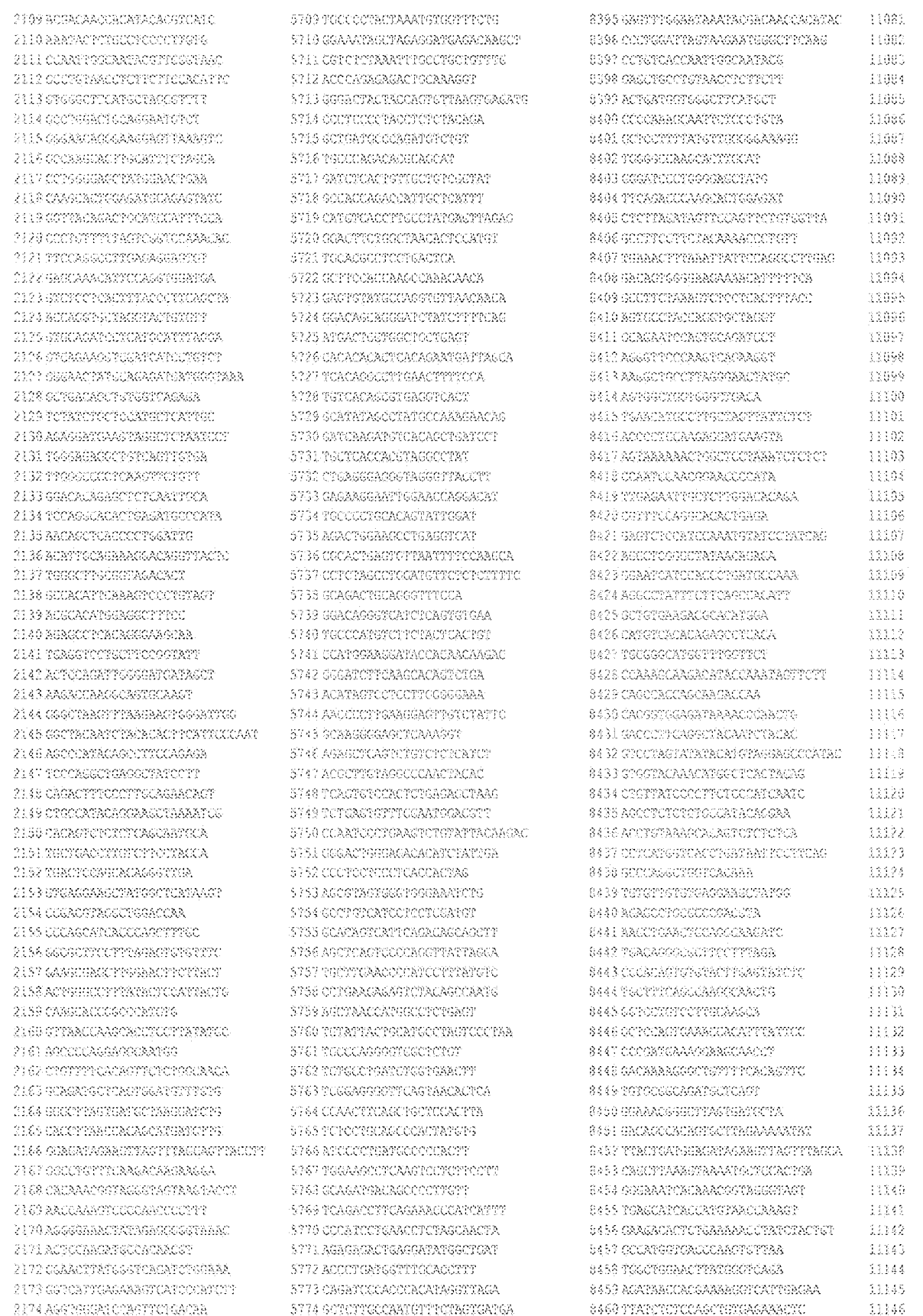
Figure 35D4:
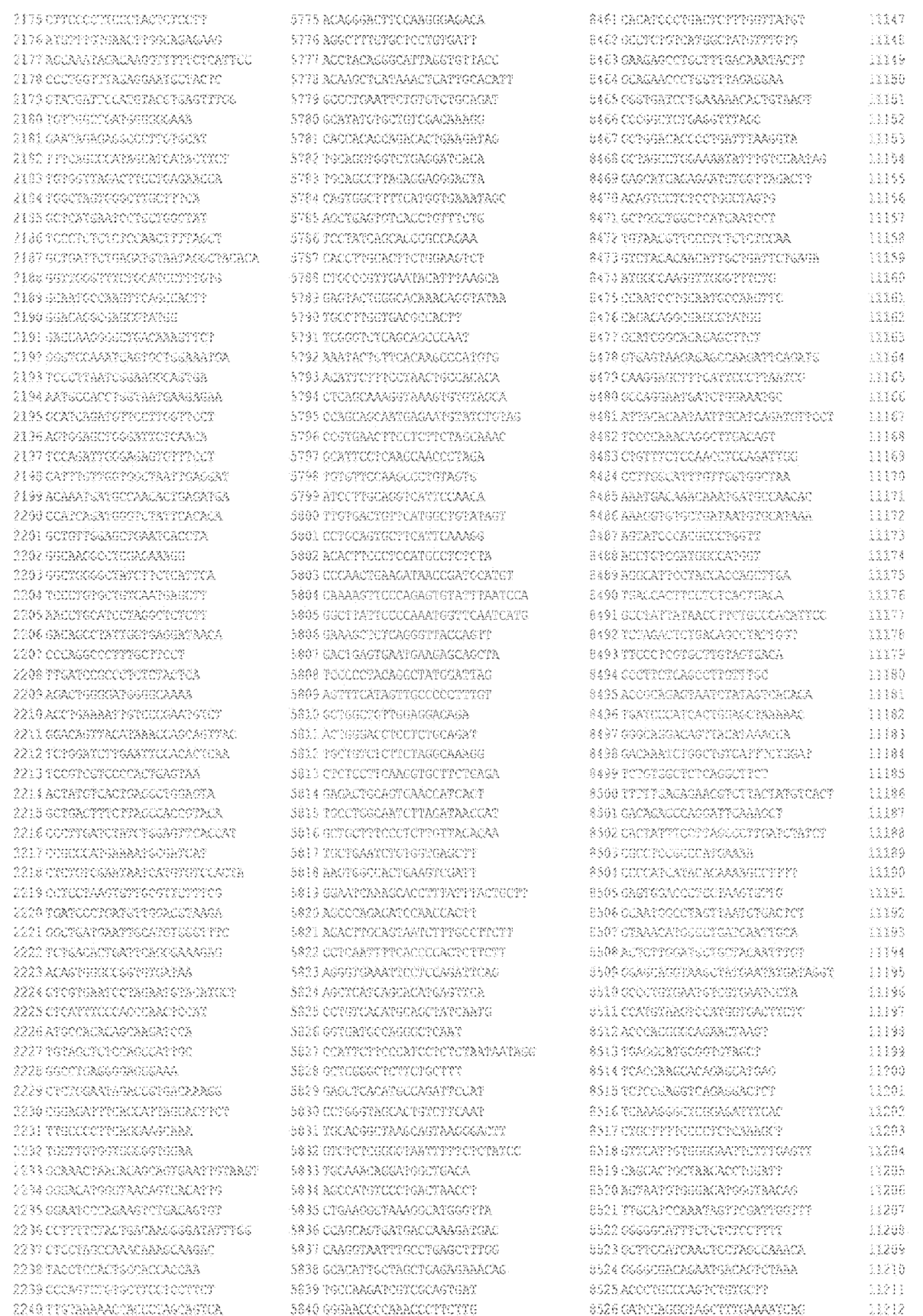
Figure 35D5:
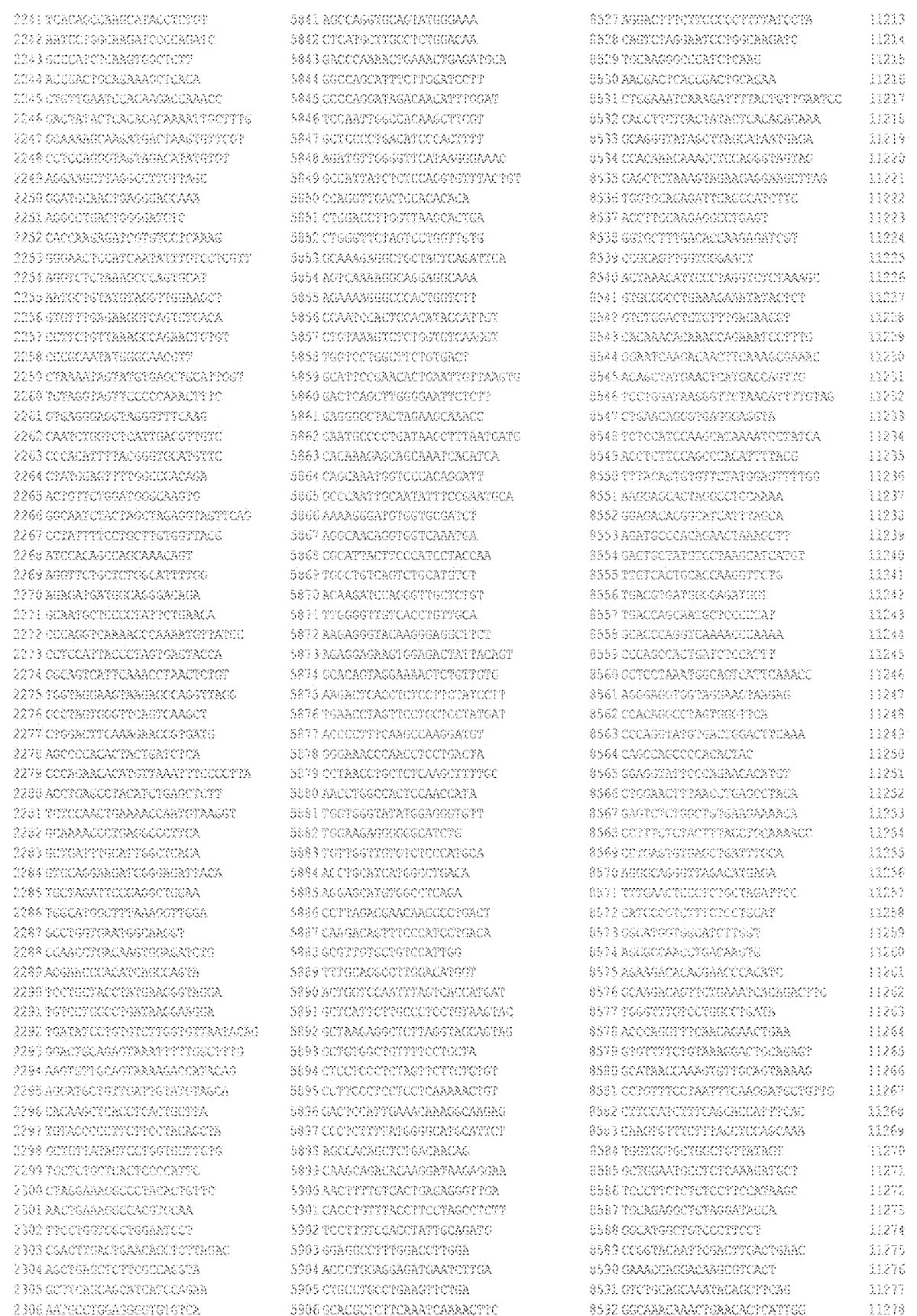
Figure 35D6:
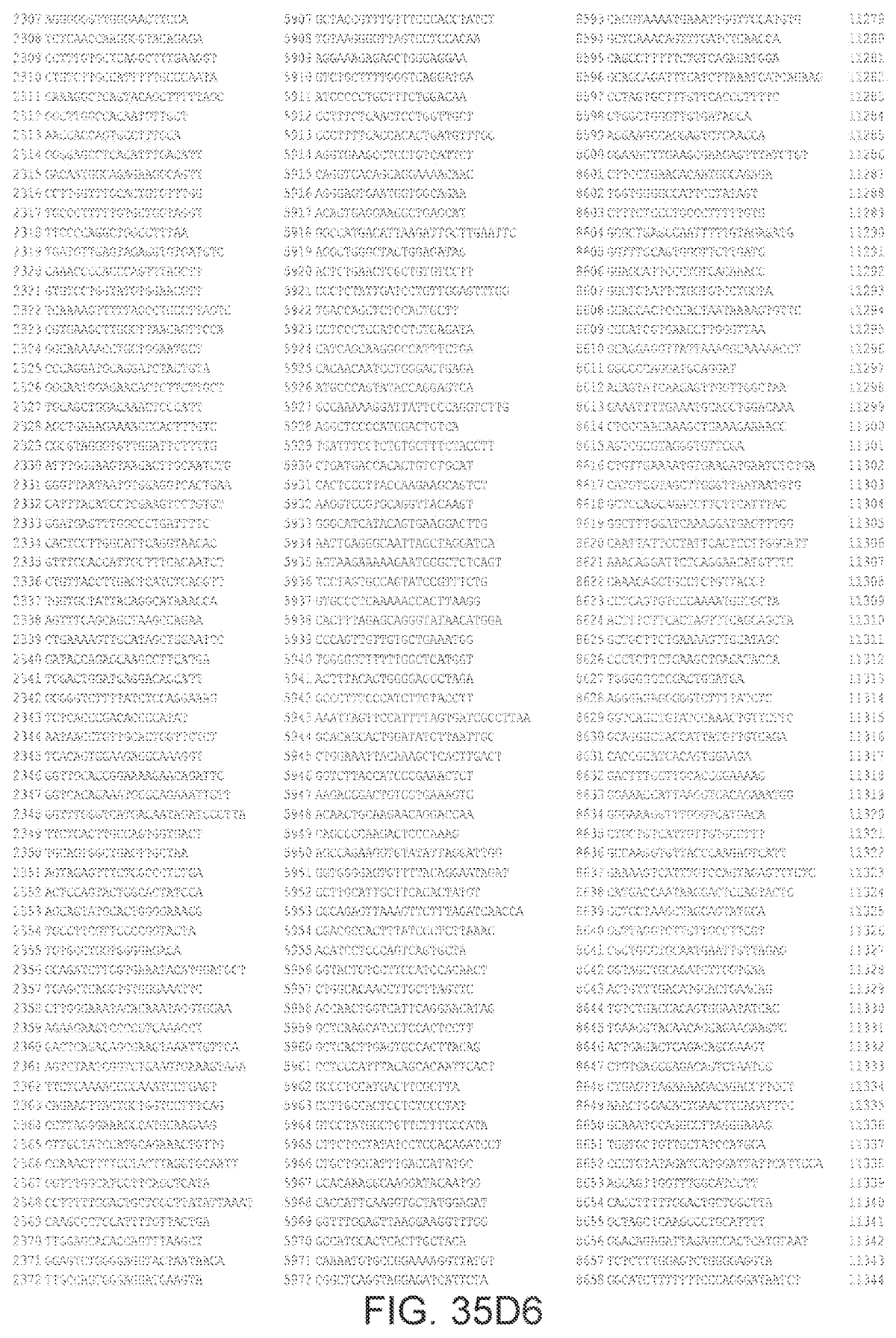
Figure 35D7:
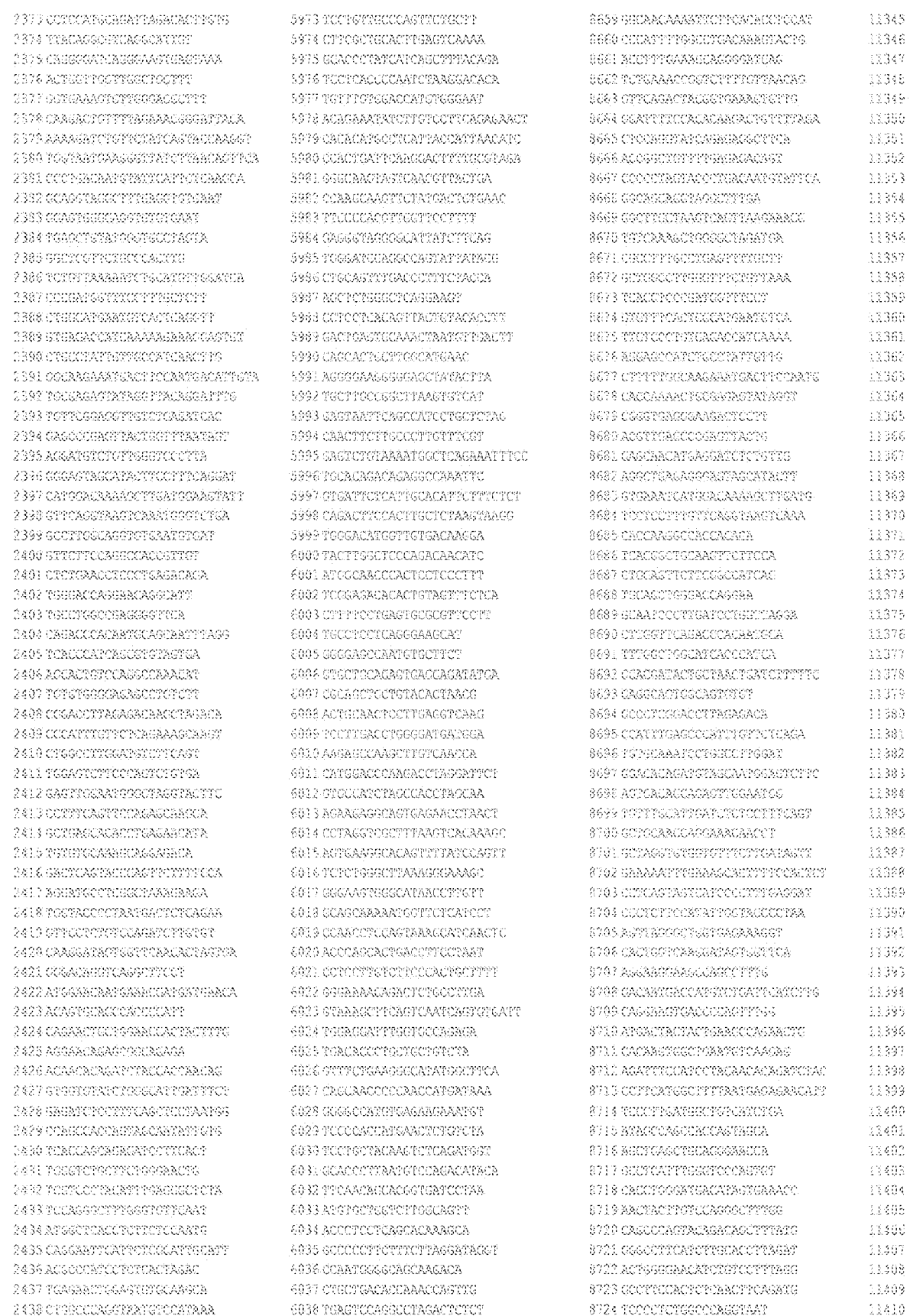
Figure 35D8:
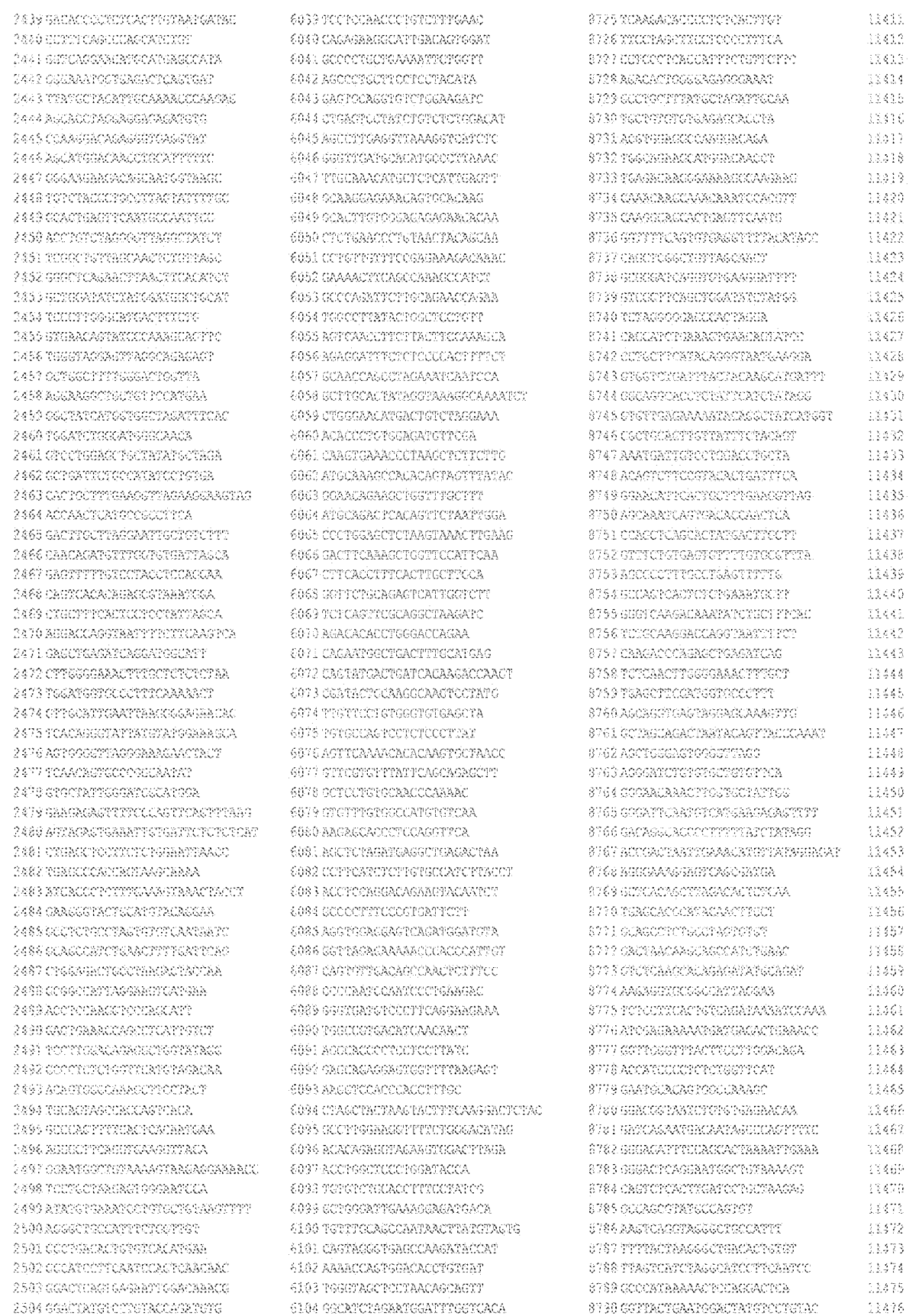
Figure 35D9:
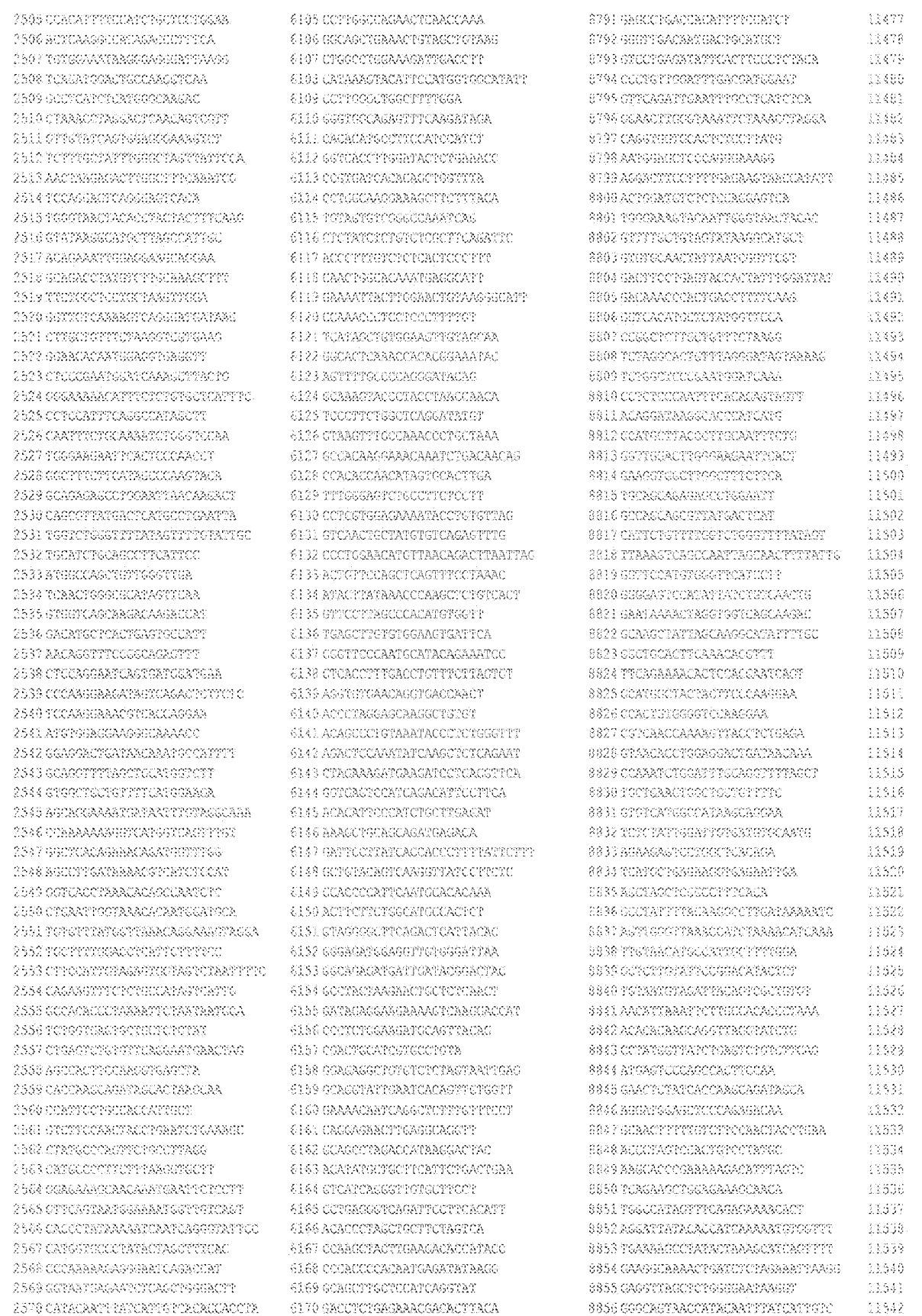
Figure 35E1:
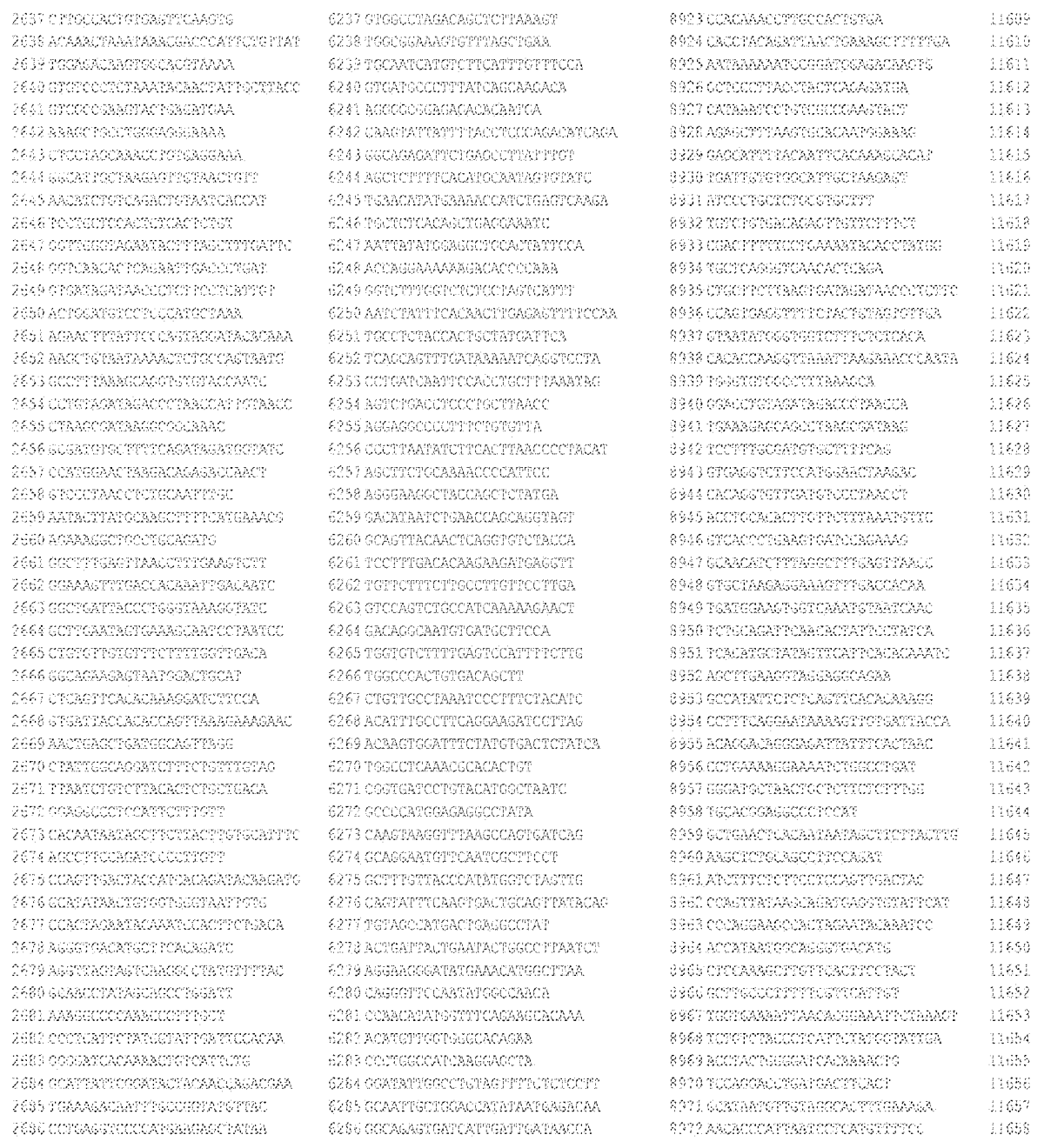

FIG. 35A1-E1: Sequences of an exemplary 2,686-plex primer library (SEQ ID NOs. 3,601-11,658). The three primers (one from pool A, one from pool B, and one from pool C) in each row all hybridize to the same target locus.

Figure 36A1:
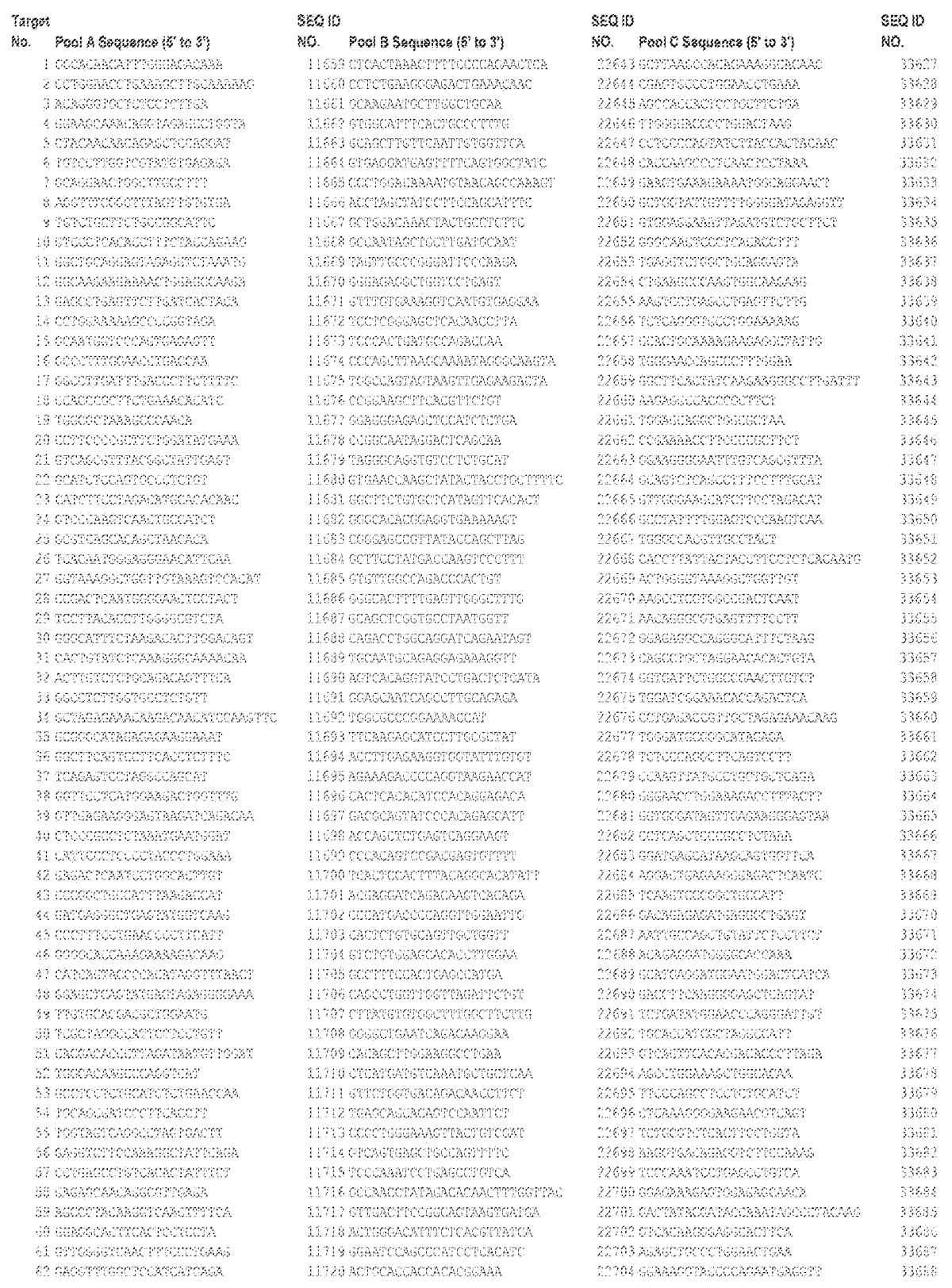
Figure 36A2:
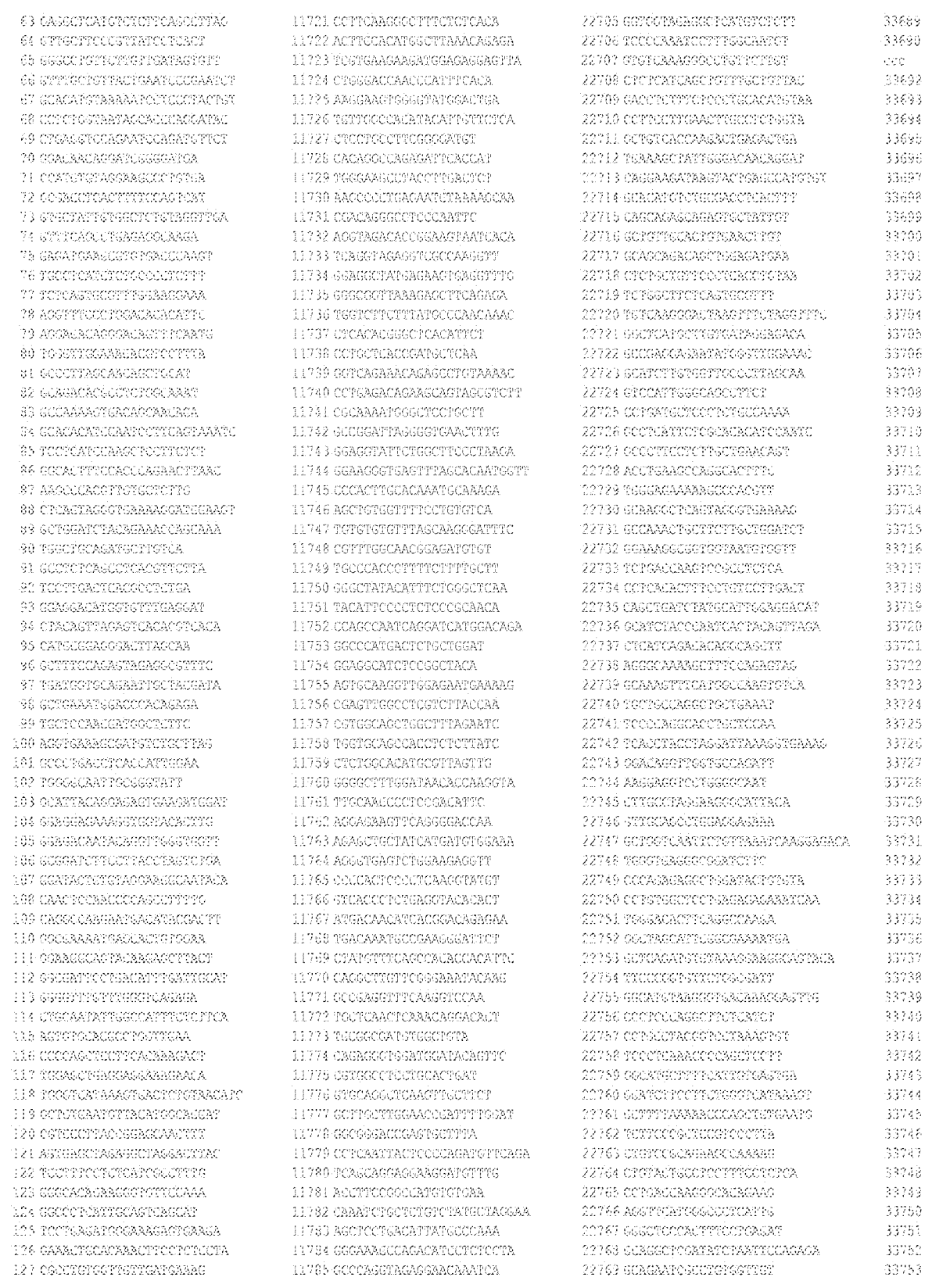
Figure 36A3:
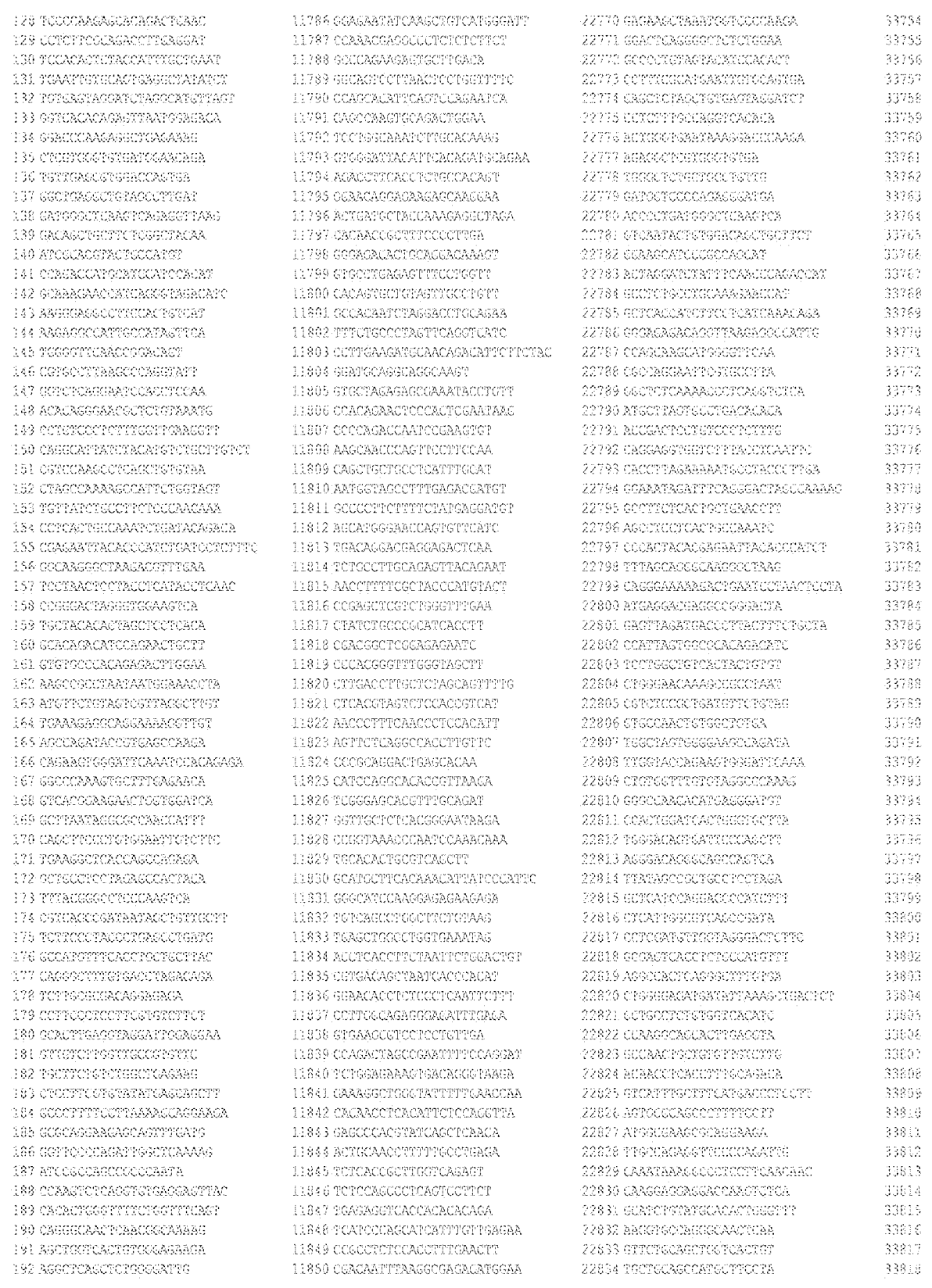
Figure 36A4:
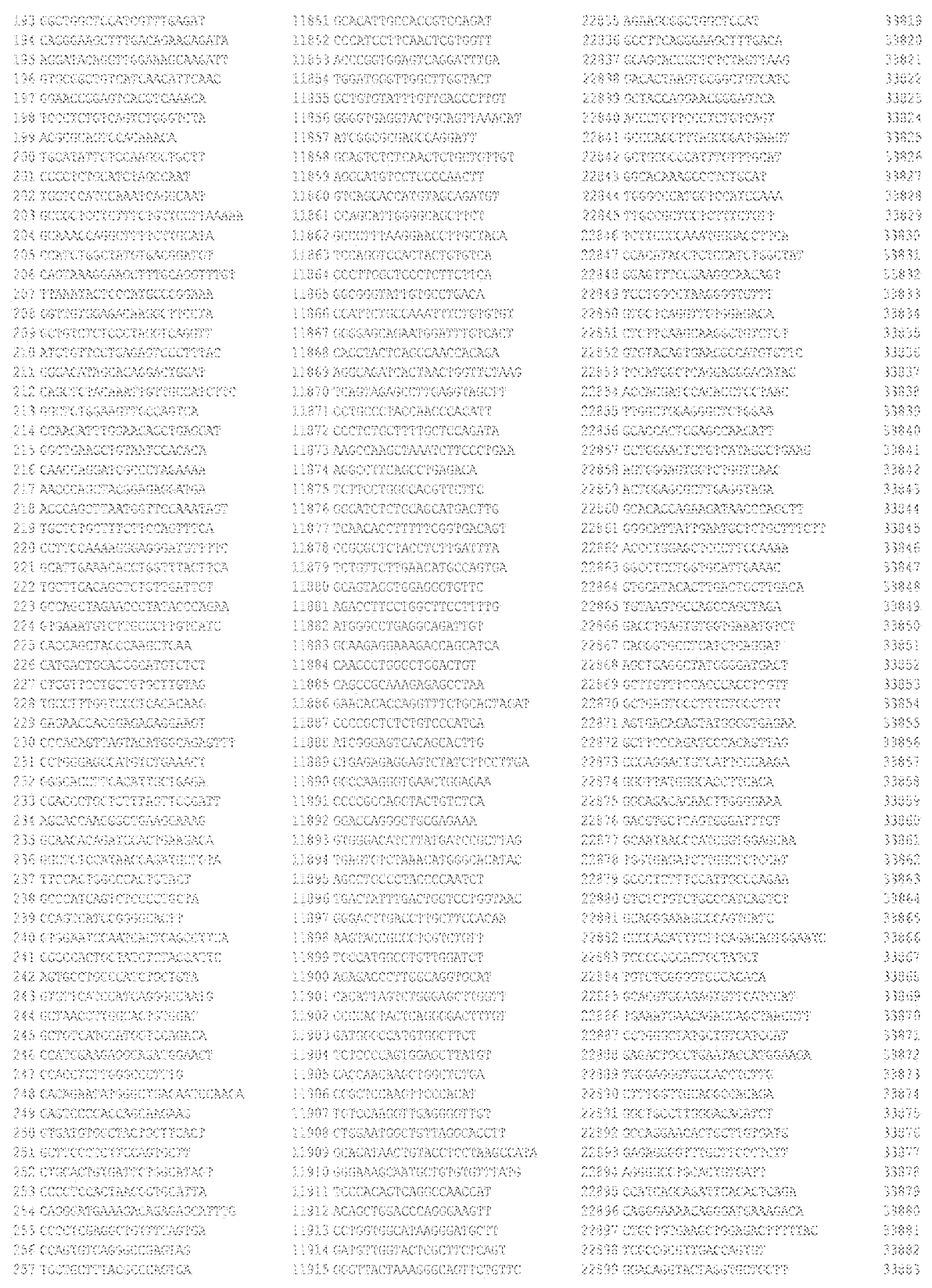
Figure 36A5:
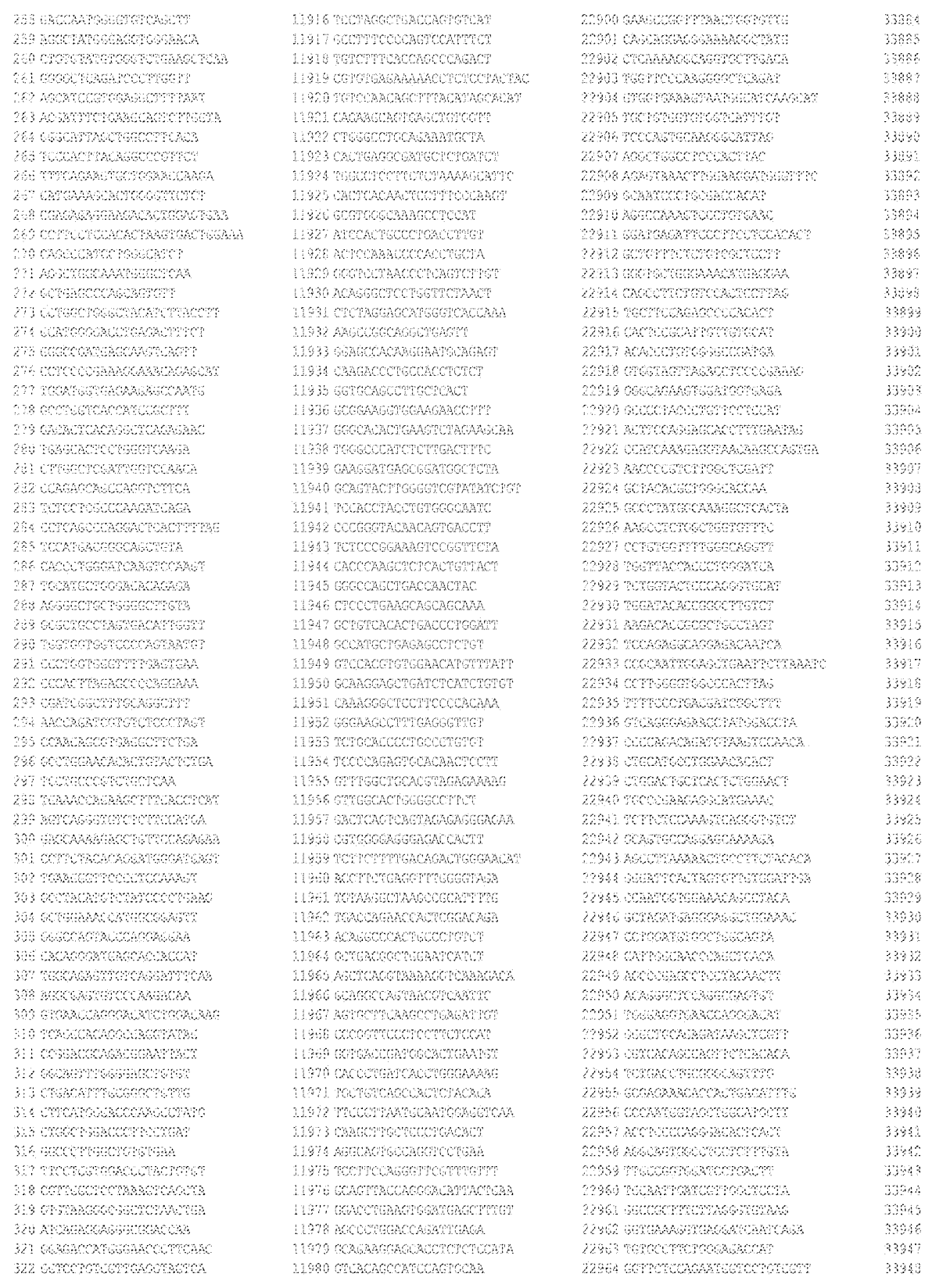
Figure 36A6:
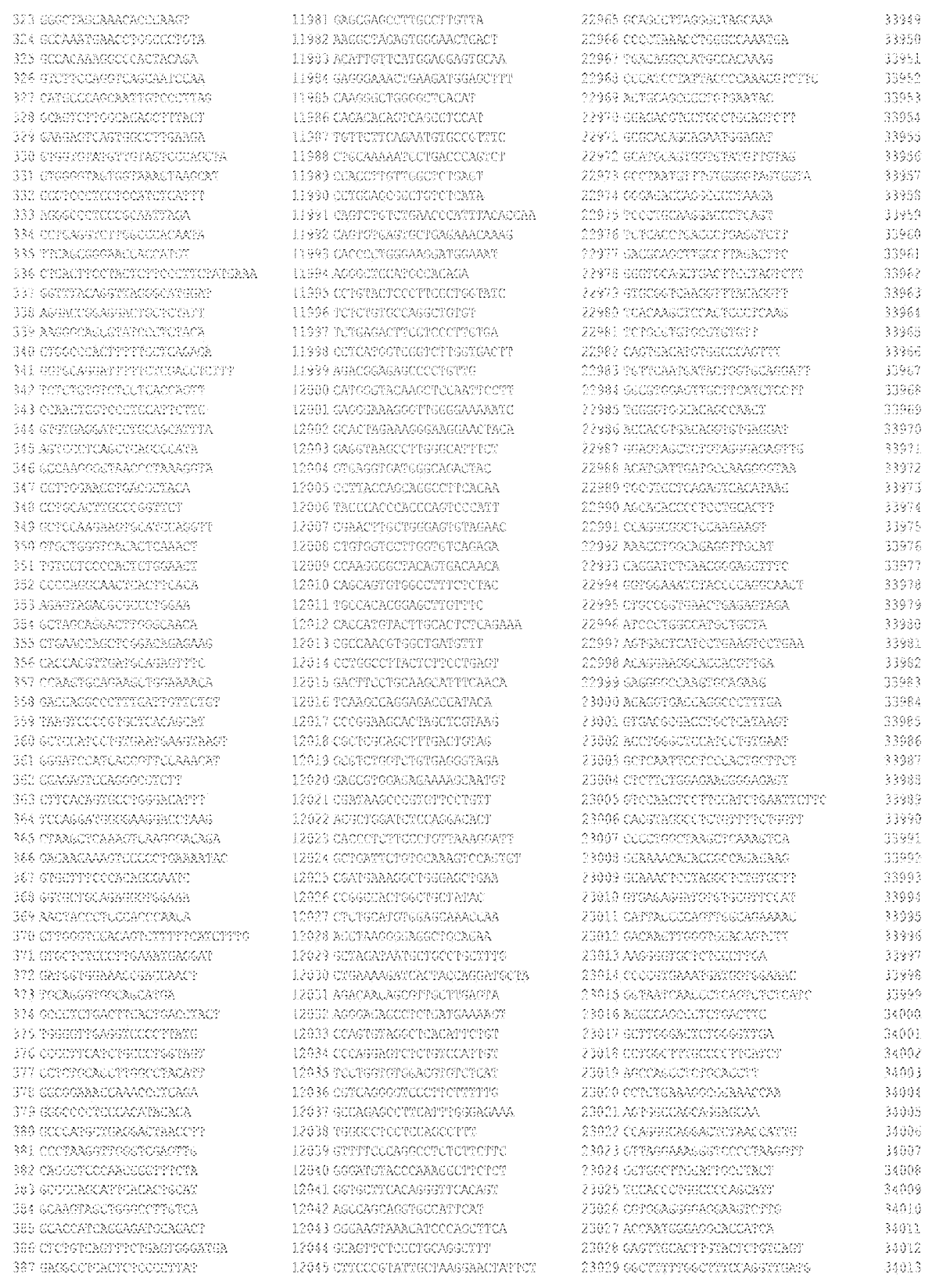
Figure 36A7:
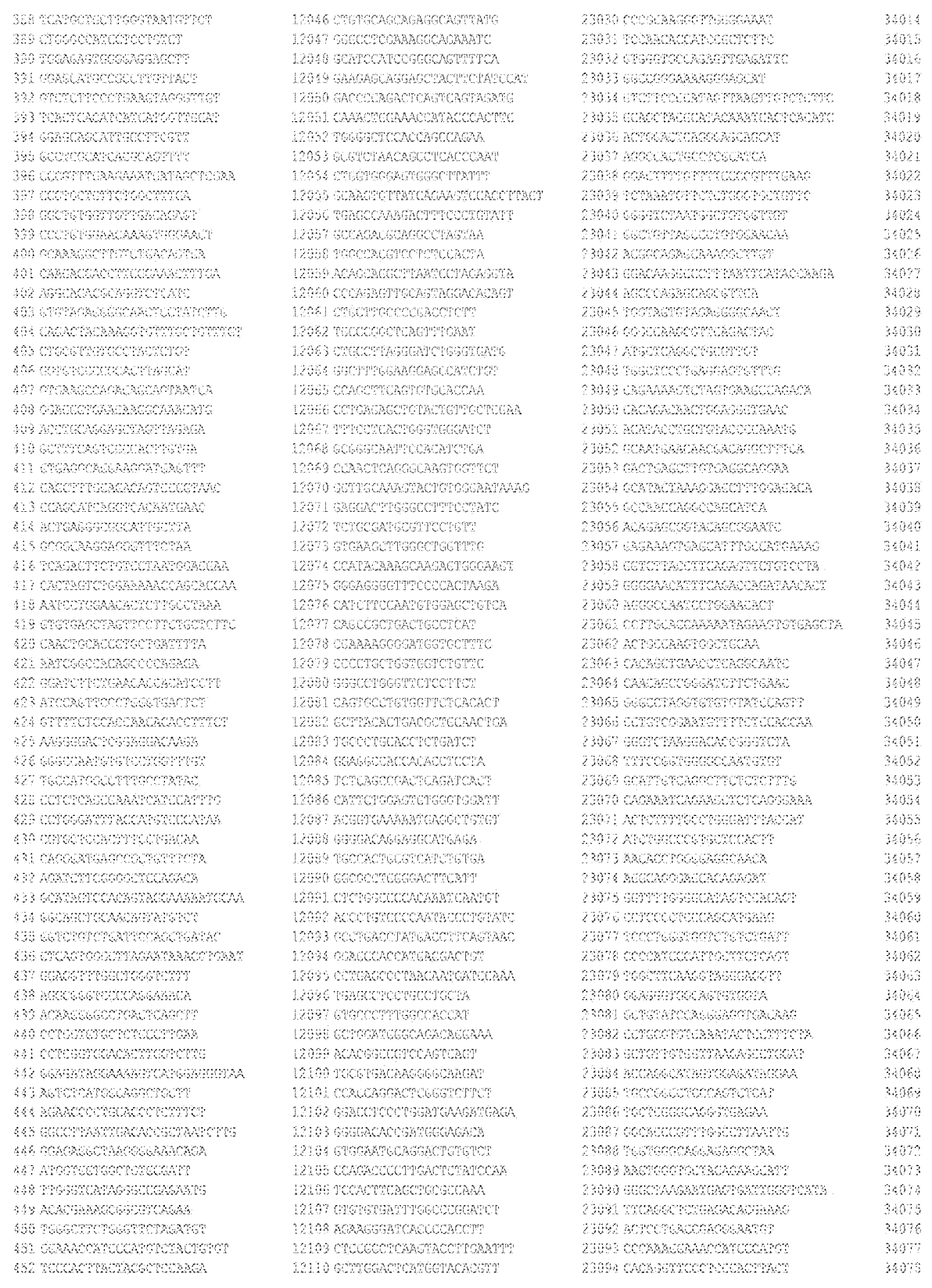
Figure 36A8:
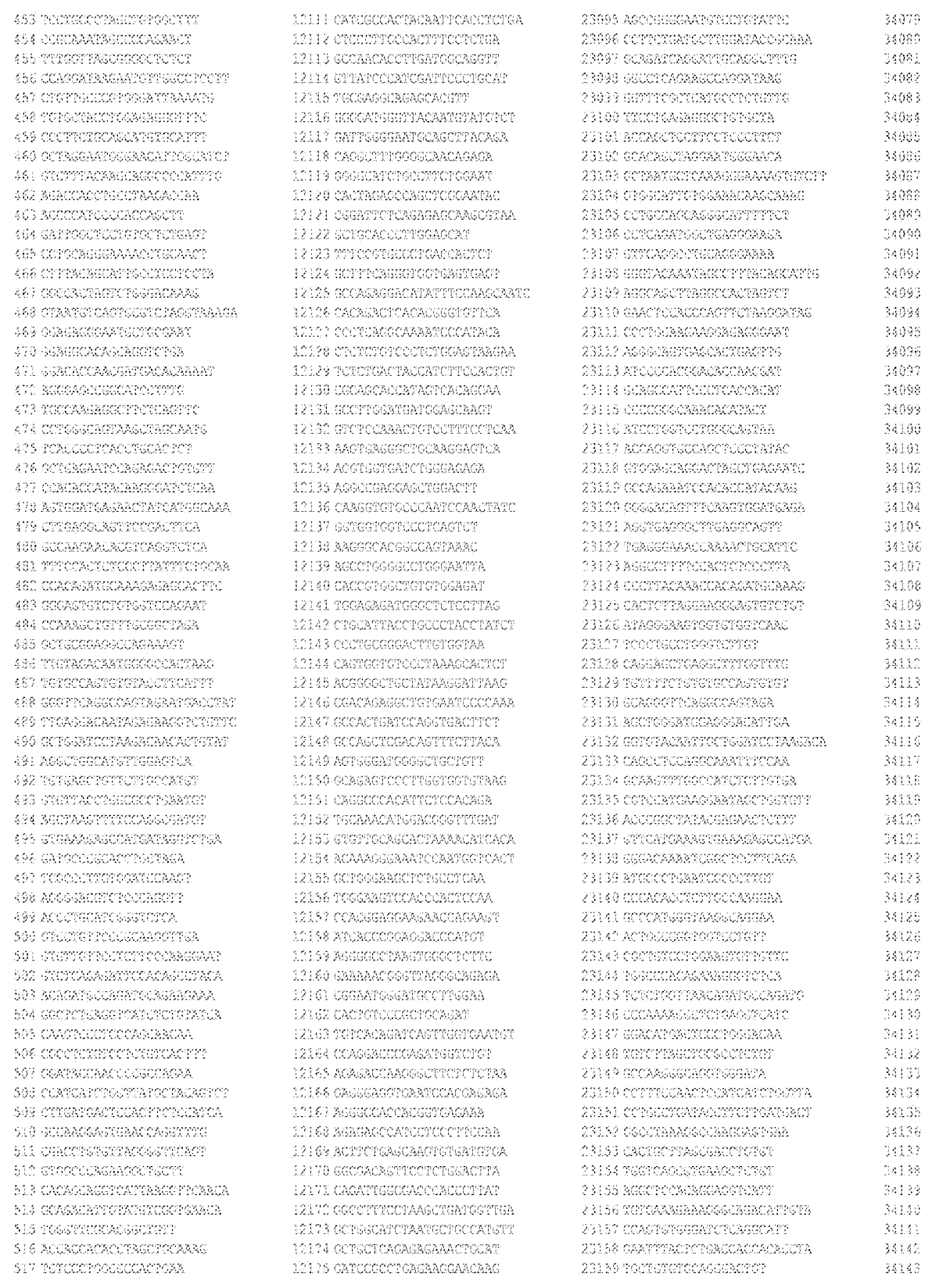
Figure 36A9:
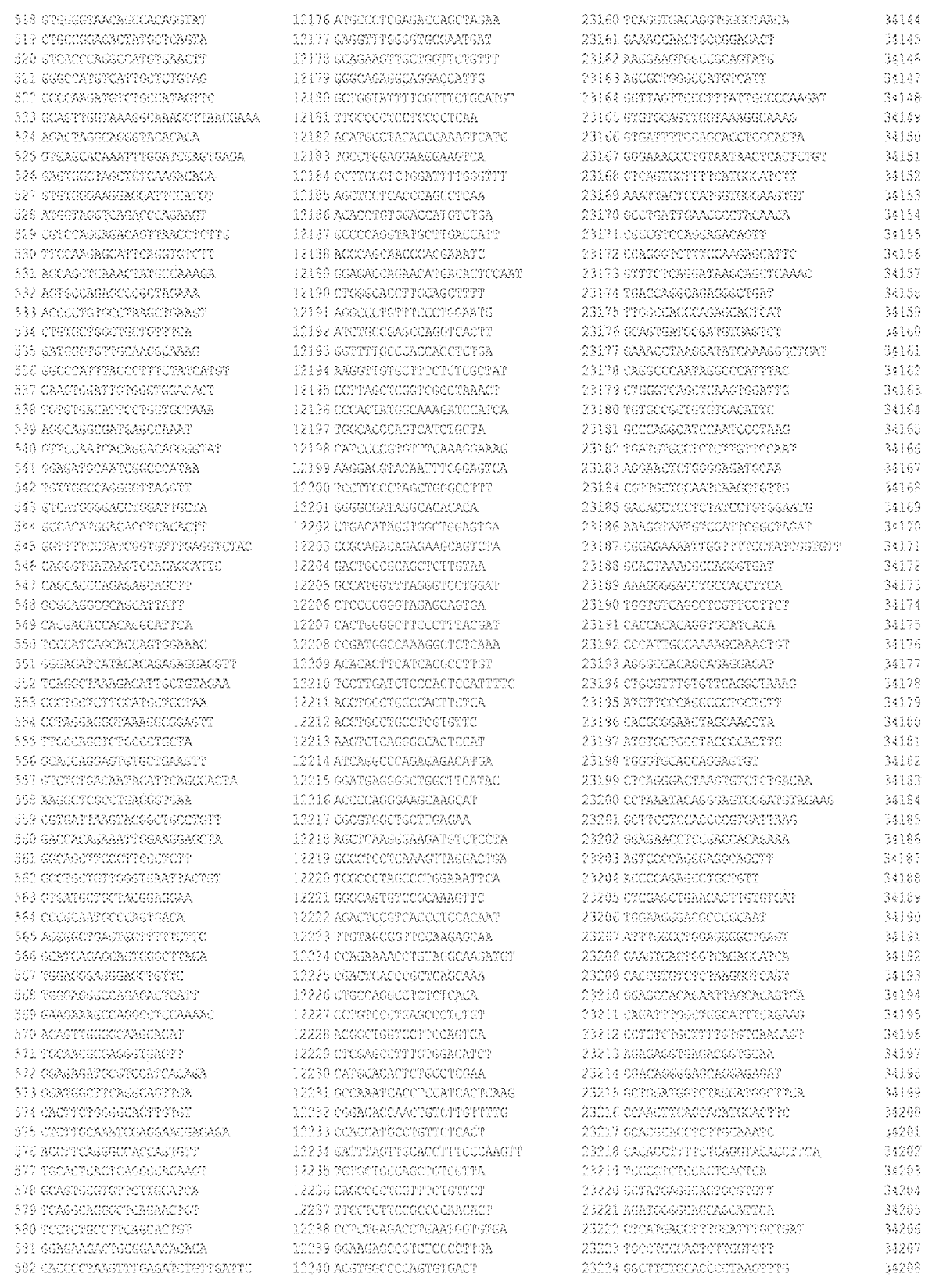
Figure 36A10:
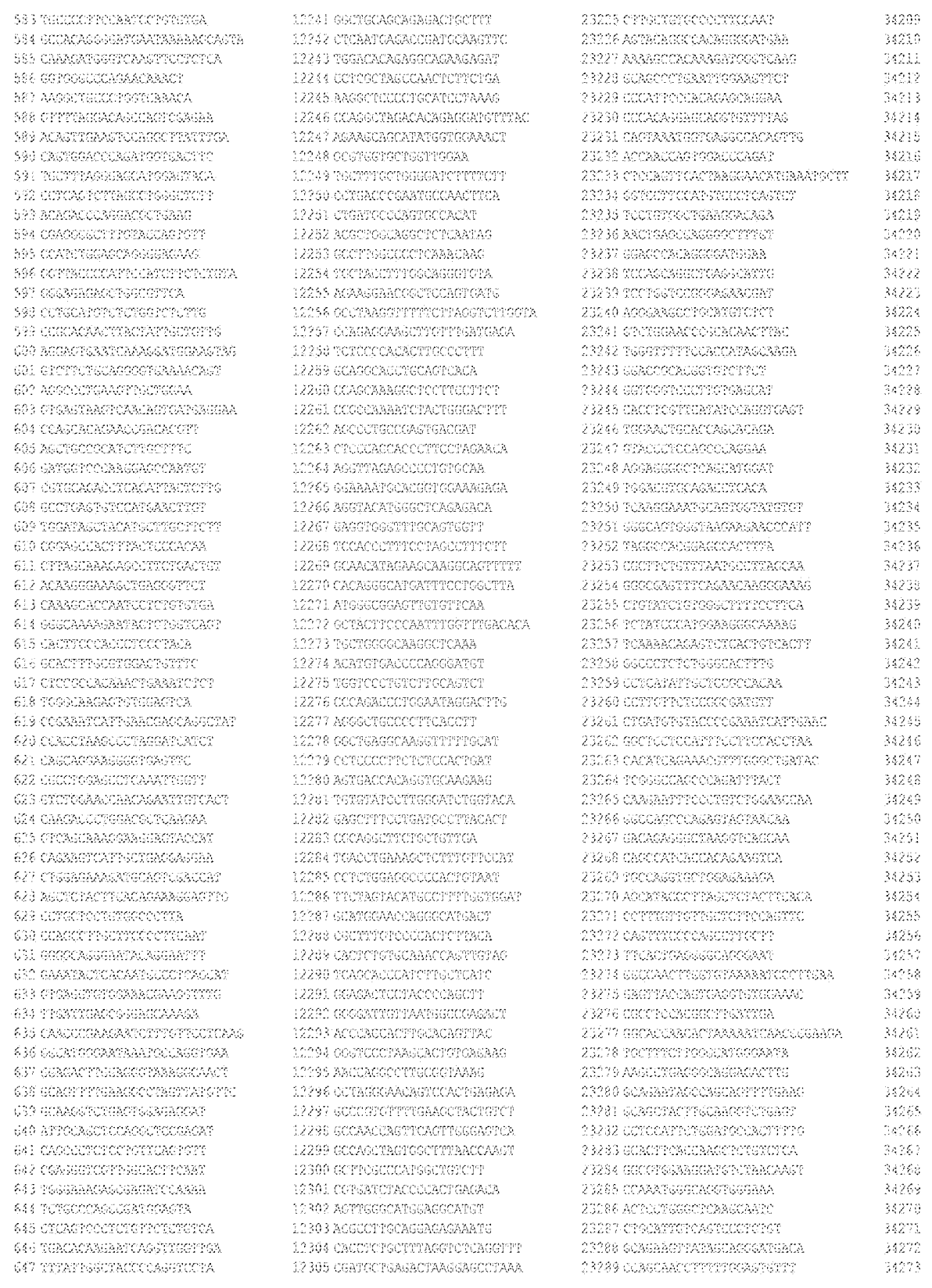
Figure 36B1:
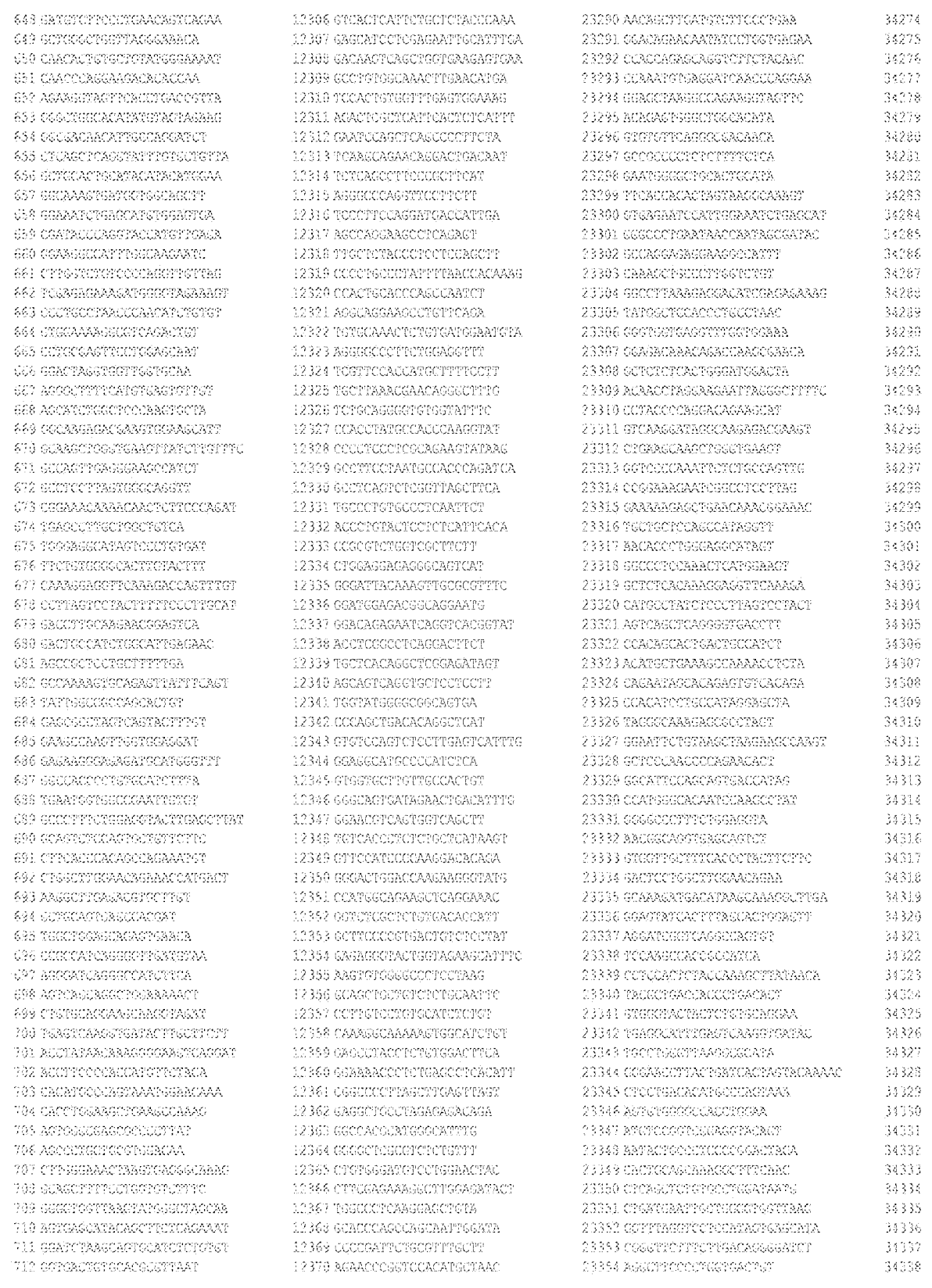
Figure 36B2:
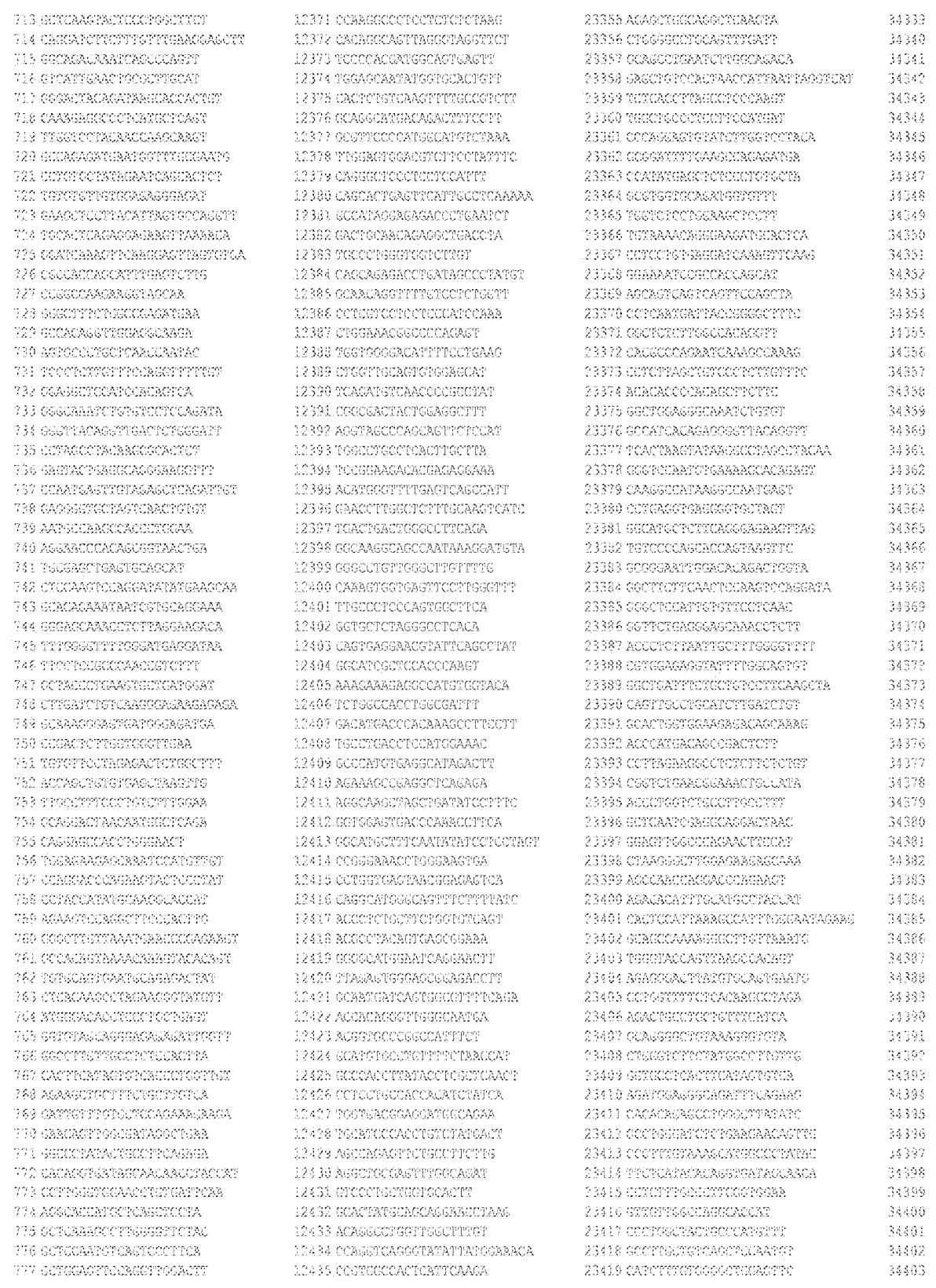
Figure 36B3:
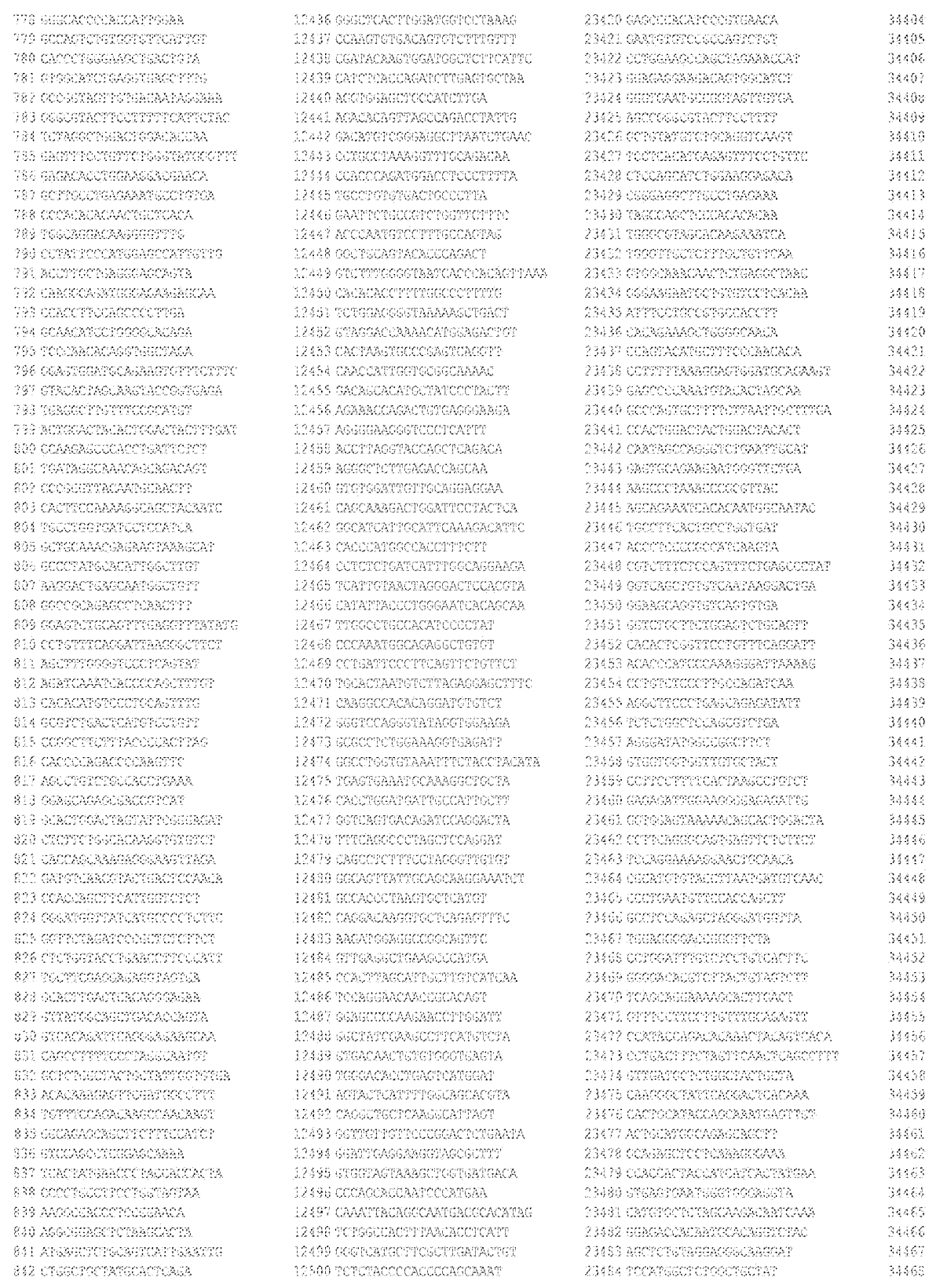
Figure 36B4:
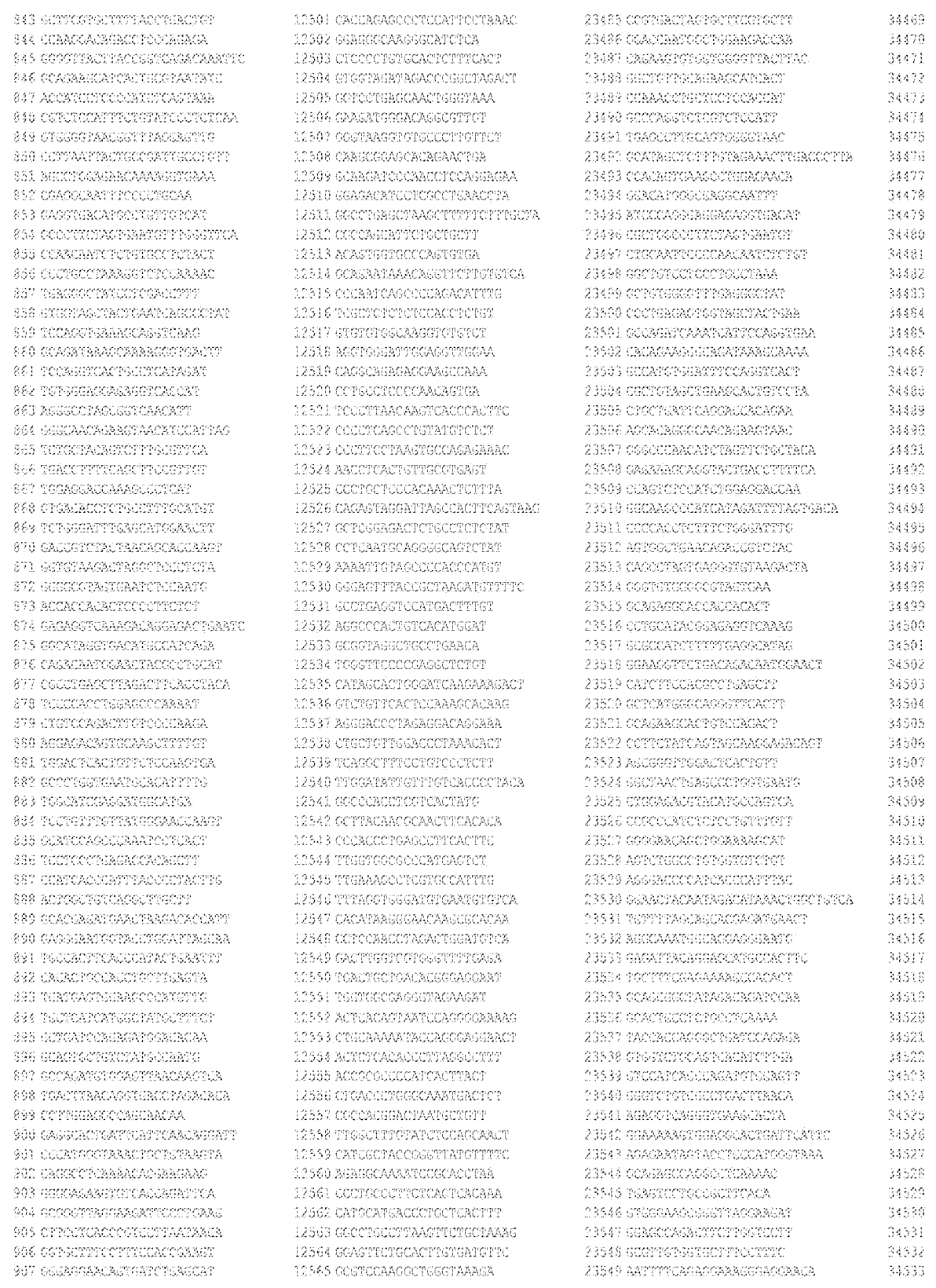
Figure 36B5:
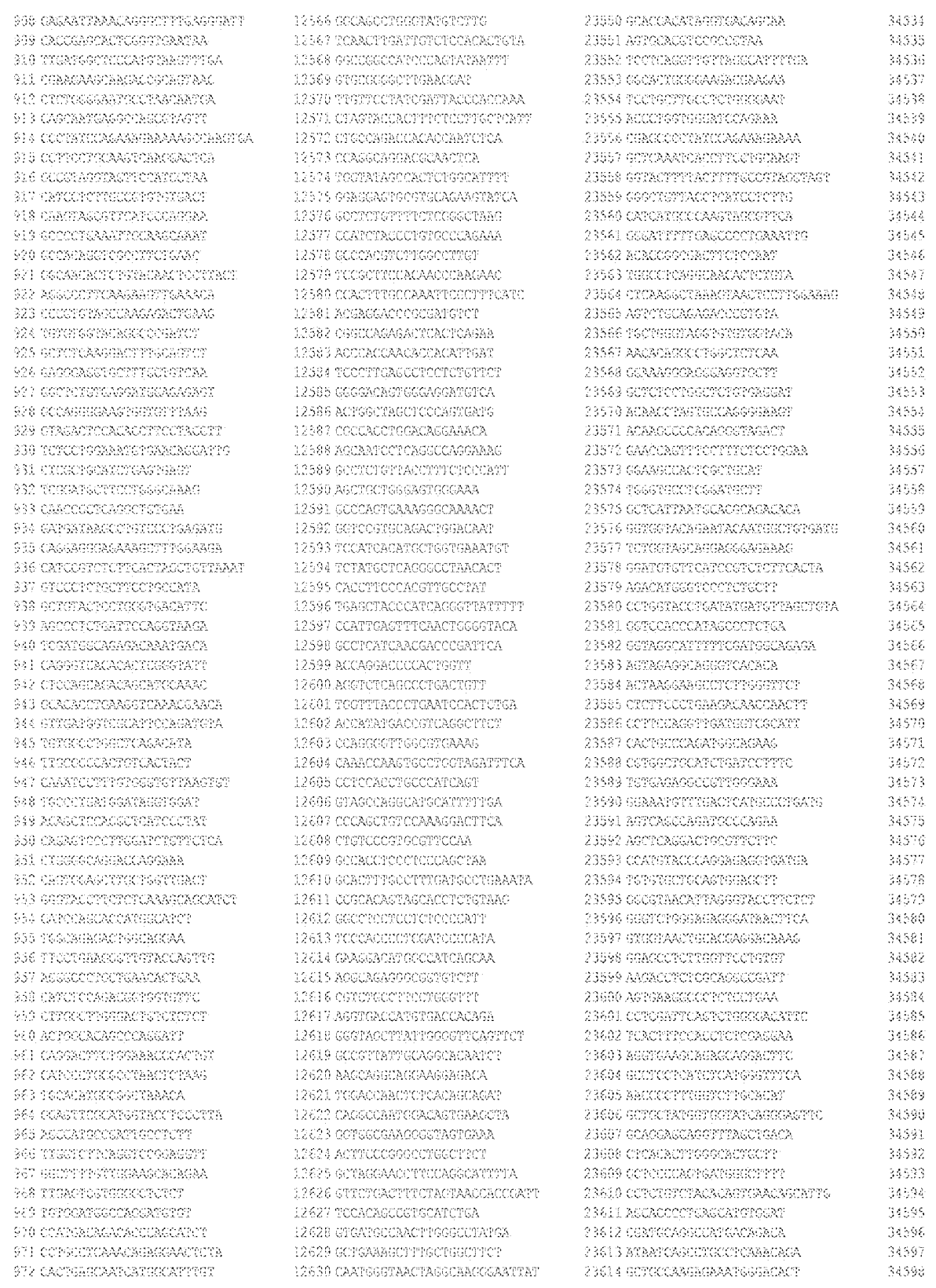
Figure 36B6:
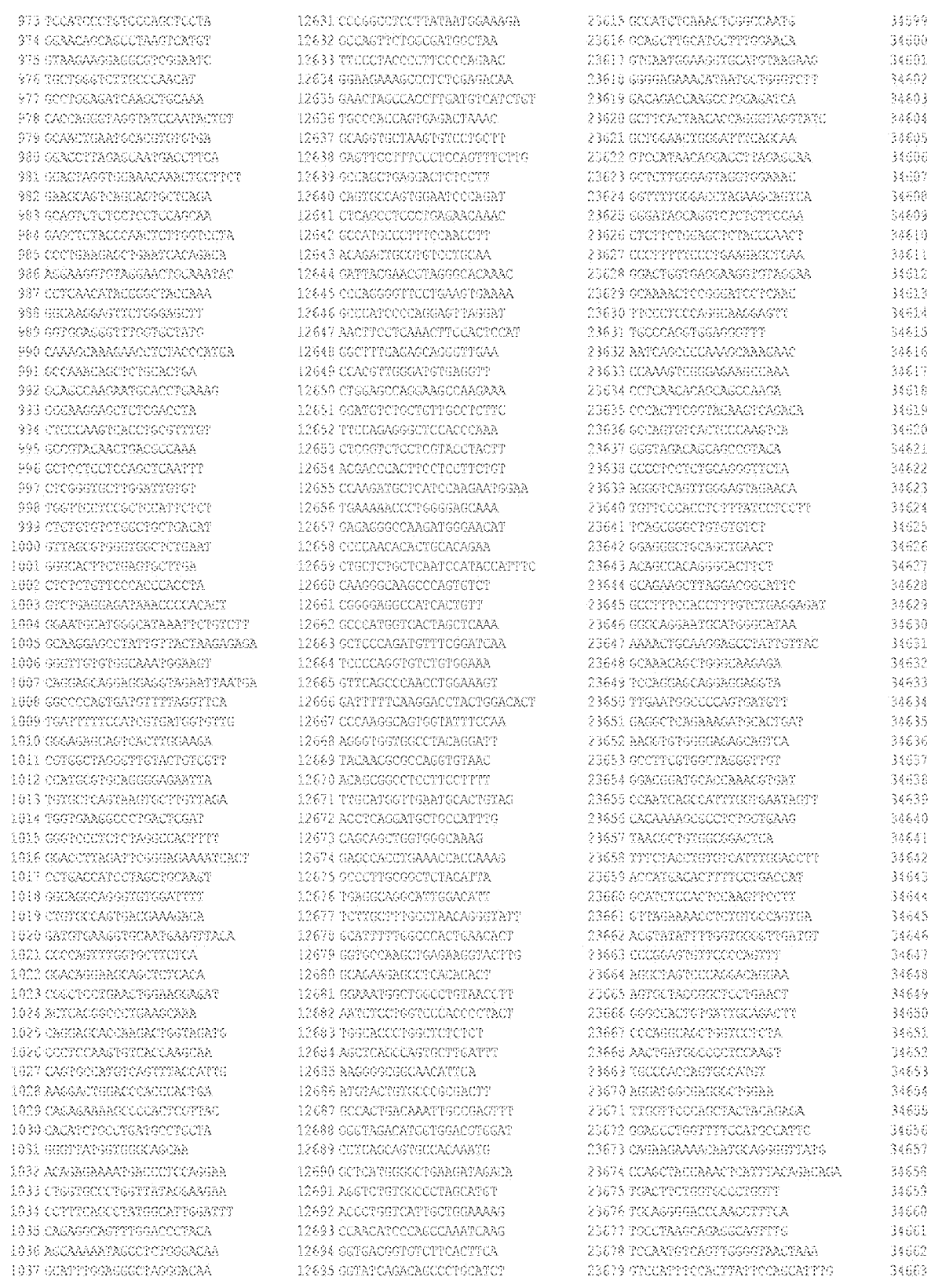
Figure 36B7:
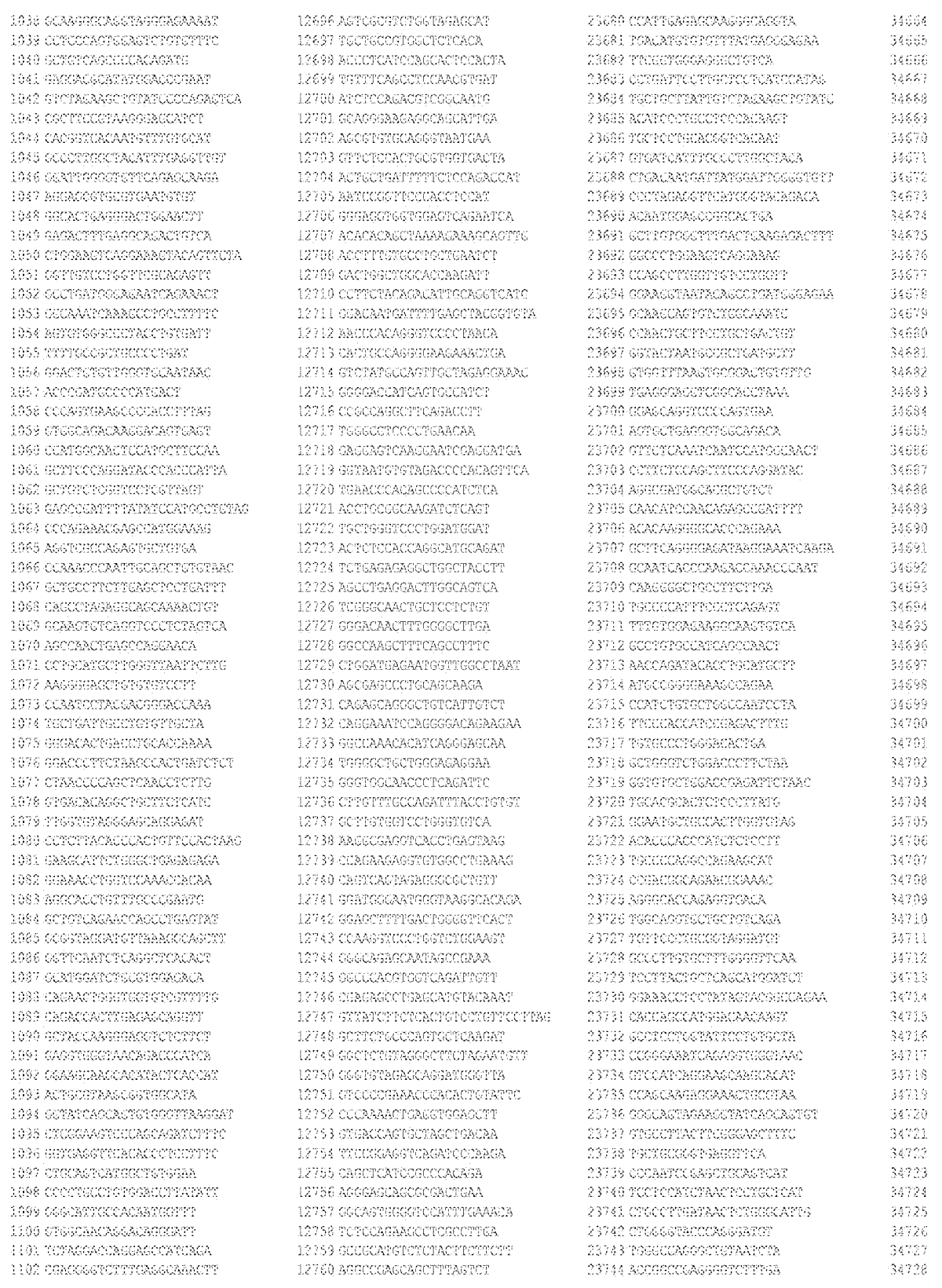
Figure 36B8:
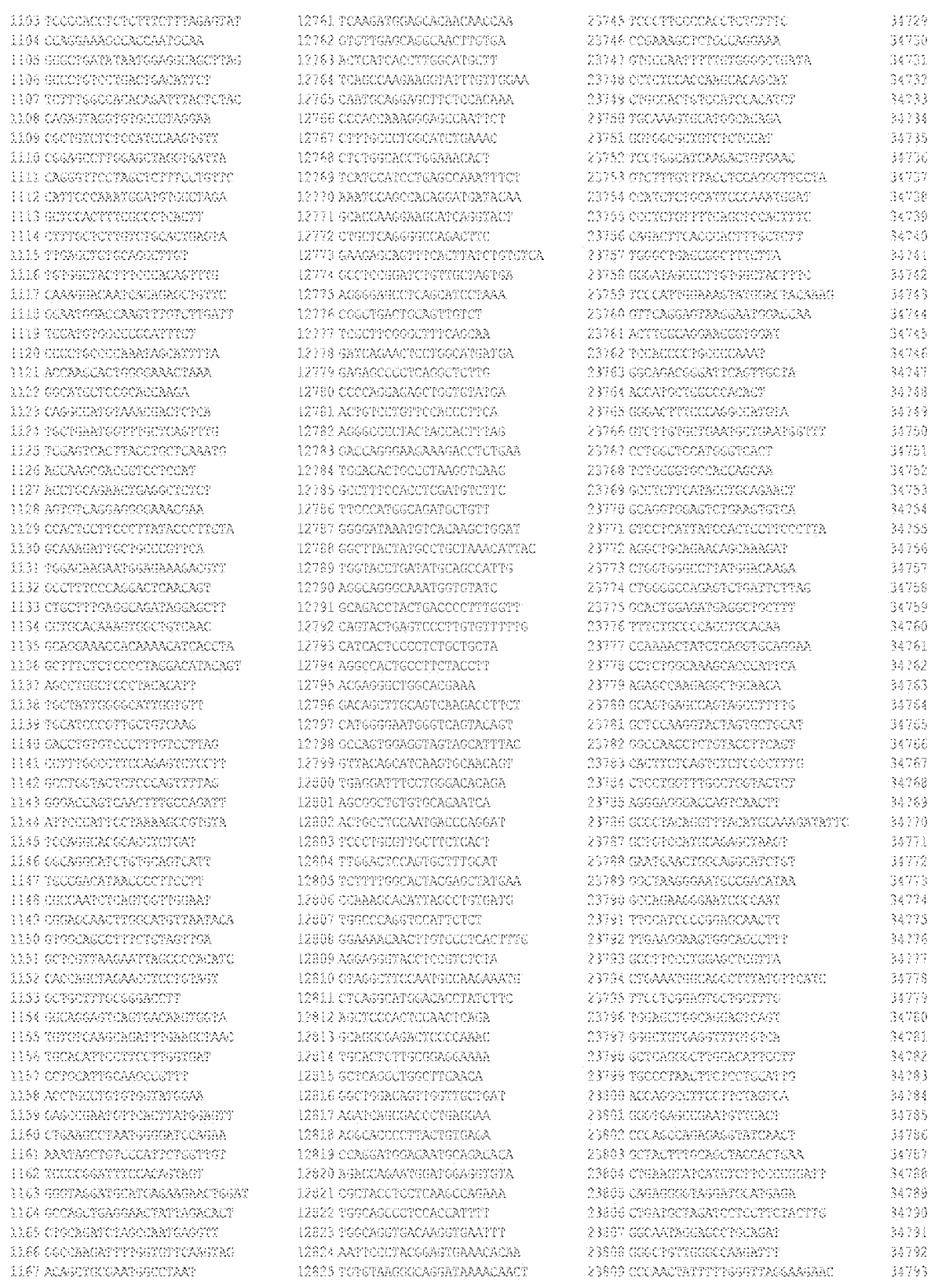
Figure 36B9:
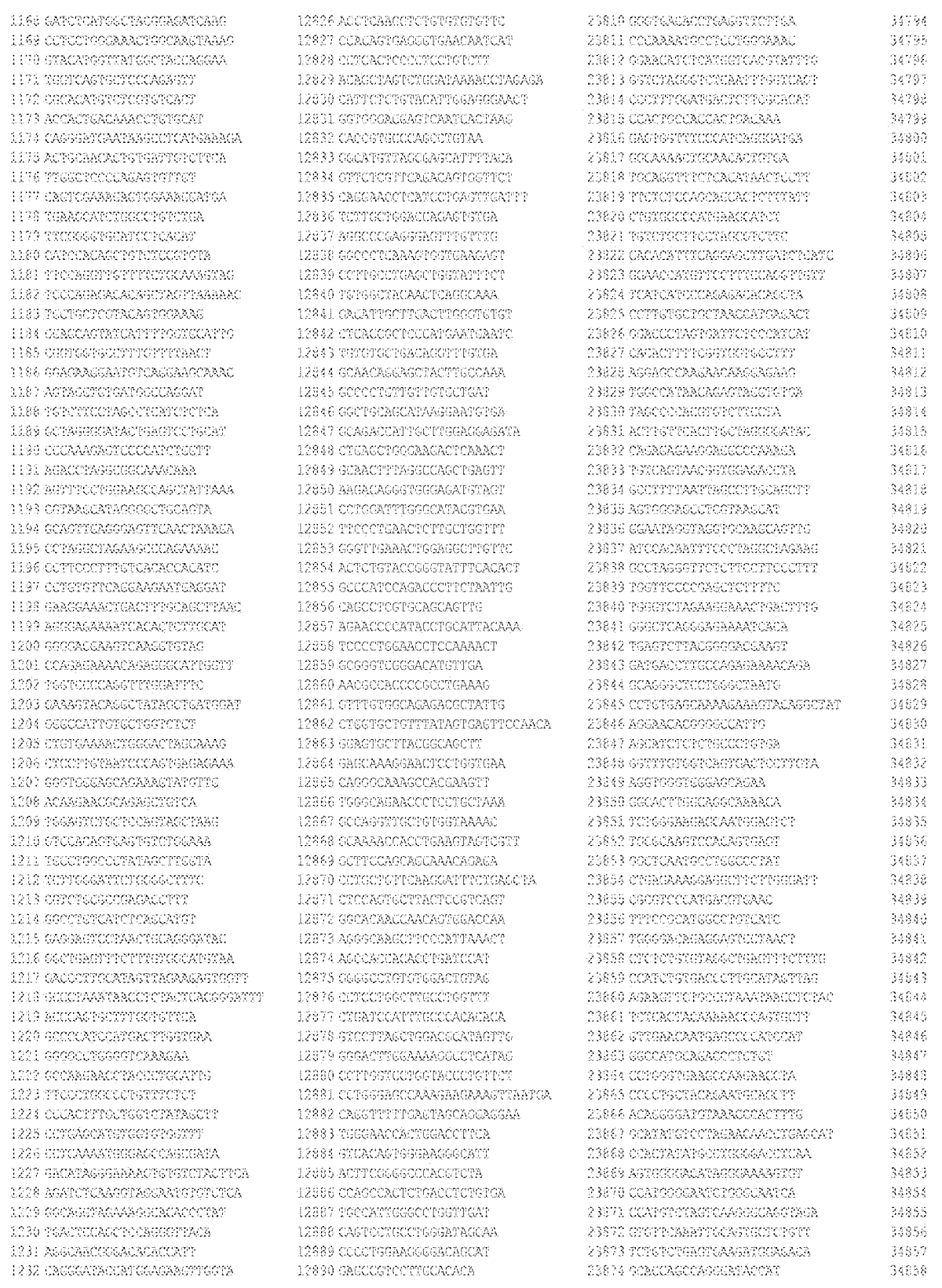
Figure 36B10:
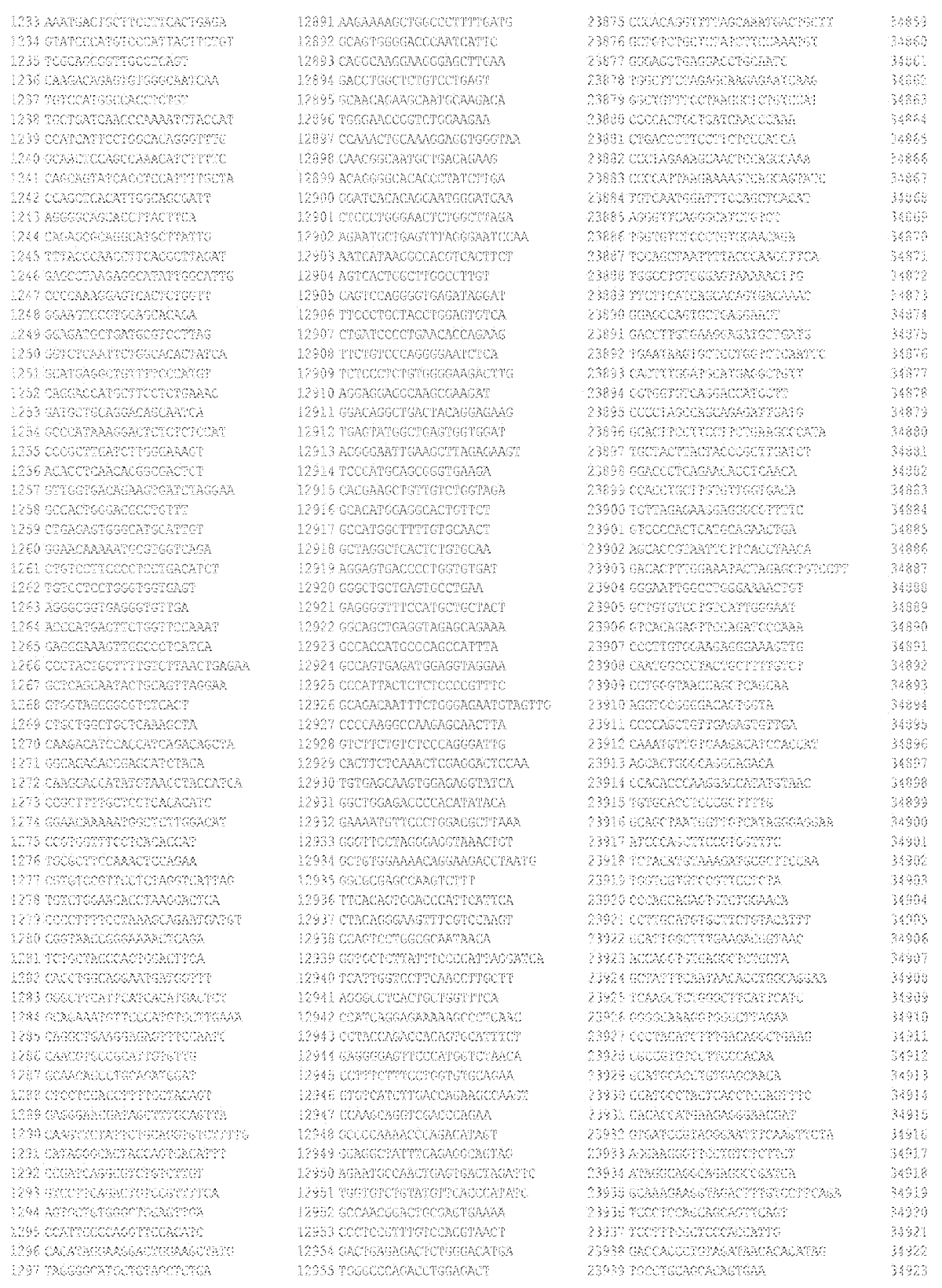
Figure 36C1:
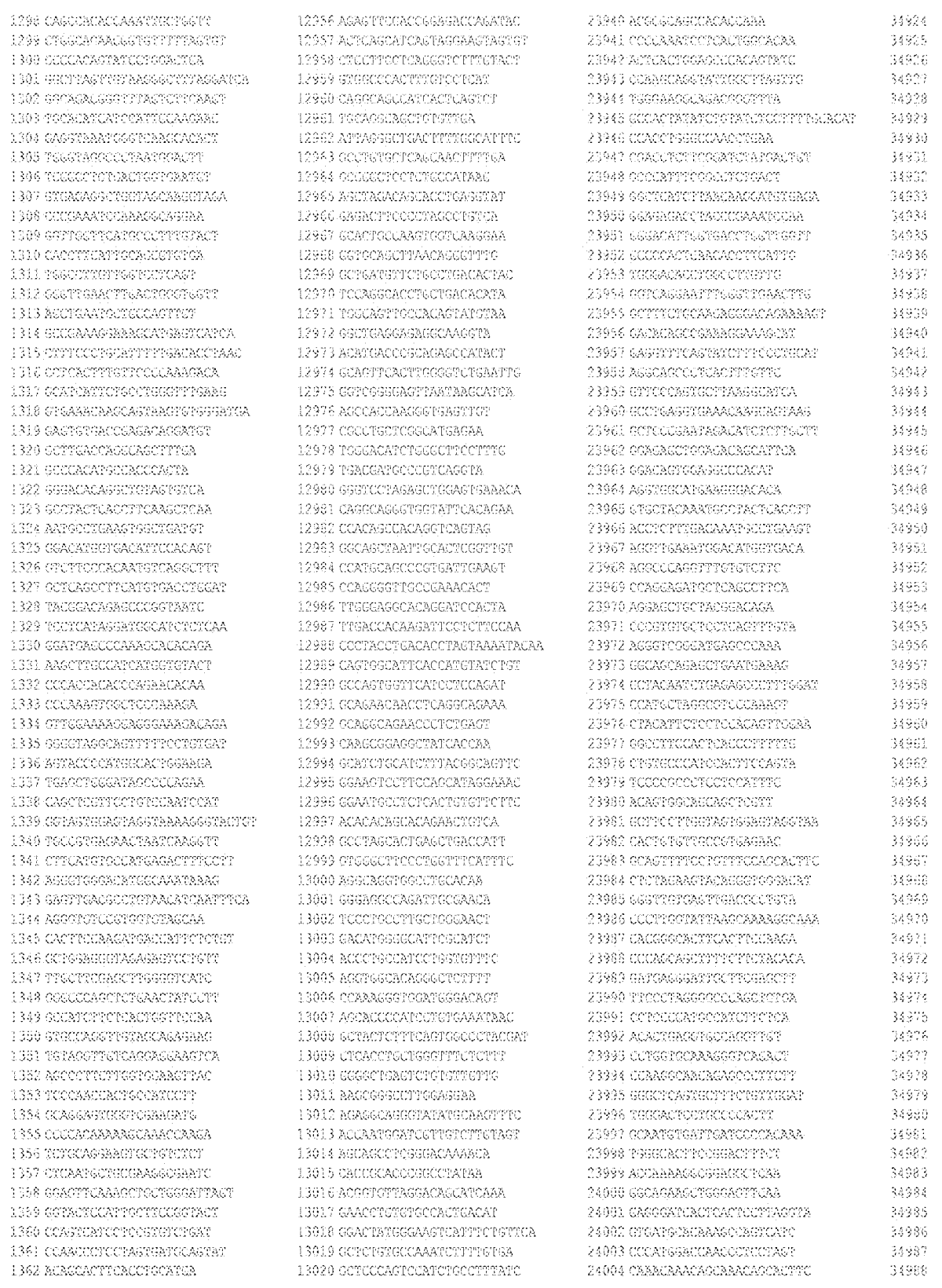
Figure 36C2:
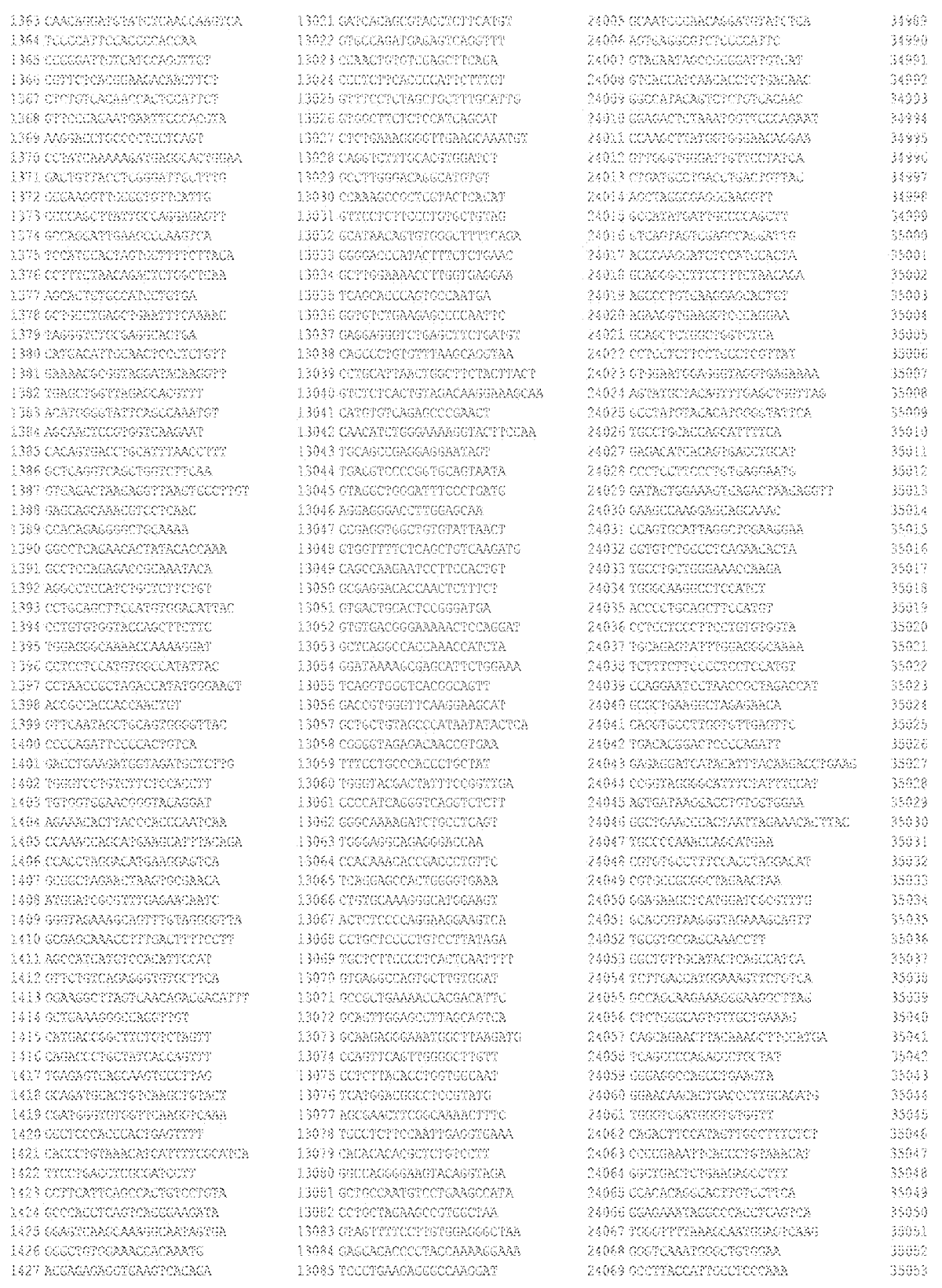
Figure 36C3:
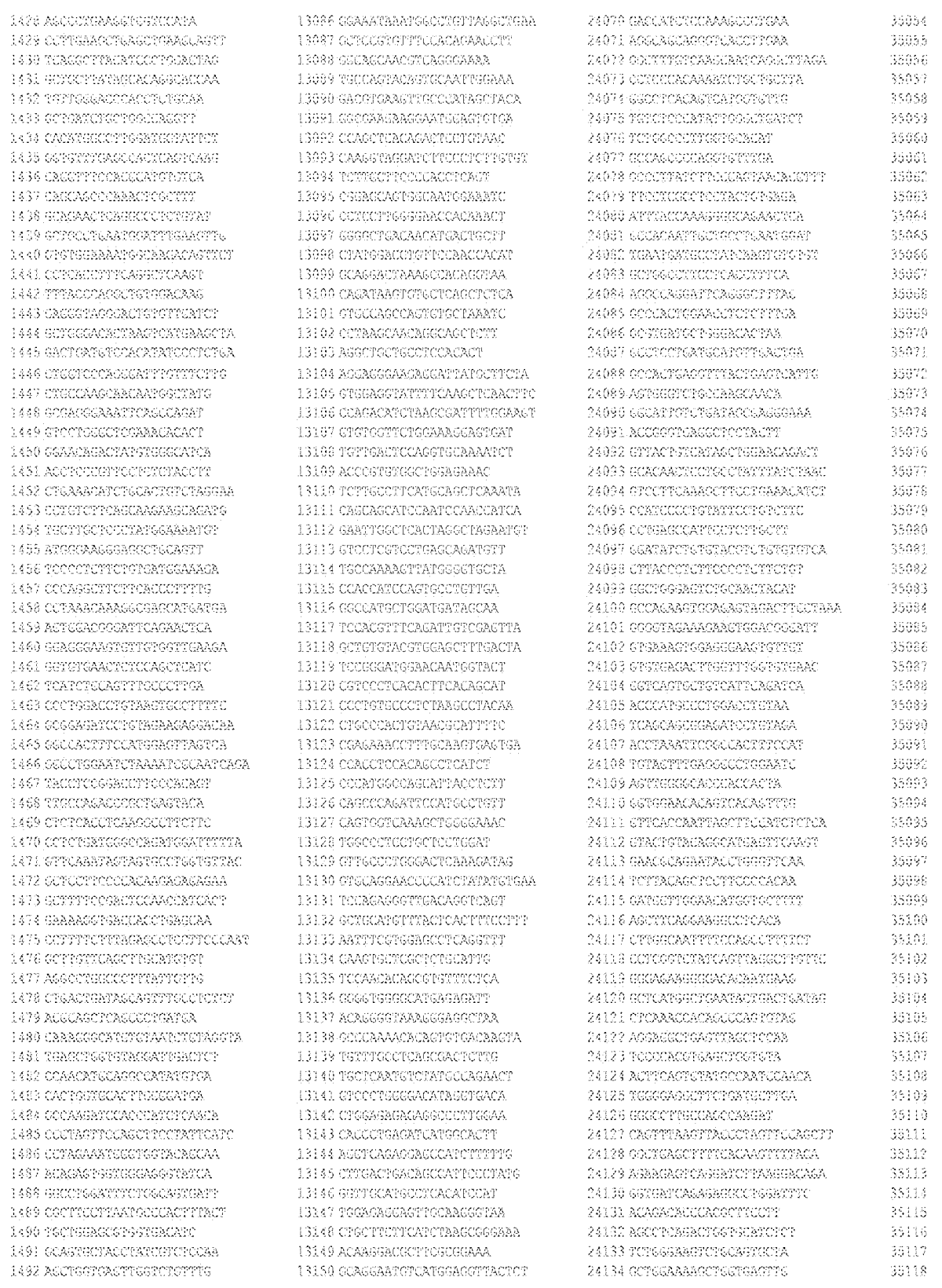
Figure 36C4:
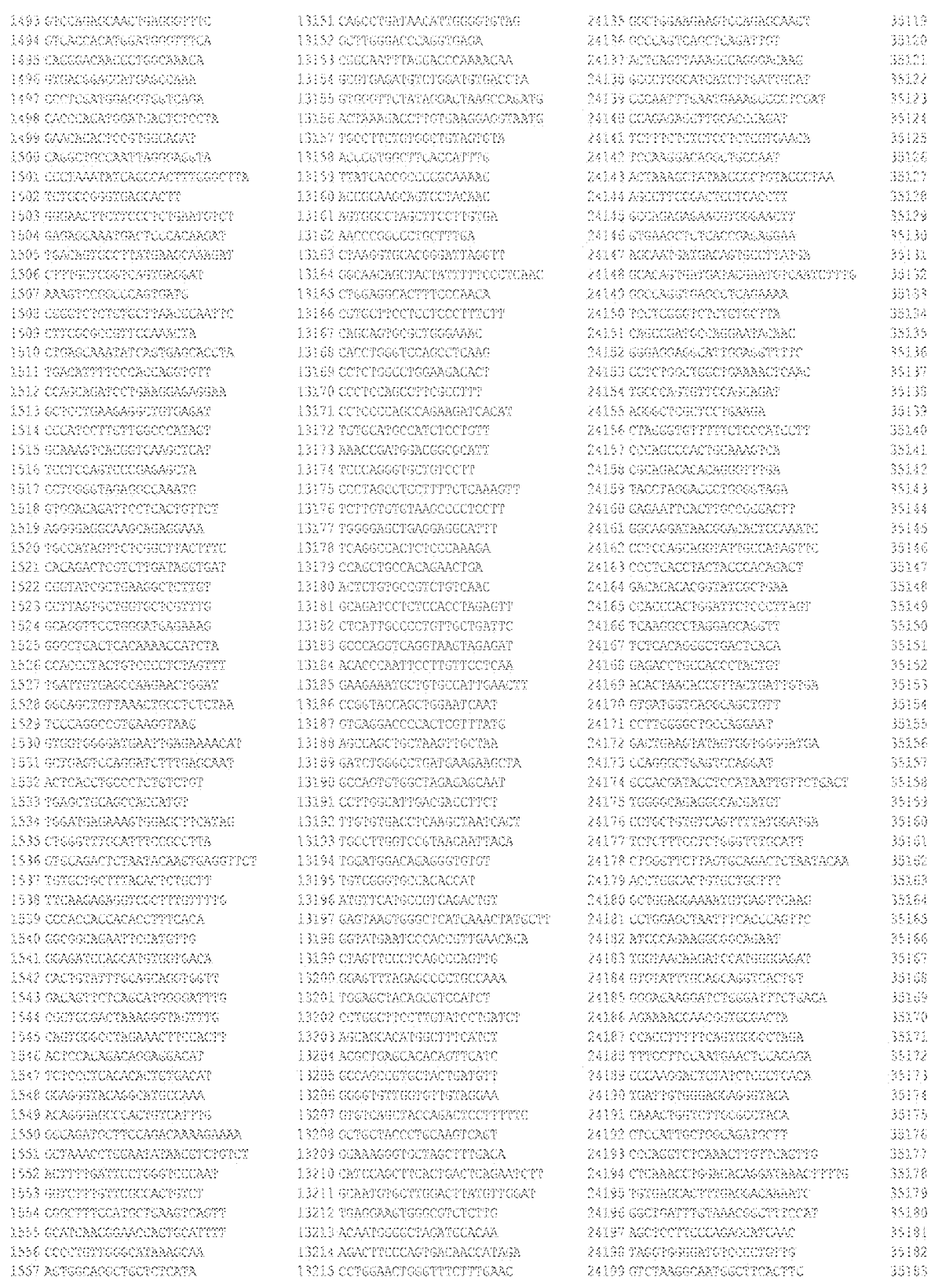
Figure 36C5:
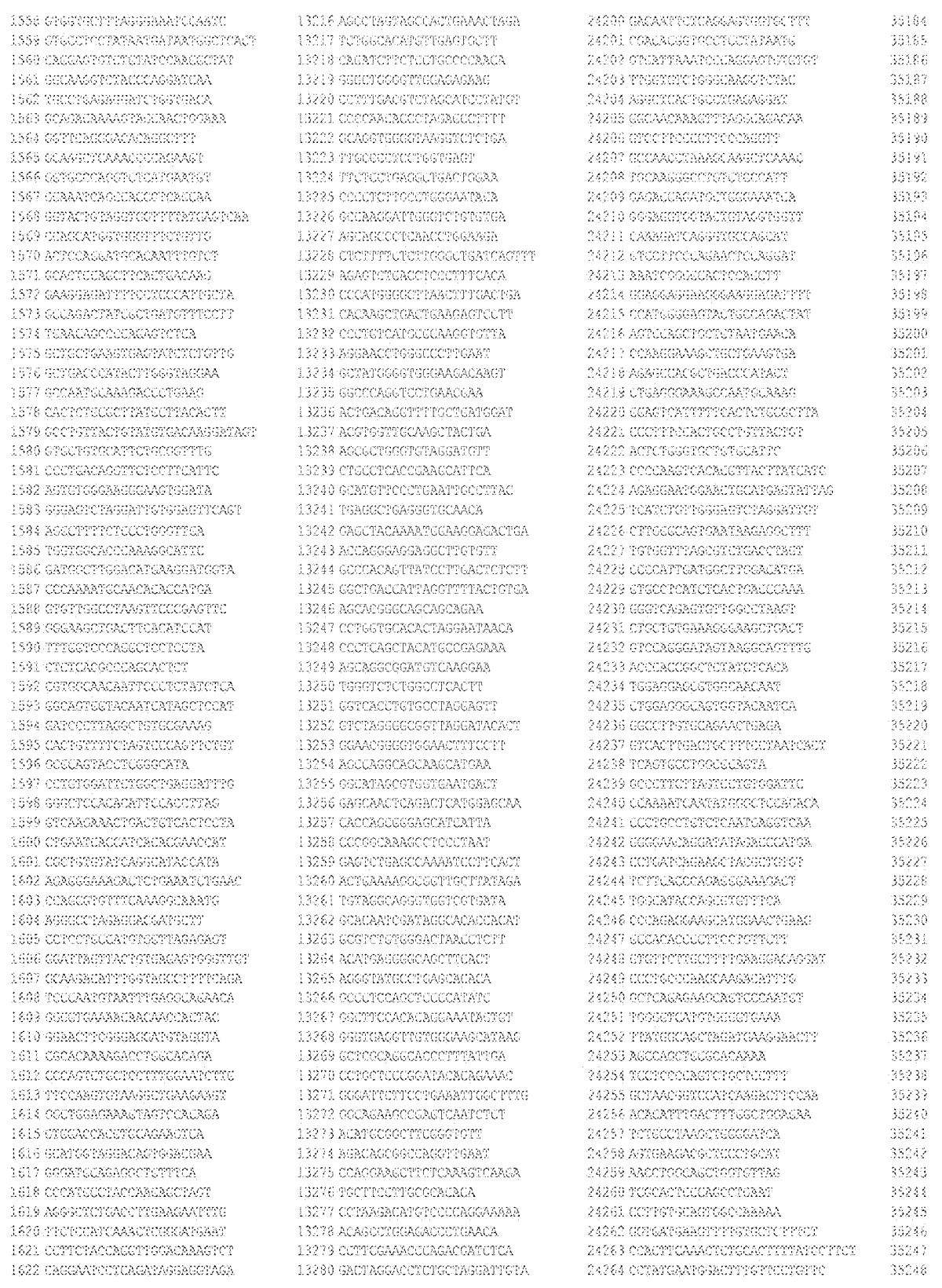
Figure 36C6:
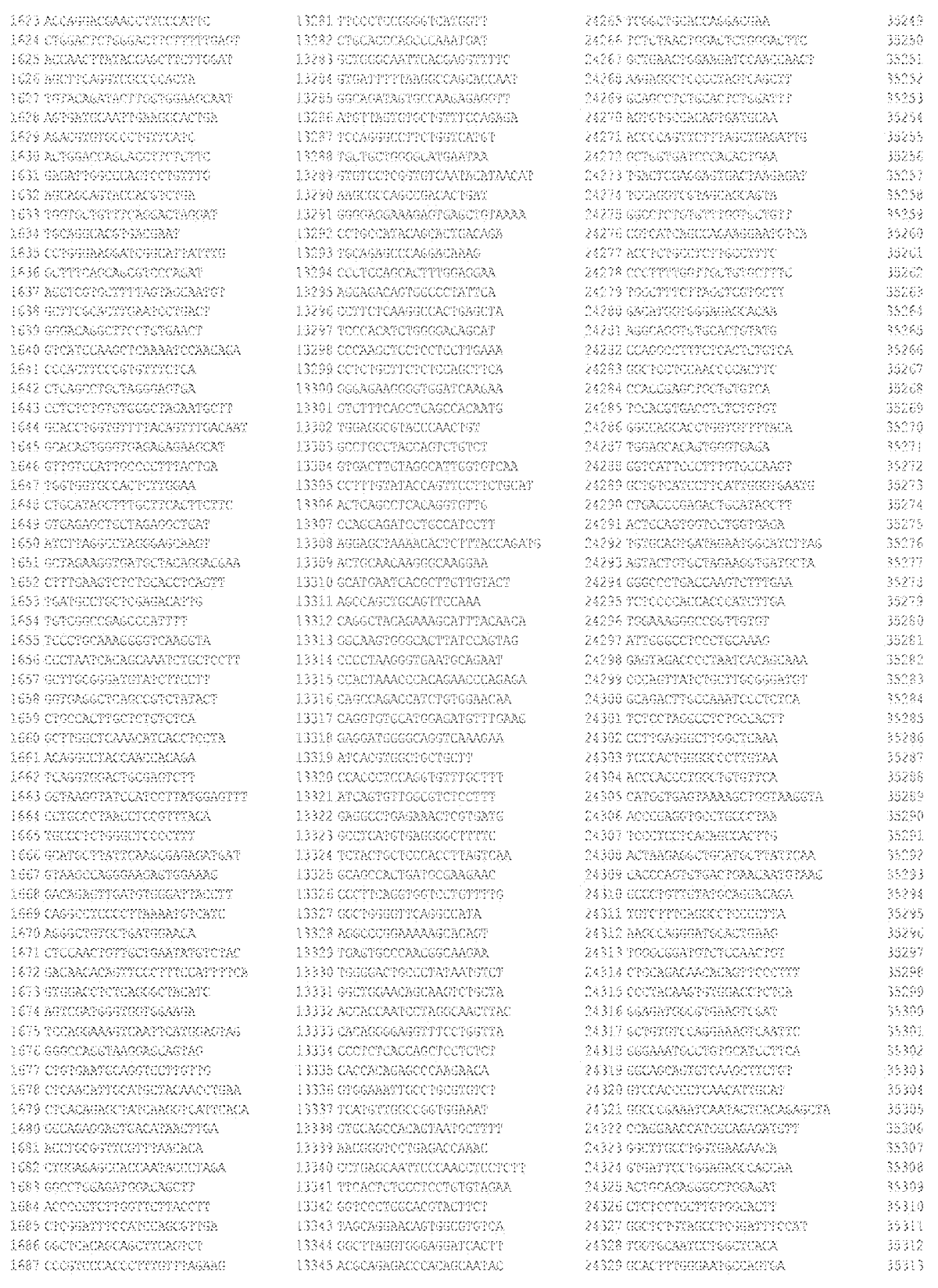
Figure 36C7:
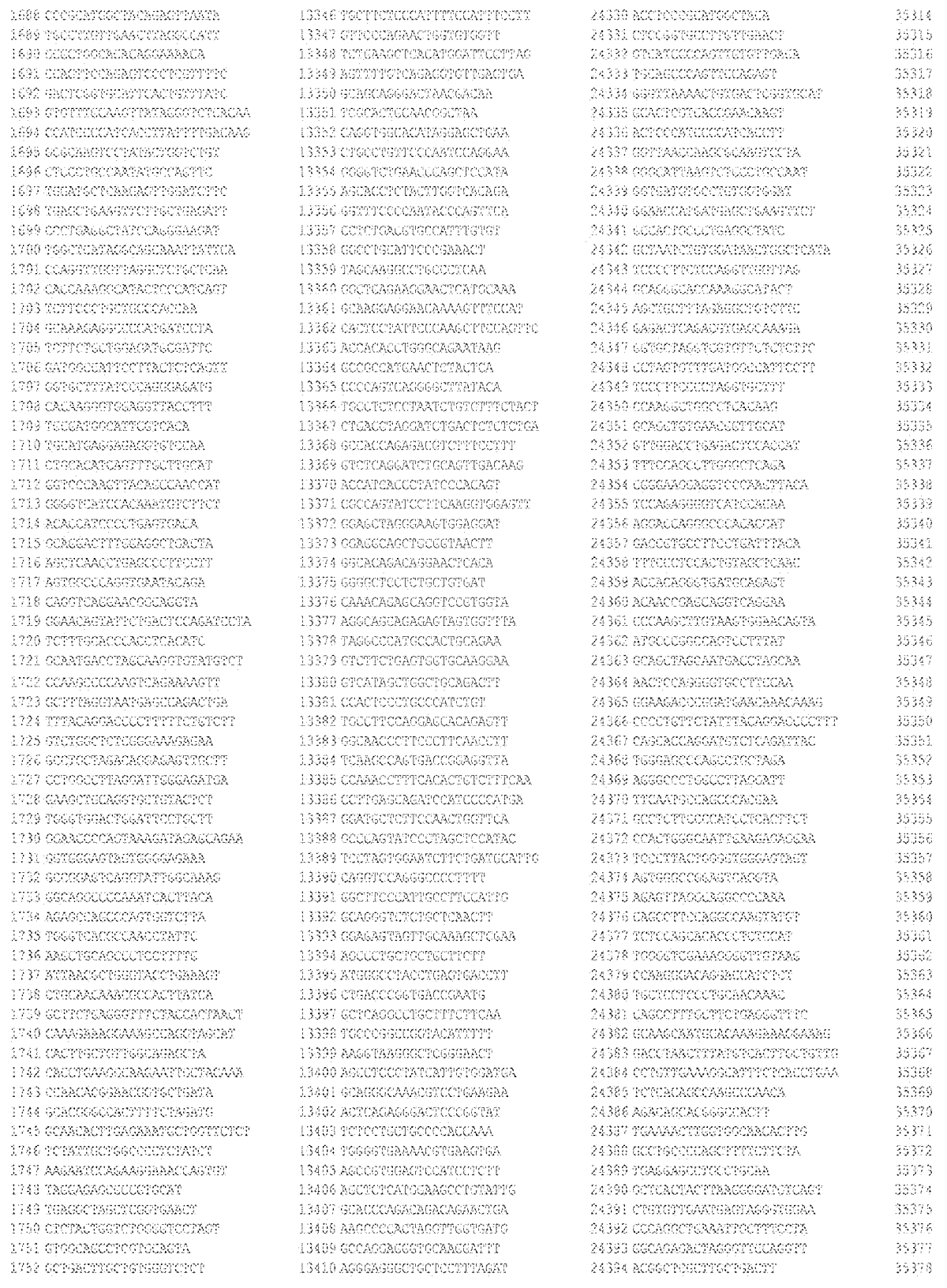
Figure 36C8:
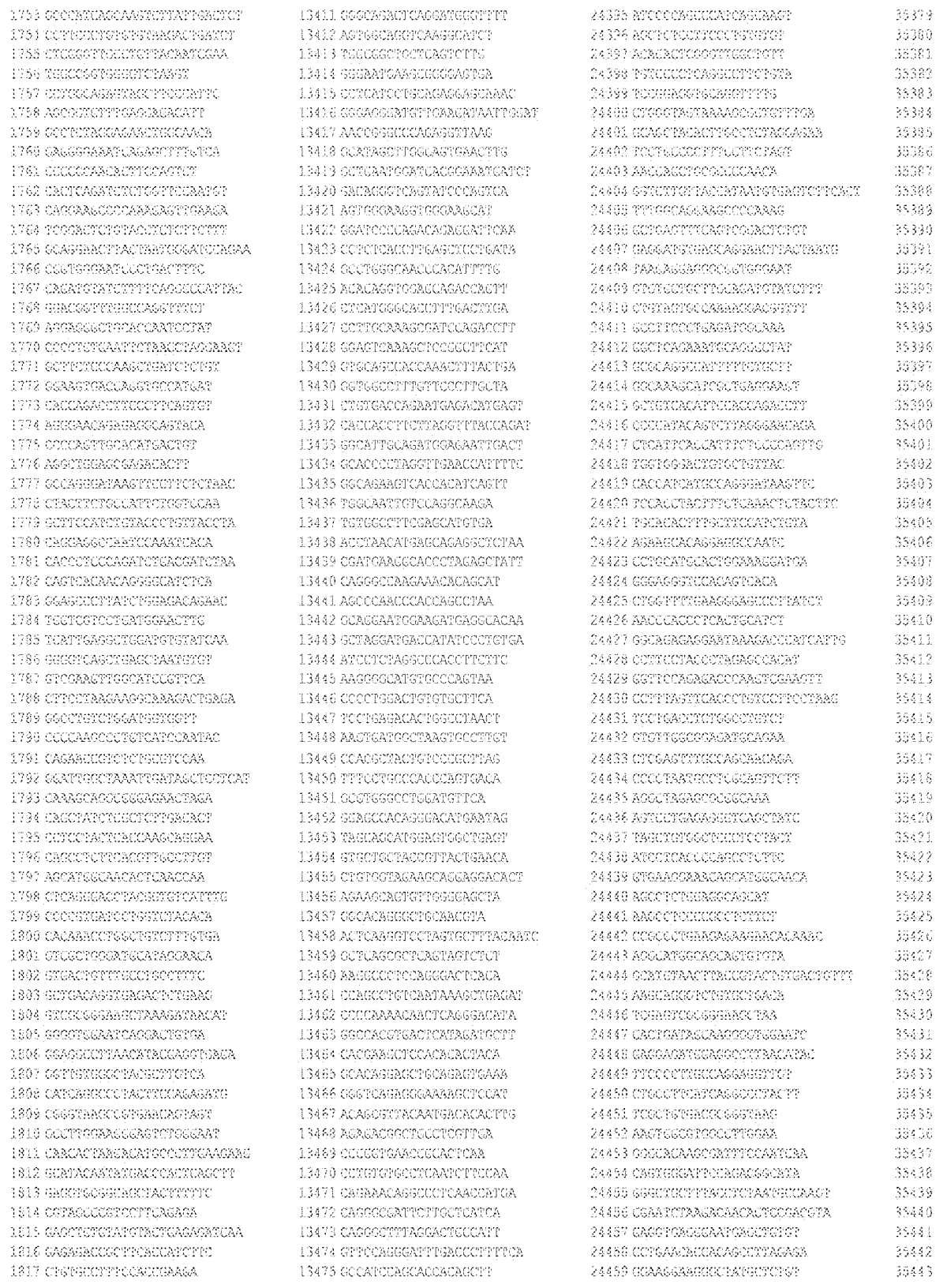
Figure 36C9:
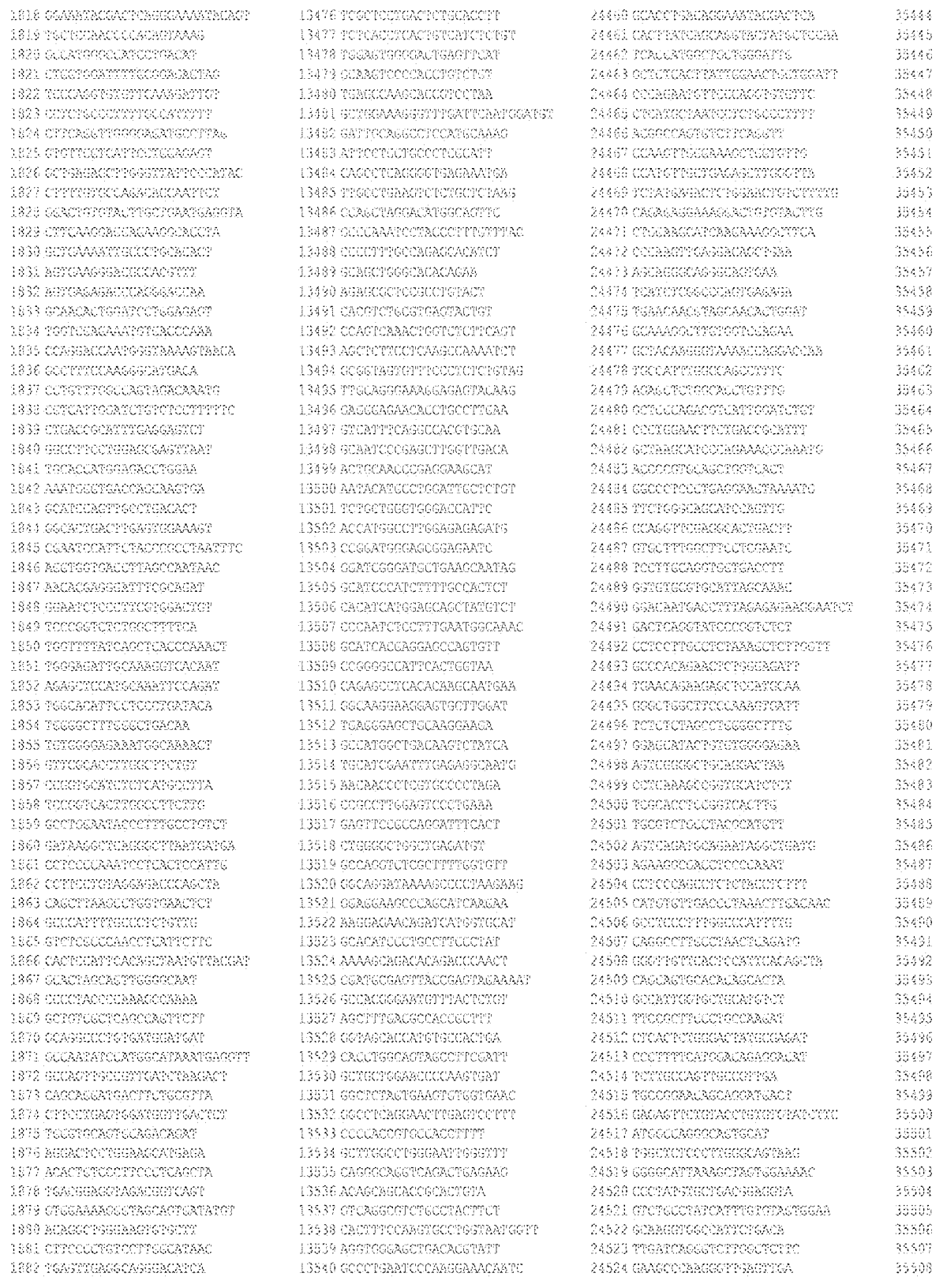
Figure 36C10:
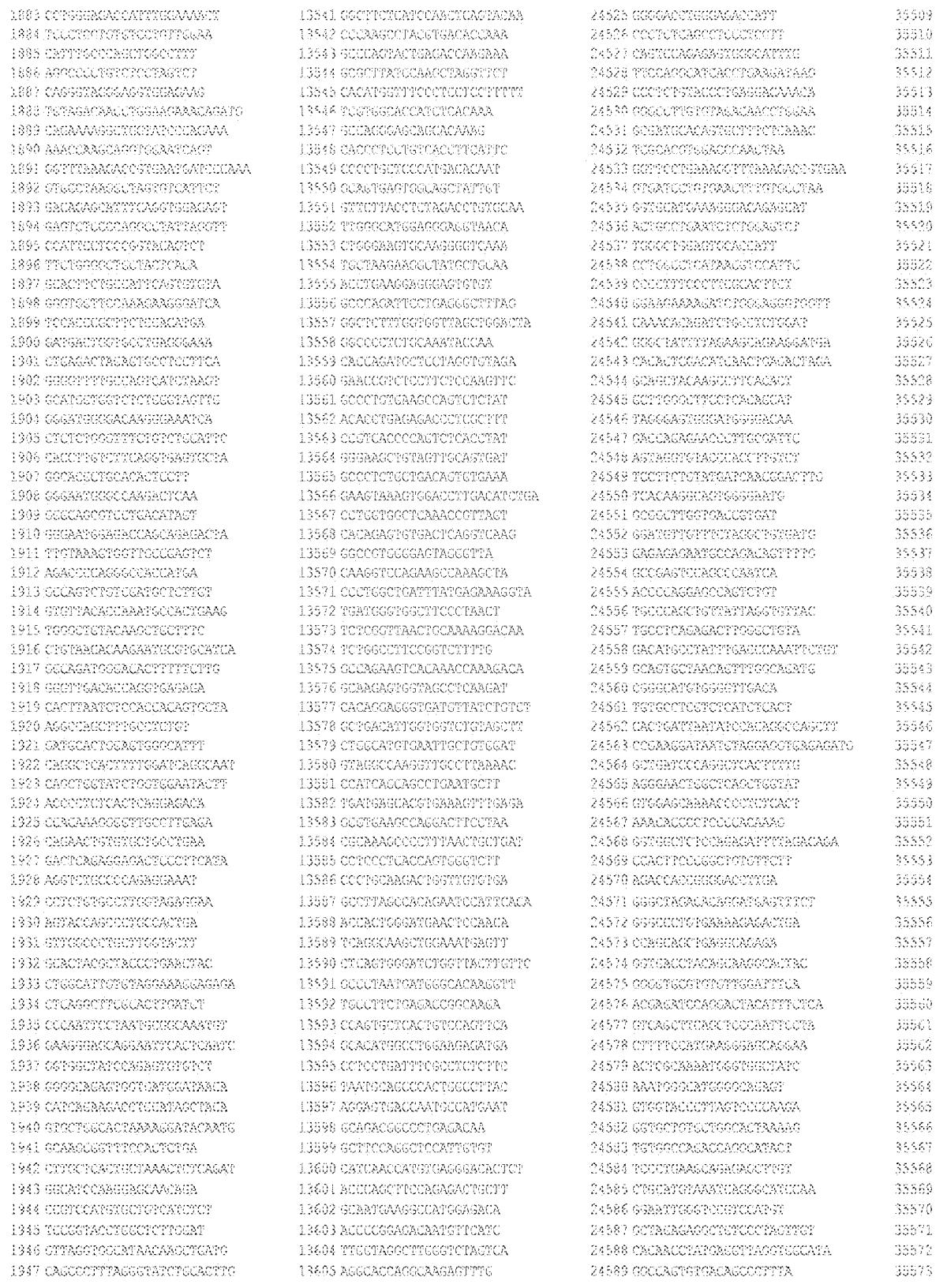
Figure 36D1:
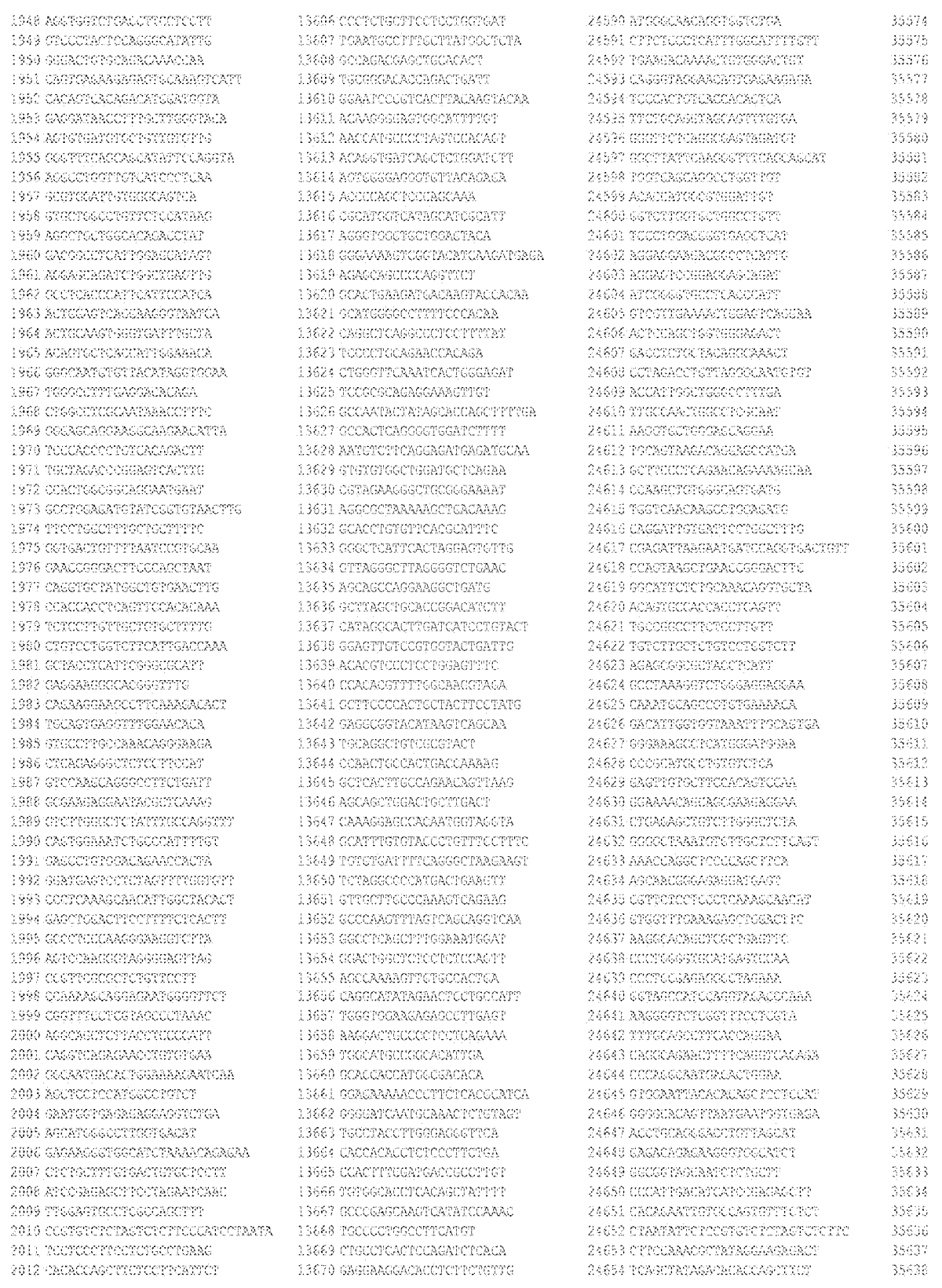
Figure 36D2:
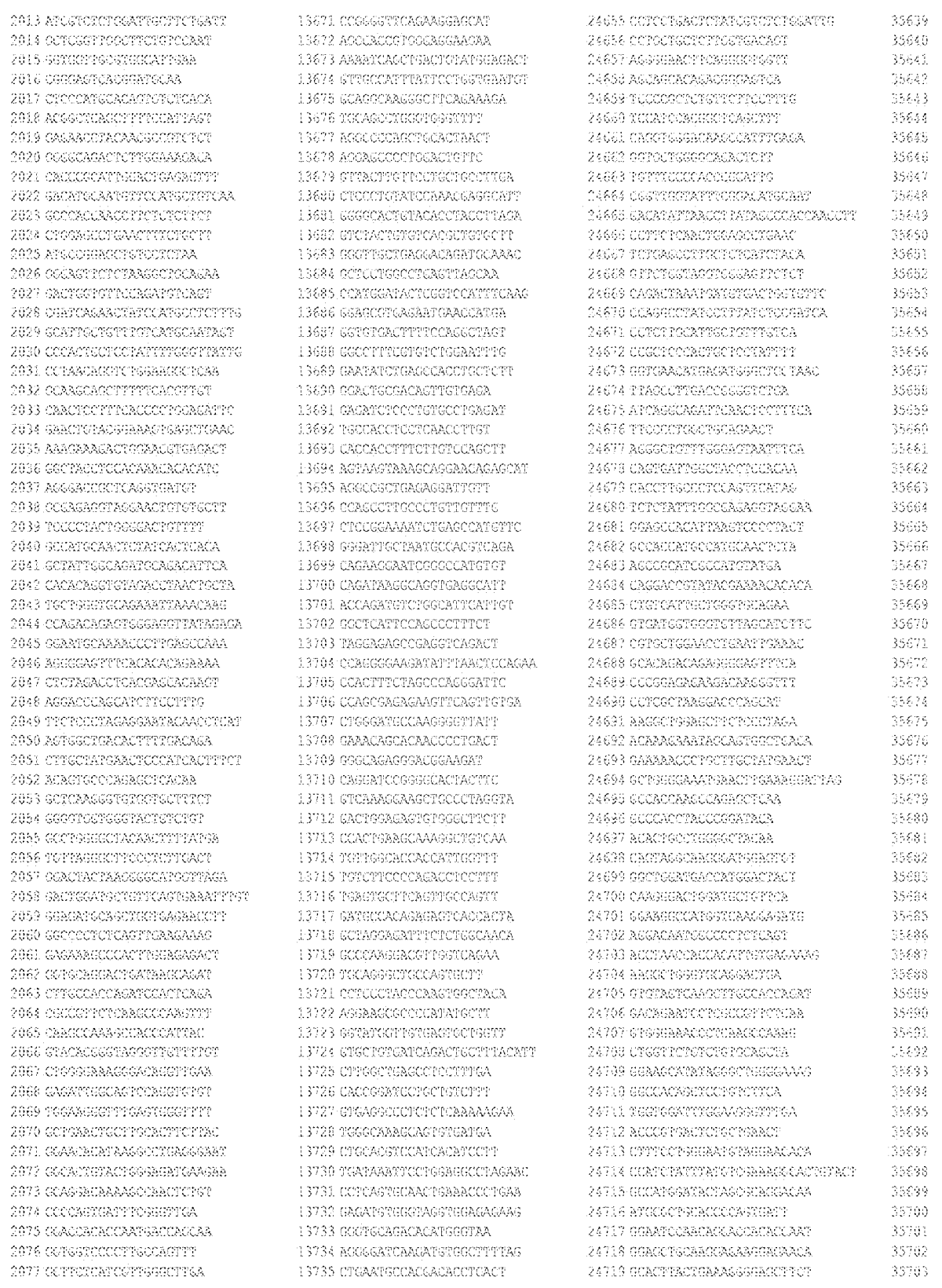
Figure 36D3:
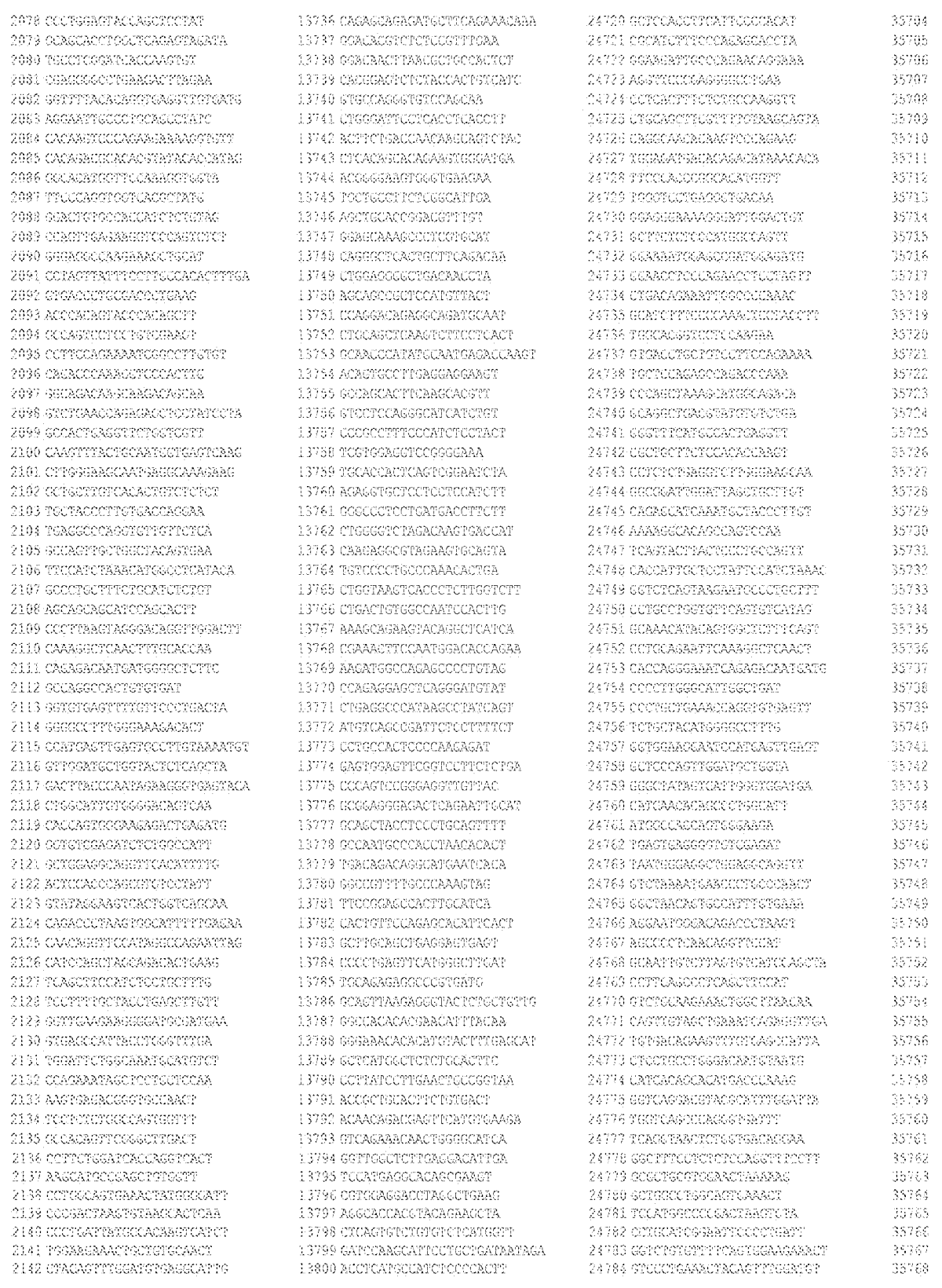
Figure 36D4:
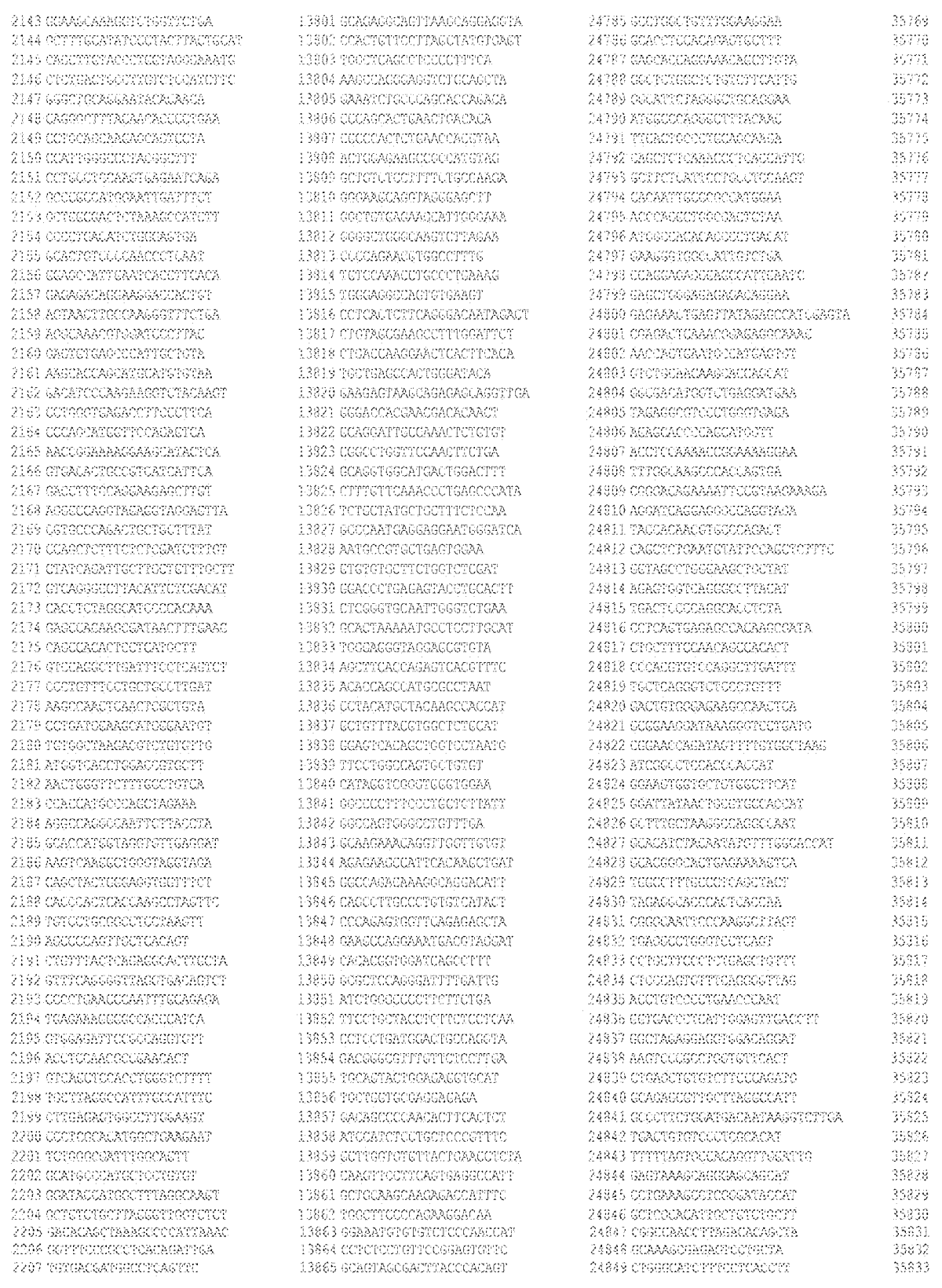
Figure 36D5:
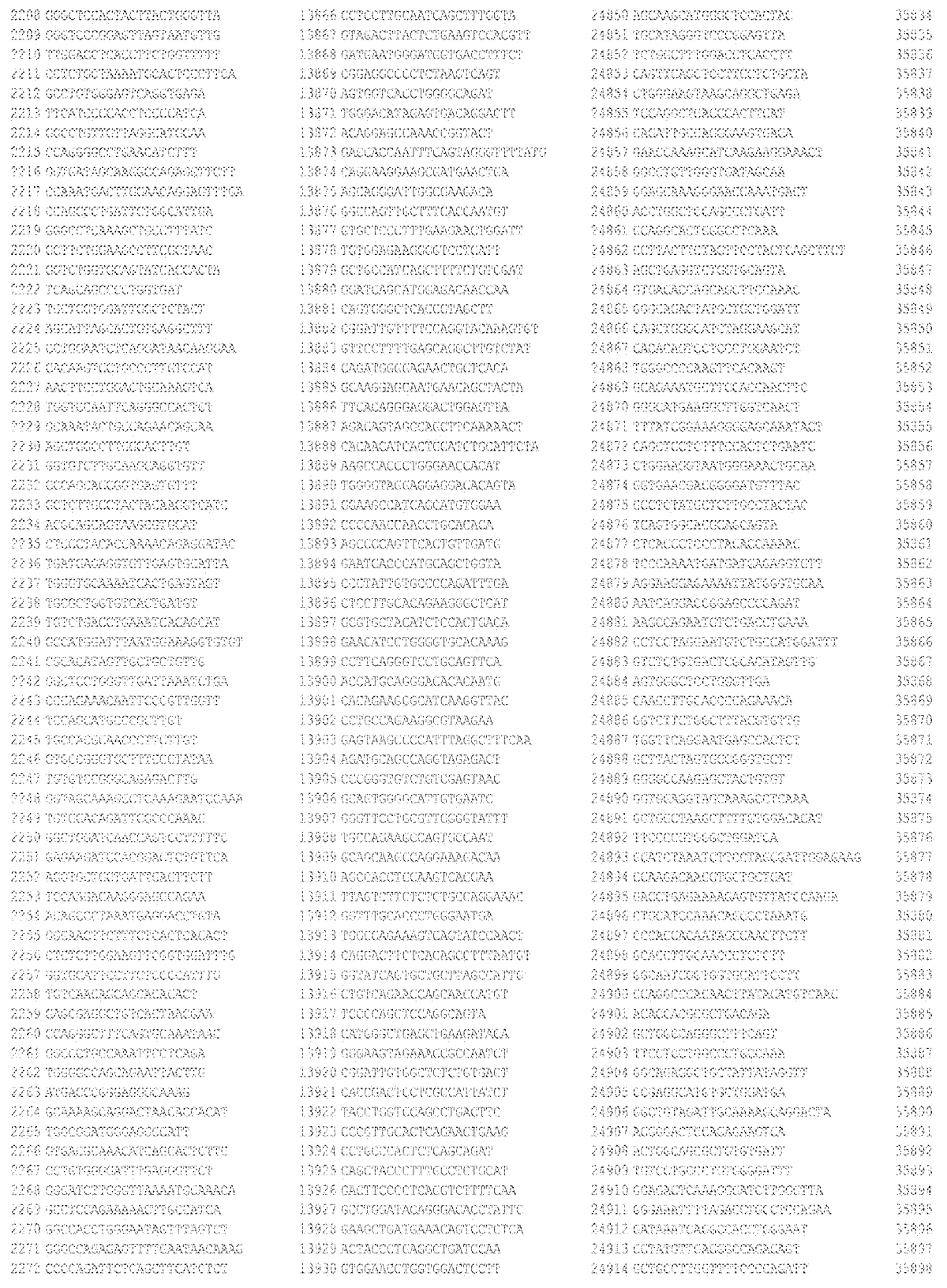
Figure 36D6:
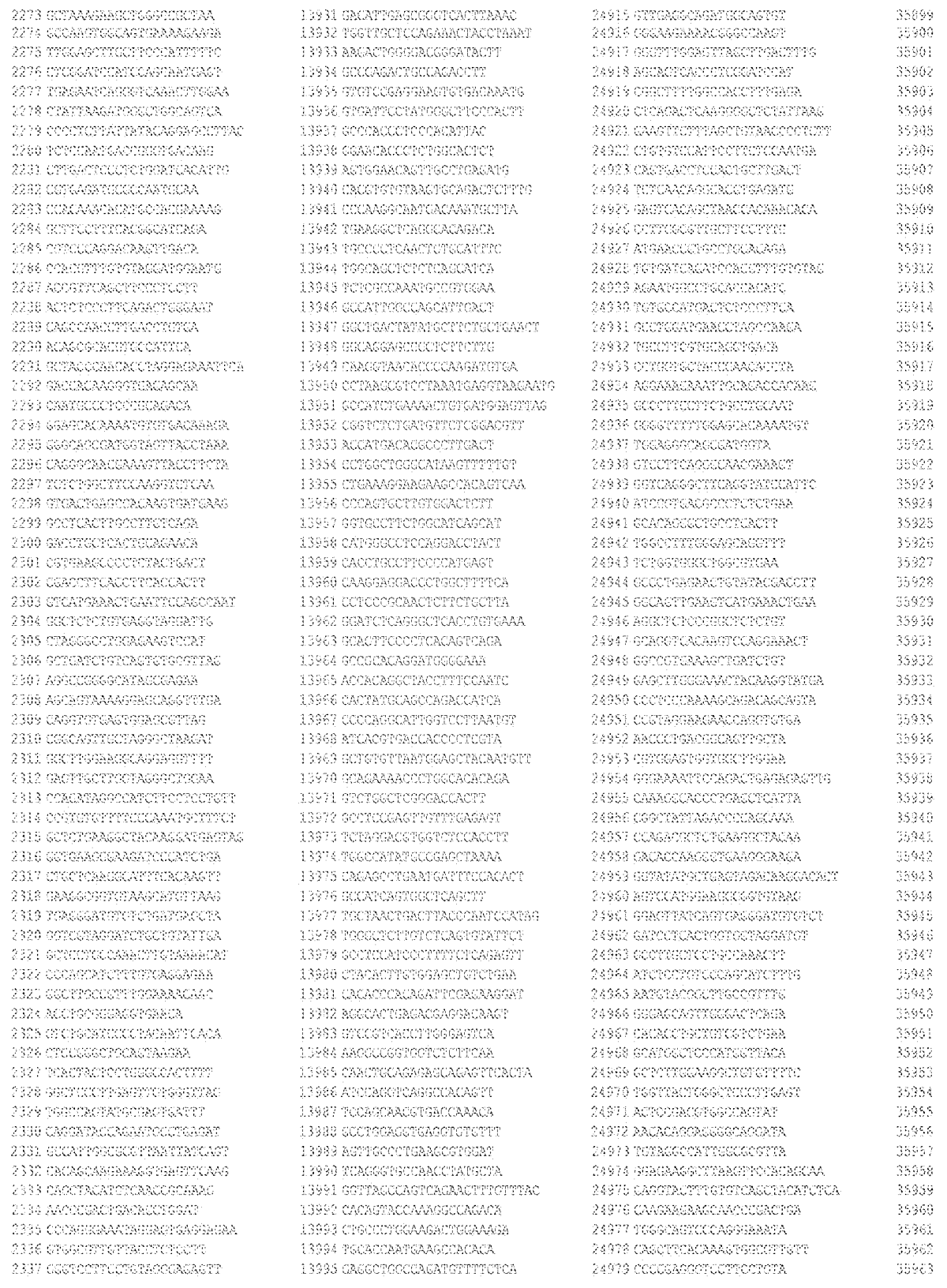
Figure 36D7:
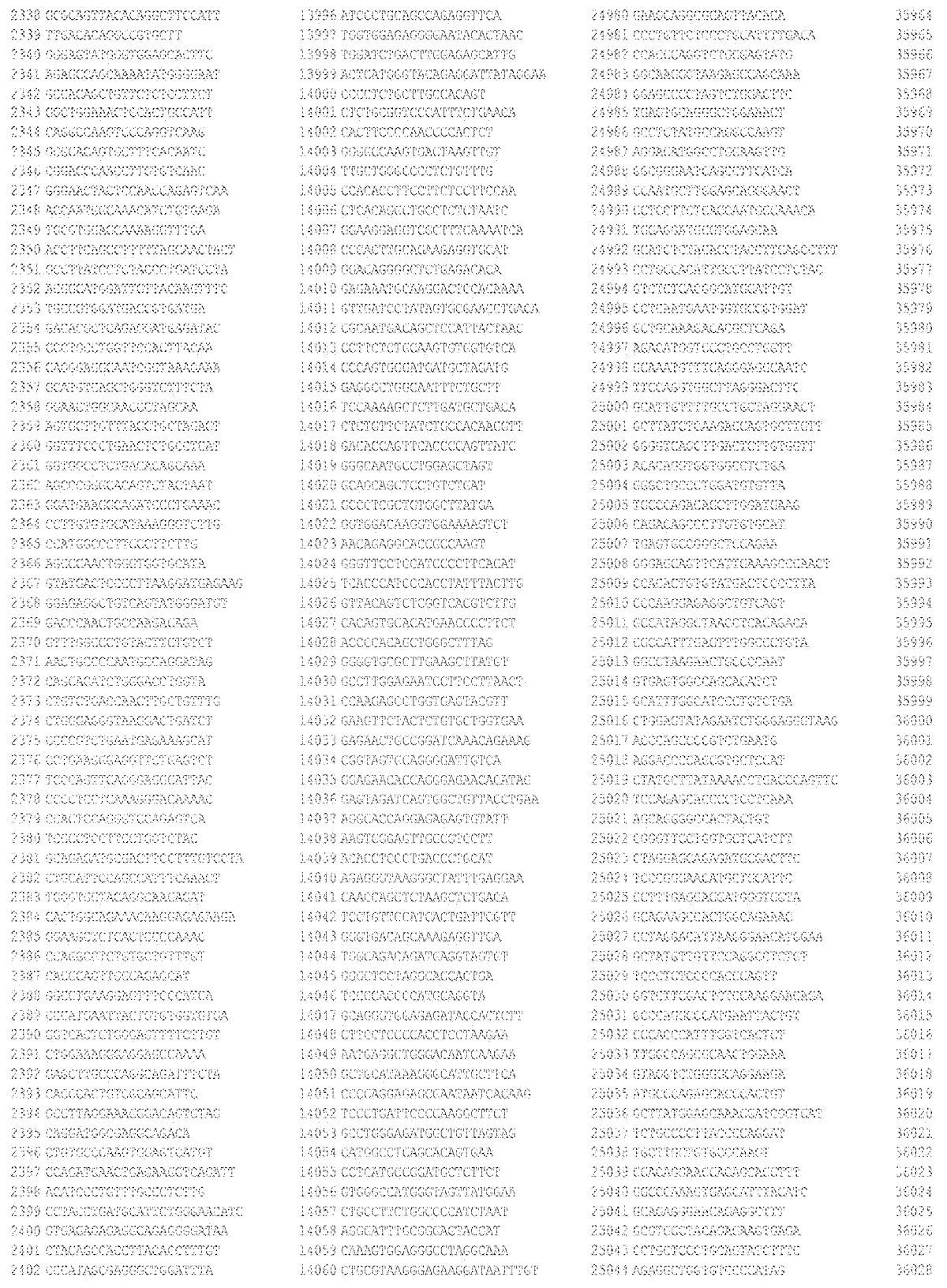
Figure 36D8:
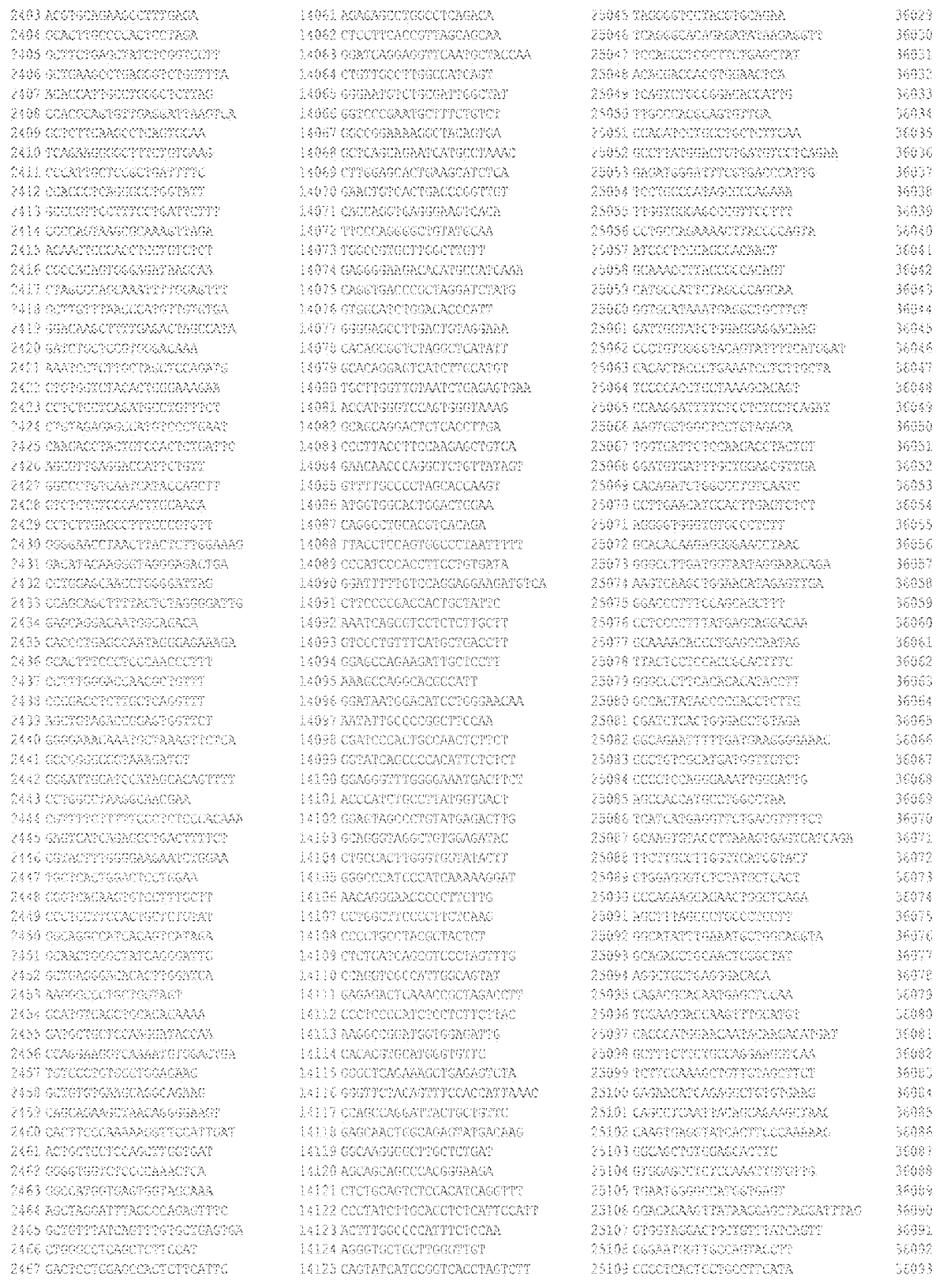
Figure 36D9:
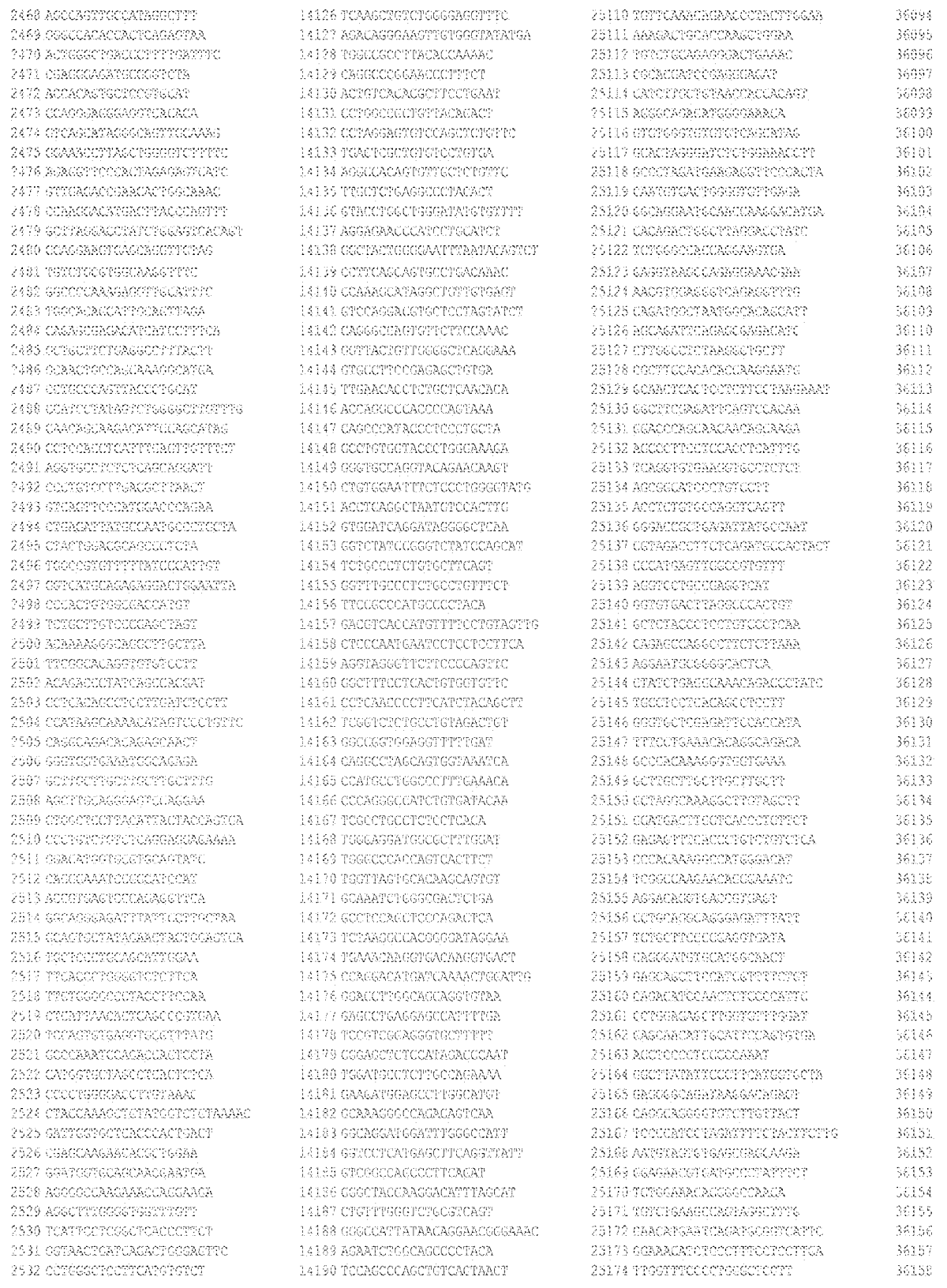
Figure 36D10:
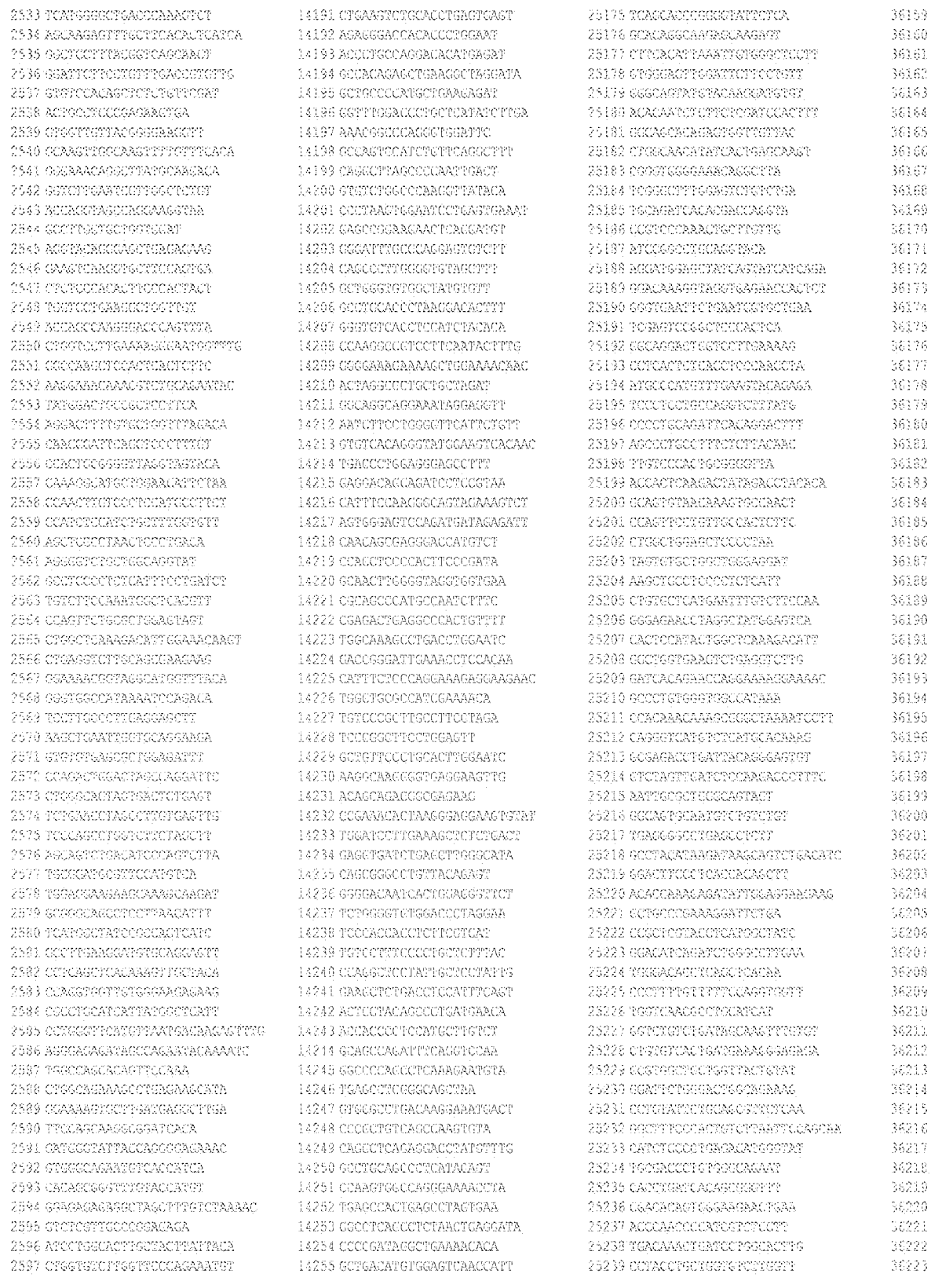
Figure 36H3:
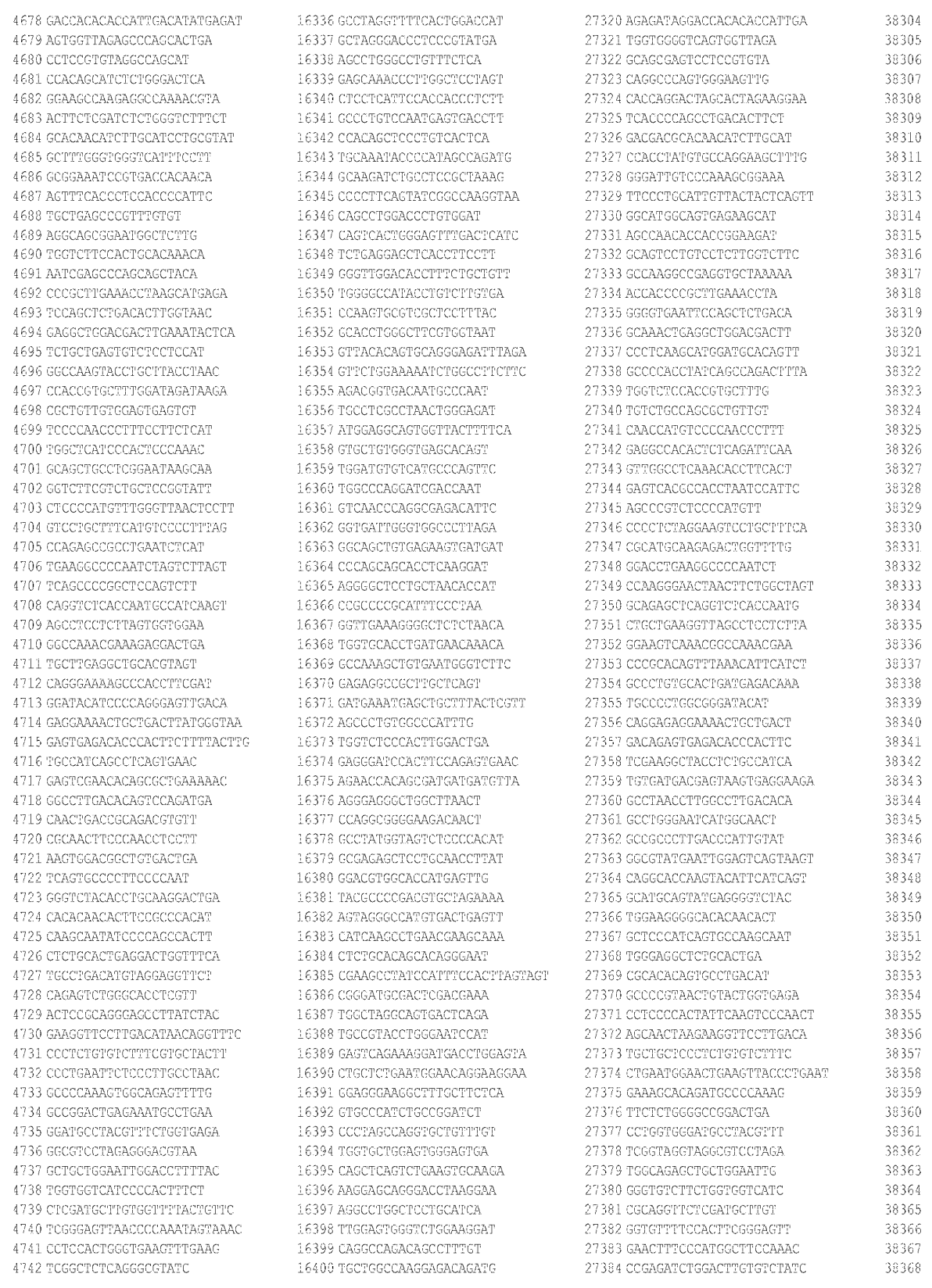

FIG. 36A1-Q9: Sequences of an exemplary 10,984-plex primer library (SEQ ID NOs 11,659-44,610). The three primers (one from pool A, one from pool B, and one from pool C) in each row all hybridize to the same target locus.

FIG. 37: Table of the percentage of reads that map to target loci for genomic DNA samples and for samples of a single cell from a cell line for both mother and child samples.

FIG. 39: Table of the percentage of reads that map to target loci for blastoceol fluid and for a single blastocyst cell.

FIG. 46 is a table comparing error call metrics for genomic DNA and DNA from a single cell.

FIG. 48 is a table of data (such as percent mapped reads and error rate) from multiplex PCR with various buffers.

Figure 1:
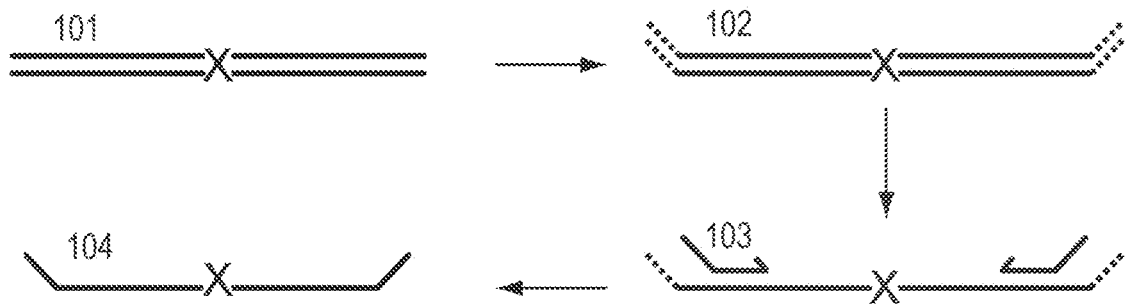
FIG. 1: Graphical representation of direct multiplexed mini-PCR method.

While the above-identified drawings set forth presently disclosed embodiments, other embodiments are also contemplated, as noted in the discussion. This disclosure presents illustrative embodiments by way of representation and not limitation. Numerous other modifications and embodiments can be devised by those skilled in the art which fall within the scope and spirit of the principles of the presently disclosed embodiments.

DETAILED DESCRIPTION

The present invention is based in part on the surprising discovery that often only a relatively small number of primers in a library of primers are responsible for a substantial amount of the amplified primer dimers that form during multiplex PCR reactions. Methods have been developed to select the most undesirable primers for removal from a library of candidate primers. By reducing the amount of primer dimers to a negligible amount (~0.1% of the PCR products), these methods allow the resulting primer libraries to simultaneously amplify a large number of target loci in a single multiplex PCR reaction. Because the primers hybridize to the target loci and amplify them rather than hybridizing to other primers and forming amplified primer dimers, the number of different target loci that can be amplified is increased. It was also discovered that using lower primer concentrations and much longer annealing times than normal increases the likelihood that the primers hybridize to the target loci instead of hybridizing to each other and forming primer dimers (see, e.g., U.S. Ser. No. 13/683,604, filed Nov. 21, 2012, which is hereby incorporated by reference in its entirety). The methods can also be used to amplify a large number of target loci even if the primers have a relatively large range of melting temperatures (in contrast to other methods that require primers to have very similar melting temperatures to successfully amplify multiple loci simultaneously due to the need for the primers to be functional under the same reaction conditions). Additionally, it was discovered that the annealing temperature can optionally be higher than the melting temperatures of the primers (in contrast to other methods that use an annealing temperature below the melting temperatures of the primers). A higher annealing temperature improves the specificity of the PCR amplification and reduces or prevents amplification of non-target loci.

During the PCR amplification and sequencing of 19,488 target loci in a genomic sample, 99.4-99.7% of the sequencing reads mapped to the genome, of those, 99.99% of the mapped to target loci. For plasma samples with 10 million sequencing reads, typically at least 19,350 of the 19,488 target loci (99.3%) were amplified and sequenced. This primer library has even been used to amplify the nucleic acids in a single cell (FIGS. 37-40).

During the PCR amplification and sequencing of ~28,000 target loci in a genomic sample, 99% of the sequencing reads mapped to target loci. This primer library has also been used to amplify nucleic acids in a single cell.

Being able to simultaneously amplify such a large number of target loci at once greatly decreases the amount of time and the amount of DNA required to analyze thousands of target loci. For example, DNA from a single cell is sufficient to simultaneously analyze thousands of target loci, which is important for applications in which the amount of DNA is low, such as genetic testing of a single cell from an embryo prior to in vitro fertilization or genetic testing of a forensic sample with little DNA. In addition, being able to analyze the target loci in one reaction volume (such as in one chamber, well, or vessel) rather than splitting the sample into multiple different reactions reduces variability that can occur between reactions. In addition, methods have been developed to use reference standards to correct for amplification bias that may occur between different target loci. For example, differences in amplification efficiency between target loci due to factors such as GC content may cause differing amounts of PCR products to be produced for target loci that are actually present in the same amount. The use of reference standards similar to the target loci allows the detection of such amplification bias so that it can be corrected for during the quantitation of the target loci.

During sequencing of PCR products, artifacts such as primer dimers are detected and thus inhibit the detection of target amplicons. Because of this limitation, microarrays with hybridization probes are often used for detection since microarrays are less sensitive to interference from primer dimers (for example, microarrays can be used as a target specific detection that uses probes to hybridize to target amplicons but does not have probes to hybridize to undesired primer dimers). The high level of multiplexing with minimal non-target amplicons that has now been achieved allows PCR followed by sequencing to be used as an alternative to microarrays. For example, the present multiplex PCR methods can be used with a non-target specific method of detection, such as sequencing that detects all amplified products (including both target amplicons and primer dimers, if any). The small amount of primer dimers that are produced allows detection of target amplicons by methods that detect all amplicons. Thus, in some embodiments, the method includes multiplex PCR followed by sequencing without use of an array. In other embodiments, the method includes multiplex PCR followed by an array for detection of the amplified products.

The multiplex-PCR methods of the invention can be in a variety of applications, such as genotyping, detection of chromosomal abnormalities (such as a fetal chromosome aneuploidy), gene mutation and polymorphism (such as single nucleotide polymorphisms, SNPs) analysis, gene deletion analysis, determination of paternity, analysis of genetic differences among populations, forensic analysis, measuring predisposition to disease, quantitative analysis of mRNA, and detection and identification of infectious agents (such as bacteria, parasite, and viruses). The multiplex PCR methods can also be used for non-invasive prenatal testing, such as paternity testing or the detection of fetal chromosome abnormalities.

Exemplary Primer Design Methods

Highly multiplexed PCR can often result in the production of a very high proportion of product DNA that results from unproductive side reactions such as primer dimer formation. In an embodiment, the particular primers that are most likely to cause unproductive side reactions may be removed from the primer library to give a primer library that will result in a greater proportion of amplified DNA that maps to the genome. The step of removing problematic primers, that is, those primers that are particularly likely to firm dimers has unexpectedly enabled extremely high PCR multiplexing levels for subsequent analysis by sequencing. In systems such as sequencing, where performance significantly degrades by primer dimers and/or other mischief products, greater than 10, greater than 50, and greater than 100 times higher multiplexing than other described multiplexing has been achieved. Note this is opposed to probe based detection methods, e.g. microarrays, TAQMAN, PCR etc. where an excess of primer dimers will not affect the outcome appreciably. Also note that the general belief in the art is that multiplexing PCR for sequencing is limited to about 100 assays in the same well. Fluidigm and Rain Dance offer platforms to perform 48 or 1000s of PCR assays in parallel reactions for one sample.

There are a number of ways to choose primers for a library where the amount of non-mapping primer dimer or other primer mischief products are minimized. Empirical data indicate that a small number of 'bad' primers are responsible for a large amount of non-mapping primer dimer side reactions. Removing these 'bad' primers can increase the percent of sequence reads that map to targeted loci. One way to identify the 'bad' primers is to look at the sequencing data of DNA that was amplified by targeted amplification; those primer dimers that are seen with greatest frequency can be removed to give a primer library that is significantly less likely to result in side product DNA that does not map to the genome. There are also publicly available programs that can calculate the binding energy of various primer combinations, and removing those with the highest binding energy will also give a primer library that is significantly less likely to result in side product DNA that does not map to the genome.

In some embodiments for selecting primers, an initial library of candidate primers is created by designing one or more primers or primer pairs to candidate target loci. A set of candidate target loci (such as SNPs) can selected based on publically available information about desired parameters for the target loci, such as frequency of the SNPs within a target population or the heterozygosity rate of the SNPs. In one embodiment, the PCR primers may be designed using the Primer3 program (the worldwide web at primer3.sourceforge.net; libprimer3 release 2.2.3, which is hereby incorporated by reference in its entirety). If desired, the primers can be designed to anneal within a particular annealing temperature range, have a particular range of GC contents, have a particular size range, produce target amplicons in a particular size range, and/or have other parameter characteristics. Starting with multiple primers or primer pairs per candidate target locus increases the likelihood that a primer or prime pair will remain in the library for most or all of the target loci. In one embodiment, the selection criteria may require that at least one primer pair per target locus remains in the library. That way, most or all of the target loci will be amplified when using the final primer library. This is desirable for applications such as screening for deletions or duplications at a large number of locations in the genome or screening for a large number of sequences (such as polymorphisms or other mutations) associated with a disease or an increased risk for a disease. If a primer pair from the library would produces a target amplicon that overlaps with a target amplicon produced by another primer pair, one of the primer pairs may be removed from the library to prevent interference.

In some embodiments, a score such as an "undesirability score" (higher score representing least desirability) is calculated (such as calculation on a computer) for most or all of the possible combinations of two primers from a library of candidate primers. In various embodiments, a score (such as an undesirability score) is calculated for at least 80, 90, 95, 98, 99, or 99.5% of the possible combinations of candidate primers in the library. Each score (such as an undesirability score) is based at least in part on the likelihood of dimer formation between the two candidate primers. If desired, the score (such as the undesirability score) may also be based on one or more other parameters selected from the group consisting of heterozygosity rate of the target locus, disease prevalence associated with a sequence (e.g., a polymorphism) at the target locus, disease penetrance associated with a sequence (e.g., a polymorphism) at the target locus, specificity of the candidate primer for the target locus, size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, size of the target amplicon. number of SNPs within the candidate primer, location of SNPs within the candidate primer, distance from an end of the amplicon to the target bases within the amplicon, and the number of target loci in an amplicon. In some embodiments, the lower the number of SNPs with the candidate primer (such as 2, 1 or 0 SNPs) the better. In some embodiments, there are no SNPs in the candidate primer. In some embodiments, SNPs (if any) are preferably not in the last 5 nucleotides in the 3' end of the candidate primer. In some embodiments, the target bases (the bases of interest in a target locus) are preferably near an end (the 3' or 5' end) of the amplicon; this may improve the quality of sequencing data (since bases near the end of an amplicon are sequenced more accurately), and/or allow shorter sequencing reads to be performed. In some embodiments, a single amplicon includes 2 or more target loci (such as 2 or more nearby SNPs or variants). In some embodiments, the specificity of the candidate primer for the target locus includes the likelihood that the candidate primer will mis-prime by binding and amplifying a locus other than the target locus it was designed to amplify. In some embodiments, one or more or all the candidate primers that mis-prime are removed from the library. In some embodiments to increase the number of candidate primers to choose from, candidate primers that may mis-prime are not removed from the library. In some embodiments, the optimal melting temperature for selection of the candidate primers is 57° C. In some embodiments, the optimal size for selection of the candidate primers is a length of 24 nucleotides. In some embodiments, the optimal GC content for selection of the candidate primers is 50%. If multiple factors are considered, the score (such as the undesirability score) may be calculated based on a weighted average of the various parameters. The parameters may be assigned different weights based on their importance for the particular application that the primers will be used for. An exemplary score (such as an undesirability score) for a primer is shown below in which the parameters are weighted by various factors.

score=(1)(total number of targets−number of targets covered)+(100)(number of SNPs in GC clamp)+(10)(number of SNPs in primer binding site)+(10)(number of similar primer pair designs)+(0.1)(distance of target base from amplicon end)+(0.1)(amplicon length)+(100)(interaction score)

where interaction score=max (−1*ΔG value) as described herein
Another exemplary score for a primer is shown below.

score=(100)(number of SNPs in GC clamp)+(10)(number of SNPs in primer binding site)+(0.1)(distance of target base from amplicon end)+(0.1)(amplicon length)+(100)(interaction score)

where interaction score=max (−1*ΔG value) as described herein
In some embodiments, the score for a primer pair is the worse score out of the scores for the two primers in the pair. An exemplary score (such as an undesirability score or the score in Experiment 20) for a pairs of designs (in which each design is one primer pair so that a pair of designs includes two primer pairs with a total of 4 primers) is shown below.

score=(10000000)(amplicon overlap)+(100)(distance between designs)+(1)(total number of targets−number of targets covered)+(100)(number of SNPs in GC clamp)+(10)(number of SNPs in primer binding site)+(10)(number of similar primer pair designs)+(0.1)(distance of target base from amplicon end)+(0.1)(amplicon length)+(100)(interaction score)

where interaction score=max (−1*ΔG value) as described herein;
where amplicon overlap=overlap between the two amplicons formed by a pair of designs
In some embodiments, the score for a pair of designs is the worse score out of the scores for the four primers in the pair of designs.

In some embodiments, the primer with the highest score (such as the undesirability score) or any score representing least desirability is removed from the library. If the removed primer is a member of a primer pair that hybridizes to one target locus, then the other member of the primer pair may be removed from the library. The process of removing primers may be repeated as desired. In some embodiments, the selection method is performed until the score (such as the undesirability score) for the candidate primer combinations remaining in the library are all equal to or below a minimum threshold (such as any threshold for which the primers remaining in the library all have at least that level of desirability). In some embodiments, the selection method is performed until the number of candidate primers remaining in the library is reduced to a desired number.

In various embodiments, after the score (such as the undesirability score) are calculated, the candidate primer that is part of the greatest number of combinations of two candidate primers with a score (such as an undesirability score) above a first minimum threshold (such as any threshold for which the primers remaining in the library all have at least that level of desirability) is removed from the library. This step ignores interactions equal to or below the first minimum threshold since these interactions are less significant. If the removed primer is a member of a primer pair that hybridizes to one target locus, then the other member of the primer pair may be removed from the library. The process of removing primers may be repeated as desired. In some embodiments, the selection method is performed until the score (such as the undesirability score) for the candidate primer combinations remaining in the library are all equal to or below the first minimum threshold. If the number of candidate primers remaining in the library is higher than desired, the number of primers may be reduced by decreasing the first minimum threshold to a lower second minimum threshold (such as any threshold with a stricter cutoff than the first minimum threshold so that some of the least desirable primers are removed from the library) and repeating the process of removing primers. If the number of candidate primers remaining in the library is lower than desired, the method can be continued by increasing the first minimum threshold to a higher second minimum threshold (such as any threshold with a less strict cutoff than the first minimum threshold) and repeating the process of removing primers using the original candidate primer library, thereby allowing more of the candidate primers to remain in the library. In some embodiments, the selection method is performed until the score (such as the undesirability score) for the candidate primer combinations remaining in the library are all equal to or below the second minimum threshold, or until the number of candidate primers remaining in the library is reduced to a desired number.

If desired, primer pairs that produce a target amplicon that overlaps with a target amplicon produced by another primer pair can be divided into separate amplification reactions. Multiple PCR amplification reactions may be desirable for applications in which it is desirable to analyze all of the candidate target loci (instead of omitting candidate target loci from the analysis due to overlapping target amplicons).

In various embodiments of any of the aspects of the invention, the selection method selects candidate primers and divides them into different pools (e.g., 2, 3, 4, 5, 6, or more different pools). Each pool can be used to simultaneously amplify a large number of target loci (or a subset of target loci) in a single reaction volume. In some embodiments, a graph coloring algorithm is used to divide candidate primers into different pools. If desired, this method can be used to minimize the number of different pools needed to amplify most or all of the target loci.

In some embodiments, most or all of the target loci (such as at least 70, 80, 90, 92, 94, 96, 98, 99, or 100% of the target loci) are amplified by at least 2, 3, 4, 5, 6, or more different pools. In some embodiments, most or all of the bases in the target loci (such as at least 70, 80, 90, 92, 94, 96, 98, 99, or 100% of the bases in the target loci) are amplified by at least 2, 3, 4, 5, 6, or more different pools. In some embodiments, most or all of the bases in the target loci (such as at least 70, 80, 90, 92, 94, 96, 98, 99, or 100% of the bases in the target loci) are amplified by at least 2, 3, 4, 5, 6, or more different primers or primer pairs in different pools. For example, a particular base in a target locus may be amplified by at least 2, 3, 4, 5, 6, or more different primers or primer pairs; wherein each different primer or primer pair is in a different pool. Using different primers or primer pairs to amplify each base allows multiple independent measurements of the base to be made, thereby increasing the accuracy of the method. Dividing the different primers or primer pairs that amplify the same base into different pools prevents interference due to overlapping amplicons being formed by different primers or primer pairs.

In one aspect, the invention features methods of selecting test primers from a library of candidate primers to form 2 or more different primer pools. In various embodiments, the selection involves (i) calculating on a computer a score (such as an undesirability score) for most or all of the possible combinations of two candidate primers from the library, wherein each score (such as an undesirability score) is based at least in part on the likelihood of dimer formation between the two candidate primers; (ii) removing the candidate primer with the highest or worst score (such as an undesirability score) from the library of candidate primers; and (iii) if the candidate primer removed in step (ii) is a member of a primer pair, then removing the other member of the primer pair from the library of candidate primers; and (iv) optionally repeating steps (ii) and (iii), thereby selecting a first pool. In some embodiments, the selection method is performed until the score (such as the undesirability score) for the candidate primer combinations remaining in the library are all equal to or below a minimum threshold for the first pool. In some embodiments, the selection method is performed until the number of candidate primers remaining in the library is reduced to a desired number for the first pool. In some embodiments, after the first pool is selected those primers are removed from further consideration and steps of the method (such as steps (ii) and (iii)) are repeated with the remaining primers to select a second pool. If desired, this method may be repeated to select the desired number of primer pools. In some embodiments, the score is based at least in part on the current coverage of the bases in the target locus (such as the number of other primer pools that have a primer or primer pair that amplifies a particular base in the target locus).

In one aspect, the invention features methods of selecting test primers from a library of candidate primers to form 2 or more different primer pools. In various embodiments, the selection of test primers are selected from a library of candidate primers involves (i) calculating on a computer a score (such as an undesirability score) for most or all of the possible combinations of two candidate primers from the library, wherein each score (such as an undesirability score) is based at least in part on the likelihood of dimer formation between the two candidate primers; (ii) removing from the library of candidate primers the candidate primer that is part of the greatest number of combinations of two candidate primers with a score (such as an undesirability score) above a first minimum threshold; (iii) if the candidate primer removed in step (ii) is a member of a primer pair, then removing the other member of the primer pair from the library of candidate primers; and (iv) optionally repeating steps (ii) and (iii), thereby selecting a first pool. In some embodiments, the selection method is performed until the score (such as the undesirability score) for the candidate primer combinations remaining in the library are all equal to or below the first minimum threshold for the first pool. In some embodiments, the selection method is performed until the number of candidate primers remaining in the library is reduced to a desired number for the first pool. In various embodiments, the selection method involves further reducing the number of candidate primers remaining in the library by decreasing the first minimum threshold used in step (ii) to a lower second minimum threshold and optionally repeating steps (ii) and (iii). In some embodiments, the selection method involves increasing the first minimum threshold used in step (ii) to a higher second minimum threshold and optionally repeating steps (ii) and (iii). In some embodiments, the selection method is performed until the score (such as the undesirability score) for the candidate primer combinations remaining in the library are all equal to or below the second minimum threshold, or until the number of candidate primers remaining in the library is reduced to a desired number for the first pool. In some embodiments, after the first pool is selected those primers are removed from further consideration and steps of the method (such as steps (ii) and (iii)) are repeated with the remaining primers to select a second pool. If desired, this method may be repeated to select the desired number of primer pools. In some embodiments, the score is based at least in part on the current coverage of the bases in the target locus (such as the number of other primer pools that have a primer or primer pair that amplifies a particular base in the target locus).

As discussed above, in some embodiments, a library is formed by starting with a library of candidate primers and removing primers until the primers remaining in the library have the desired characteristics for use as a final primer library.

In other embodiments, candidate primers are added to a library (such as a library starting with no primers) to form a library with the desired characteristics. In some embodiments, the candidate primer or primer pair with the most desirable score (such as the lowest undesirability score) is added to a library (such as a library starting with no primers). The process of adding candidate primers may be repeated as desired. In some embodiments, the selection method is performed until the score (such as the undesirability score) for the candidate primers that have not been added to the library are all above a minimum threshold (such that all the candidate primers that have not been chosen for the library all have worse scores than the threshold). In some embodiments, the selection method is performed until the number of candidate primers that have been added to the library reaches a desired number. The library of selected primers can then be used in any of the methods of the invention.

In some embodiments, most (such as at least 50, 60, 70, 80, 90, 95, 96, 97, 98, 99, or 99.5%) or all of the possible sets of two primer pairs (two primer pairs with a total of 4 primers) are considered for inclusion in a library. In some embodiments, the set of two different candidate primer pair with the most desirable score (such as the lowest undesirability score) is added to a first pool (such as a first pool starting with no primers). In some embodiments, the set of two different candidate primer pairs with the next most desirable score is added to the first pool if it is connected to at most two sets of two different candidate primer pairs in the first pool. By "connected" for purposes of this step is meant that a single candidate primer pair in one set of two different candidate primer pairs is the same as a single candidate primer pair in another set of two different candidate primer pairs. If the set of two different candidate primer pairs is connected to more than two sets, it may be added to a different pool than the first pool. The process of set of two different candidate primer pair to pool(s) may be repeated as desired for the next set of two different candidate primer pairs with the next most desirable score. In some embodiments, the selection method is performed until the score (such as the undesirability score) for the candidate primers that have not been added to the pool(s) are all above a minimum threshold (such that all the candidate primers that have not been chosen for the pool(s) all have worse scores than the threshold). In some embodiments, the selection method is performed until the number of candidate primers that have been added to the pool(s) reaches a desired number. In some embodiments, the method involves storing designs in N number of doubly linked list data structures with the design pairs. N represents the current number of different primer pools. Initially, N=1, since there is only one primer pool. In some embodiments, a second pool is only created if necessary to include the desired target loci or the desired level of coverage of target loci. The library of selected primers can then be used in any of the methods of the invention.

In some embodiments, the minimum threshold, the first minimum threshold, or the second minimum threshold is an interaction score equal to or about 20, 18, 16, 14, 12, 10, 9, 8, 7, 6, 5, 4, 3, 2, or 1 kcal/mol. In some embodiments, the interaction score is calculated as followed as described further herein:

Interaction score=max(-1*ΔG value); or interaction_score=max(-delta$G$_2,0.8*(-delta$G$_1))

where
deltaG_2=Gibbs energy (energy required to break the dimer) for a dimer that is extensible by PCR on both ends, i.e., the 3' end of each primer anneals to the other primer; and
deltaG_1=Gibbs energy for a dimer that is extensible by PCR on at least one end.

These selection methods minimize the number of candidate primers that have to be removed from the library to achieve the desired reduction in primer dimers. By removing a smaller number of candidate primers from the library, more (or all) of the target loci can be amplified using the resulting primer library.

Multiplexing large numbers of primers imposes considerable constraint on the assays that can be included. Assays that unintentionally interact result in spurious amplification products. The size constraints of miniPCR may result in further constraints. In an embodiment, it is possible to begin with a very large number of potential SNP targets (between about 500 to greater than 1 million) and attempt to design primers to amplify each SNP. Where primers can be designed it is possible to attempt to identify primer pairs likely to form spurious products by evaluating the likelihood of spurious primer duplex formation between all possible pairs of primers using published thermodynamic parameters for DNA duplex formation. Primer interactions may be ranked by a scoring function related to the interaction and primers with the worst interaction scores are eliminated until the number of primers desired is met. In cases where SNPs likely to be heterozygous are most useful, it is possible to also rank the list of assays and select the most heterozygous compatible assays. Experiments have validated that primers with high interaction scores are most likely to form primer dimers. At high multiplexing it is not possible to eliminate all spurious interactions, but it is essential to remove the primers or pairs of primers with the highest interaction scores in silico as they can dominate an entire reaction, greatly limiting amplification from intended targets. We have performed this procedure to create multiplex primer sets of up to and in some cases more than 10,000 primers. The improvement due to this procedure is substantial, enabling amplification of more than 80%, more than 90%, more than 95%, more than 98%, and even more than 99% on target products as determined by sequencing of all PCR products, as compared to 10% from a reaction in which the worst primers were not removed. When combined with a partial semi-nested approach as previously described, more than 90%, and even more than 95% of amplicons may map to the targeted sequences.

Note that there are other methods for determining which PCR probes are likely to form dimers. In an embodiment, analysis of a pool of DNA that has been amplified using a non-optimized set of primers may be sufficient to determine problematic primers. For example, analysis may be done using sequencing, and those dimers which are present in the greatest number are determined to be those most likely to form dimers, and may be removed.

This method has a number of potential application, for example to SNP genotyping, heterozygosity rate determination, copy number measurement, and other targeted sequencing applications. In an embodiment, the method of primer design may be used in combination with the mini-PCR method described elsewhere in this document. In some embodiments, the primer design method may be used as part of a massive multiplexed PCR method.

The use of tags on the primers may reduce amplification and sequencing of primer dimer products. In some embodiments, the primer contains an internal region that forms a loop structure with a tag. In particular embodiments, the primers include a 5' region that is specific for a target locus, an internal region that is not specific for the target locus and forms a loop structure, and a 3' region that is specific for the target locus. In some embodiments, the loop region may lie between two binding regions where the two binding regions are designed to bind to contiguous or neighboring regions of template DNA. In various embodiments, the length of the 3' region is at least 7 nucleotides. In some embodiments, the length of the 3' region is between 7 and 20 nucleotides, such as between 7 to 15 nucleotides, or 7 to 10 nucleotides, inclusive. In various embodiments, the primers include a 5' region that is not specific for a target locus (such as a tag or a universal primer binding site) followed by a region that is specific for a target locus, an internal region that is not specific for the target locus and forms a loop structure, and a 3' region that is specific for the target locus. Tag-primers can be used to shorten necessary target-specific sequences to below 20, below 15, below 12, and even below 10 base pairs. This can be serendipitous with standard primer design when the target sequence is fragmented within the primer binding site or, or it can be designed into the primer design. Advantages of this method include: it increases the number of assays that can be designed for a certain maximal amplicon length, and it shortens the "non-informative" sequencing of primer sequence. It may also be used in combination with internal tagging (see elsewhere in this document).

In an embodiment, the relative amount of nonproductive products in the multiplexed targeted PCR amplification can be reduced by raising the annealing temperature. In cases where one is amplifying libraries with the same tag as the target specific primers, the annealing temperature can be increased in comparison to the genomic DNA as the tags will contribute to the primer binding. In some embodiments we are using considerably lower primer concentrations than previously reported along with using longer annealing times than reported elsewhere. In some embodiments the annealing times may be longer than 3 minutes, longer than 5 minutes, longer than 8 minutes, longer than 10 minutes, longer than 15 minutes, longer than 20 minutes, longer than 30 minutes, longer than 60 minutes, longer than 120 minutes, longer than 240 minutes, longer than 480 minutes, and even longer than 960 minutes. In an embodiment, longer annealing times are used than in previous reports, allowing lower primer concentrations. In various embodiments, longer than normal extension times are used, such as greater than 3, 5, 8, 10, or 15 minutes. In some embodiments, the primer concentrations are as low as 50 nM, 20 nM, 10 nM, 5 nM, 1 nM, and lower than 1 uM. This surprisingly results in robust performance for highly multiplexed reactions, for example 1,000-plex reactions, 2,000-plex reactions, 5,000-plex reactions, 10,000-plex reactions, 20,000-plex reactions, 50,000-plex reactions, and even 100,000-plex reactions. In an embodiment, the amplification uses one, two, three, four or five cycles run with long annealing times, followed by PCR cycles with more usual annealing times with tagged primers.

To select target locations, one may start with a pool of candidate primer pair designs and create a thermodynamic model of potentially adverse interactions between primer pairs, and then use the model to eliminate designs that are incompatible with other the designs in the pool.

In an embodiment, the invention features a method of decreasing the number of target loci (such as loci that may contain a polymorphism or mutation associated with a disease or disorder or an increased risk for a disease or disorder such as cancer) that need to be detected for a diagnosis and/or increasing the disease load that is detected (e.g., increasing the number of polymorphisms or mutations that are detected). In some embodiments, the method includes ranking (such as ranking from highest to lowest) loci by frequency or reoccurrence of a polymorphism or mutation (such as a single nucleotide variation, insertion, or deletion, or any of the other variations described herein) in each locus among subjects with the disease or disorder such as cancer. In some embodiments, PCR primers are designed to some or all of the loci. During selection of PCR primers for a library of primers, primers to loci that have a higher frequency or reoccurrence (higher ranking loci) are favored over those with a lower frequency or reoccurrence (lower ranking loci). In some embodiments, this parameter is included as one of the parameters in the calculation of the scores (such as the undesirability scores) described herein. If desired, primers (such as primers to high ranking loci) that are incompatible with other designs in the library can be included in a different PCR library/pool. In some embodiments, multiple libraries/pools (such as 2, 3, 4, 5 or more) are used in separate PCR reactions to enable amplification of all (or a majority) of the loci represented by all the libraries/pools. In some embodiment, this method is continued until sufficient primers are included in one or more libraries/pools such that the primers, in aggregate, enable the desired disease load to be captured for the disease or disorder (e.g., such as by detection of at least 80, 85, 90, 95, or 99% of the disease load).

In some embodiments, the library of candidate primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primers or different primer pairs. In some embodiments, only a relatively small number of candidate primers need to be removed from the library to achieve the desired reduction in primer dimers. In some embodiments, less than 30, 20, 15, 10, 5, or 2% of the candidate primers are removed from the library prior to use of the resulting library for multiplex PCR amplification of target loci. In some embodiments, a relatively large number of candidate primers are removed from the library to achieve the desired characteristics for the resulting library. In some embodiments, at least 20, 30, 40, 50, 60, 70, 80, or 90% of the candidate primers are removed from the library prior to use of the resulting library for multiplex PCR amplification of target loci. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primers or different primer pairs remain in the library (after removal of some candidate primers from the library).

After the selection process, the primers remaining in the library may be used in any of the methods of the invention.

Exemplary Methods for Determining Interaction Scores

Exemplary methods of determining a $\Delta G$ value (such as the change in Gibbs free energy for primer dimer formation) or an interaction score that indicates the likelihood of dimer formation between candidate primers are described below. In some embodiments, a thermodynamic Nearest-Neighbors approach is used to calculate the likelihood of dimer formation between any two primers (see, e.g., Rahmann and Grafe (2004), "Mean and variance of the Gibbs free energy of oligonucleotides in the nearest neighbor model under varying conditions" Bioinformatics 20, 2928-2933; Allawi, H. T. & SantaLucia, J., Jr. (1998), "Thermodynamics of Internal C-T Mismatches in DNA", *Nucleic Acids Res.* 26, 2694-2701; Peyret, N., Seneviratne, P. A., Allawi, H. T. & SantaLucia, J., Jr. (1999), "Nearest-Neighbor Thermodynamics and NMR of DNA Sequences with Internal A-A, C-C, G-G, and T-T Mismatches", *Biochemistry* 38, 3468-3477; Allawi, H. T. & SantaLucia, J., Jr. (1998), "Nearest-Neighbor Thermodynamics of Internal A-C Mismatches in DNA: Sequence Dependence and pH Effects", *Biochemistry* 37, 9435-9444.; Allawi, H. T. & SantaLucia, J., Jr. (1998), "Nearest Neighbor Thermodynamic Parameters for Internal G-A Mismatches in DNA", *Biochemistry* 37, 2170-2179; and Allawi, H. T. & SantaLucia, J., Jr. (1997), "Thermodynamics and NMR of Internal G-T Mismatches in DNA", *Biochemistry* 36, 10581-10594; MultiPLX 2.1 (Kaplinski L, Andreson R, Puurand T, Remm M. MultiPLX: automatic grouping and evaluation of PCR primers. Bioinformatics. 2005 Apr. 15; 21(8):1701-2, which are each hereby incorporated by reference in its entirety).

In some embodiments, the following steps are performed.

Step 1

Figure 33A:
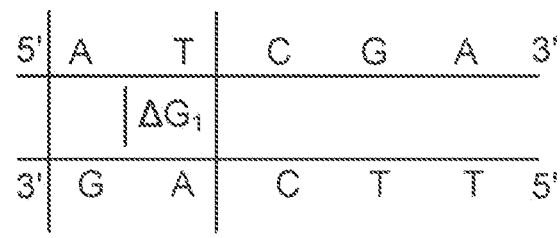
FIGS. 33A-33F: Illustrations of the calculation of an interaction score between primers in a primer library.

For each primer in a set of candidate primers, compare to every other candidate primer in the following way. Implement an ungapped thermodynamic alignment between the two primers, matching the 5' end of the first primer to the 3' end of the second primer. Taking the first two bases (dinucleotide) that align to the other primer and vice versa, determine the $\Delta H$ and $\Delta S$ values for the dinucleotide in one primer hybridizing to the dinucleotide in the other primer (see the "AT" hybridizing to "GA" in FIG. 33A). $\Delta H$ and $\Delta S$ values for various combinations of dinucleotides are known and can be determined, for example, using a thermodynamic look up table (such as the Unified NN model parameters according to Allawi and SantaLucia (1997) "Thermodynamics and NMR of internal G-T mismatches in DNA". Biochemistry, 36: 10581-10594, which is hereby incorporated by reference in its entirety). Use the $\Delta H$ and $\Delta S$ values to calculate $\Delta G$ for that interaction as follows or as described in any known equation for this.

$$\Delta G=(1000.0*\Delta H-(\text{temperature}*(\Delta S+0.368*(\text{numPhosphates}/2)*\log(\text{saltConcentration}))))/1000.0$$

Figure 33B:
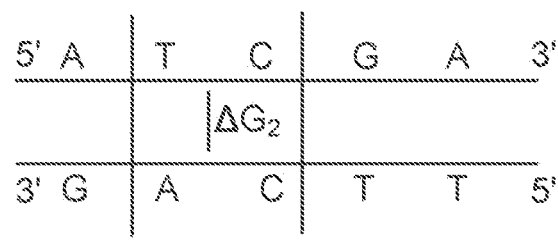

In some embodiments, one or more of the following conditions are assumed for this calculation: temperature: of 60.0° C., primer concentration of 100 nM, or salt concentration of 100 mM. In some embodiments, other conditions are assumed for this calculation, such as the conditions that will be used for multiplex PCR with the pool. Iterate over the remainder of the primer that aligns with the other primer by sliding the bases being observing one base to the right. Continue until $\Delta G$ has been calculated for all dinucleotides that align (FIG. 33B). The $\Delta G$ for that alignment of the primer pair is the sum of the $\Delta G$ values for the various dinucleotides.

Step 2

Figure 33C:
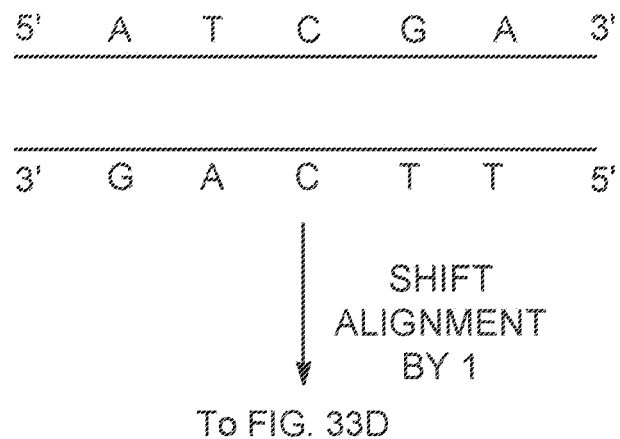
Figure 33D:
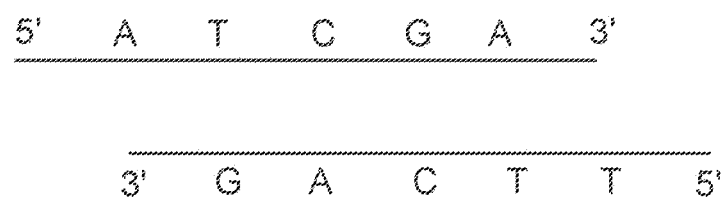

Shift the alignment of the two primers (FIGS. 33C and 33D).

Step 3

Figure 33E:
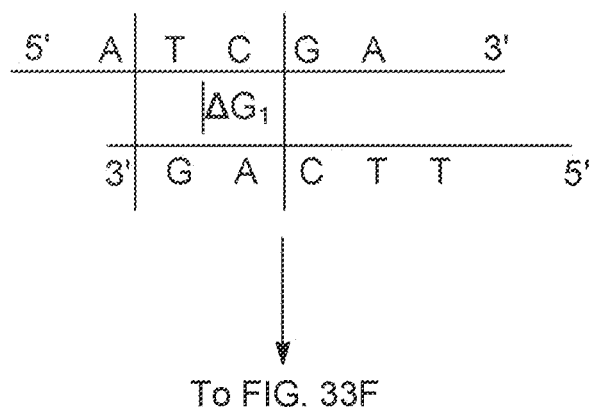
Figure 33F:
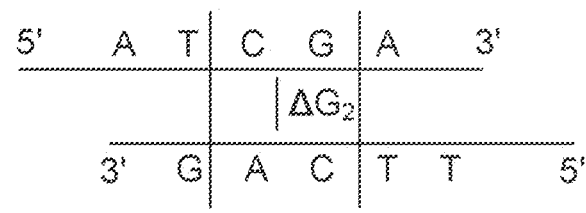

Repeat step 1 again for the new alignment (FIGS. 33E and 33F).

Step 4

After aligning all possible alignments between the two primers, determine the final ΔG value and the interaction score.

In some embodiments, the ΔG value for a combination of primers is the lowest ΔG value (the lowest numerical value, which is indicative of the greatest likelihood of primer dimer formation) out of the ΔG values for all possible alignments between the two primers. For example, if one alignment has a ΔG value of −12 kcal/mol and another alignment has a ΔG value of −2 kcal/mol then −12 kcal/mol (worse value) is used as the ΔG value for that combination of primers.

For algorithms such as the one in Experiment 16 in which it is easiest to rank primers based on assigning the worse combination of primers (those with the greatest likelihood of dimer formation) the highest interaction score, then the interaction score can be calculated as follows.

Interaction score=max(−1*ΔG value)

For example, if one alignment has a ΔG value of −12 kcal/mol and another alignment has a ΔG value of −2 kcal/mol, then 12 kcal/mol is used as the interaction score. In this case, the interaction score with the largest numerical positive number indicates the least desirable combination of primers due to the greatest likelihood of primer dimer formation.

In some embodiments, the interaction score is calculated as follows (this score weights the ΔG values depending on the number of ends that a dimer can be extended by PCR).

interaction score=max(−deltaG_2,0.8*(−deltaG_1))

where deltaG_2=Gibbs energy (energy required to break the dimer) for a dimer that is extensible by PCR on both ends, i.e., the 3' end of each primer anneals to the other primer; and deltaG_1=Gibbs energy for a dimer that is extensible by PCR on at least one end.

In some embodiments, deltaG_2 is determined by performing steps 1-4 above for all the alignments in which a dimer is extensible by PCR on both ends. The deltaG_2 value is the lowest ΔG value (the lowest numerical value, which is indicative of the greatest likelihood of primer dimer formation) for all the alignments in which a dimer is extensible by PCR on both ends.

In some embodiments, deltaG_1 is determined by performing steps 1-4 above for all the alignments in which a dimer is extensible by PCR on at least one end (such as by PCR on one end or by PCR on both ends). The deltaG_1 value is the lowest ΔG value (the lowest numerical value, which is indicative of the greatest likelihood of primer dimer formation) for all the alignments in which a dimer is extensible by PCR on at least one end.

In some embodiments, possible loop structures or gaps in alignment between primers are also considered.

In some embodiments, ΔG values from step 4 for each possible combination of two primers (each possible primer dimer) in a library are all equal to or greater than −20, −18, −16, −14, −12, −10, −9, −8, −7, −6, −5, −4, −3, −2, or −1 kcal/mol. In some embodiments, ΔG values from step 4 for at least 80, 85, 90, 92, 94, 96, 98, 99, or 100% of the primers in the library for possible combinations of that primer with other primers in the library are all equal to or greater than −20, −18, −16, −14, −12, −10, −9, −8, −7, −6, −5, −4, −3, −2, or −1 kcal/mol. In some embodiments, possible combinations of two primers in a library that have positive ΔG values are ignored since these values are indicative of no likelihood to for primer dimers. In some embodiments for the possible combination of two primers in a library that have negative ΔG values, the ΔG values are between −20 and 0 kcal/mol, such as between −15 and 0 kcal/mol, −10 and 0 kcal/mol, −8 and 0 kcal/mol, −7 and 0 kcal/mol, −6 and 0 kcal/mol, −5.5 and 0 kcal/mol, −5 and 0 kcal/mol, −4.5 and 0 kcal/mol, −4 and 0 kcal/mol, −3.5 and 0 kcal/mol, −3 and 0 kcal/mol, −2.5 and 0 kcal/mol, −2 and 0 kcal/mol, or −1.5 and 0 kcal/mol, inclusive.

In some embodiments, the interaction scores from step 4 for each possible combination of two primers in a library are all equal to or less than 20, 18, 16, 14, 12, 10, 9, 8, 7, 6, 5, 4, 3, 2, or 1 kcal/mol. In some embodiments, the interaction scores from step 4 for at least 80, 85, 90, 92, 94, 96, 98, 99, or 100% of the primers in the library for possible combinations of that primer with other primers in the library are all equal to or less than 20, 18, 16, 14, 12, 10, 9, 8, 7, 6, 5, 4, 3, 2, or 1 kcal/mol. In some embodiments, possible combination of two primers in a library that have negative interaction scores are ignored since these values are indicative of no likelihood to for primer dimers. In some embodiments for the possible combination of two primers in a library that have positive interaction scores, the interaction scores are between 20 and 0 kcal/mol, such as between 15 and 0 kcal/mol, 10 and 0 kcal/mol, 8 and 0 kcal/mol, 7 and 0 kcal/mol, 6 and 0 kcal/mol, 5.5 and 0 kcal/mol, 5 and 0 kcal/mol, 4.5 and 0 kcal/mol, 4 and 0 kcal/mol, 3.5 and 0 kcal/mol, 3 and 0 kcal/mol, 2.5 and 0 kcal/mol, 2 and 0 kcal/mol, or 1.5 and 0 kcal/mol, inclusive.

In some embodiments, the score (such as the undesirability score) for candidate primers is based at least in part on the ΔG value or the interaction score that indicates the likelihood of dimer formation between candidate primers as calculated using any of these methods.

Exemplary Primer Libraries

In one aspect, the invention features libraries of primers, such as primers selected from a library of candidate primers using any of the methods of the invention. In some embodiments, the library includes primers that simultaneously hybridize (or are capable of simultaneously hybridizing) to or that simultaneously amplify (or are capable of simultaneously amplifying) at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci in one reaction volume. In various embodiments, the library includes primers that simultaneously amplify (or are capable of simultaneously amplifying) between 1,000 to 2,000; 2,000 to 5,000; 5,000 to 7,500; 7,500 to 10,000; 10,000 to 20,000; 20,000 to 25,000; 25,000 to 30,000; 30,000 to 40,000; 40,000 to 50,000; 50,000 to 75,000; or 75,000 to 100,000 different target loci in one reaction volume, inclusive. In various embodiments, the library includes primers that simultaneously amplify (or are capable of simultaneously amplifying) between 1,000 to 100,000 different target loci in one reaction volume, such as between 1,000 to 50,000; 1,000 to 30,000; 1,000 to 20,000; 1,000 to 10,000; 2,000 to 30,000; 2,000 to 20,000; 2,000 to 10,000; 5,000 to 30,000; 5,000 to 20,000; or 5,000 to 10,000 different target loci, inclusive. In some embodiments, the library includes primers that simultaneously amplify (or are capable of simultaneously amplifying) the target loci in one reaction volume such that less than 60, 40, 30, 20, 10, 5, 4, 3, 2, 1, 0.5, 0.25, 0.1, or 0.5% of the amplified products are primer dimers. The various embodiments, the amount of amplified products that are primer dimers is between 0.5 to 60%, such as between 0.1 to 40%, 0.1 to 20%, 0.25 to 20%, 0.25 to 10%, 0.5 to 20%, 0.5 to 10%, 1 to 20%, or 1 to 10%, inclusive. In some embodiments, the primers simultaneously amplify (or are capable of simultaneously amplifying) the target loci in one reaction volume such that at least 50, 60, 70, 80, 90, 95, 96, 97, 98, 99, or 99.5% of the amplified products are target amplicons. In various embodiments, the amount of amplified products that are target amplicons is between 50 to 99.5%, such as between 60 to 99%, 70 to 98%, 80 to 98%, 90 to 99.5%, or 95 to 99.5%, inclusive. In some embodiments, the primers simultaneously amplify (or are capable of simultaneously amplifying) the target loci in one reaction volume such that at least 50, 60, 70, 80, 90, 95, 96, 97, 98, 99, or 99.5% of the target loci are amplified. In various embodiments, the amount target loci that are amplified is between 50 to 99.5%, such as between 60 to 99%, 70 to 98%, 80 to 99%, 90 to 99.5%, 95 to 99.9%, or 98 to 99.99% inclusive. In some embodiments, at least 50, 60, 70, 80, 90, 95, 96, 97, 98, 99, or 99.5% of the target loci are amplified at least 5, 10, 20, 40, 50, 60, 80, 100, 120, 150, 200, 300, or 400-fold. In some embodiments, the library of primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 primer pairs, wherein each pair of primers includes a forward test primer and a reverse test primer where each pair of test primers hybridize to a target locus. In some embodiments, the library of primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 individual primers that each hybridize to a different target locus, wherein the individual primers are not part of primer pairs.

In some embodiments, the library includes primers (such as at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primers or different primer pairs) that simultaneously amplify (or are capable of simultaneously amplifying) the target loci (such as at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci) in one reaction volume such that one or more of the following: (i) less than 60, 40, 30, 20, 10, 5, 4, 3, 2, 1, 0.5, 0.25, 0.1, or 0.5% of the amplified products are primer dimers, (ii) at least 50, 60, 70, 80, 90, 95, 96, 97, 98, 99, or 99.5% of the amplified products are target amplicons, (iii) at least 50, 60, 70, 80, 90, 95, 96, 97, 98, 99, or 99.5% of the target loci are amplified, (iv) at least 50, 60, 70, 80, 90, 95, 96, 97, 98, 99, or 99.5% of the target loci are amplified at least 5, 10, 20, 40, 50, 60, 80, 100, 120, 150, 200, 300, or 400-fold, (v) at least 60, 70, 80, 90, 95, 96, 97, 98, 99, 99.5, or 100% of the amplified products map to the human genome, or (vi) any combination thereof.

In some embodiments, the library includes at least 1,000 different primers or different primer pairs (such as at least 2,000; 5,000; 7,500; 10,000; 15,000; 19,000; 20,000; 25,000; 27,000; 28,000; 30,000; 40,000; 50,000; 75,000; or 100,000 different primers or different primer pairs) that simultaneously amplify (or are capable of simultaneously amplifying) at least 1,000 different target loci (such as at least 2,000; 5,000; 7,500; 10,000; 15,000; 19,000; 20,000; 25,000; 27,000; 28,000; 30,000; 40,000; 50,000; 75,000; or 100,000 different target loci) in one reaction volume such that one or more of the following: (i) less than 60% of the amplified products are primer dimers and at least 40% of the amplified products are target amplicons, (ii) less than 40% of the amplified products are primer dimers and at least 60% of the amplified products are target amplicons, (iii) less than 20% of the amplified products are primer dimers and at least 80% of the amplified products are target amplicons, (iv) less than 10% of the amplified products are primer dimers and at least 90% of the amplified products are target amplicons, or (v) less than 5% of the amplified products are primer dimers and at least 95% of the amplified products are target amplicons. In some embodiments for the amplification of nucleic acids (such as DNA or RNA) from a single cell (such as a fetal or embryonic cell), the library includes at least 1,000 different primers or different primer pairs (such as at least 2,000; 5,000; 7,500; 10,000; 15,000; 19,000; 20,000; 25,000; 27,000; 28,000; 30,000; 40,000; 50,000; 75,000; or 100,000 different primers or different primer pairs) that simultaneously amplify (or are capable of simultaneously amplifying) at least 1,000 different target loci (such as at least 2,000; 5,000; 7,500; 10,000; 15,000; 19,000; 20,000; 25,000; 27,000; 28,000; 30,000; 40,000; 50,000; 75,000; or 100,000 different target loci) in one reaction volume such that one or more of the following: (i) less than 60% of the amplified products are primer dimers and at least 10% of the amplified products are target amplicons, (ii) less than 40% of the amplified products are primer dimers and at least 10% of the amplified products are target amplicons, (iii) less than 20% of the amplified products are primer dimers and at least 10% of the amplified products are target amplicons, (iv) less than 10% of the amplified products are primer dimers and at least 10% of the amplified products are target amplicons, (v) less than 5% of the amplified products are primer dimers and at least 15% of the amplified products are target amplicons; (vi) less than 60% of the amplified products are primer dimers and at least 20% of the amplified products are target amplicons, (vii) less than 40% of the amplified products are primer dimers and at least 20% of the amplified products are target amplicons, (viii) less than 20% of the amplified products are primer dimers and at least 20% of the amplified products are target amplicons, (ix) less than 10% of the amplified products are primer dimers and at least 20% of the amplified products are target amplicons, (x) less than 5% of the amplified products are primer dimers and at least 20% of the amplified products are target amplicons; (xi) less than 60% of the amplified products are primer dimers and at least 40% of the amplified products are target amplicons, (xii) less than 40% of the amplified products are primer dimers and at least 40% of the amplified products are target amplicons, (xiii) less than 20% of the amplified products are primer dimers and at least 40% of the amplified products are target amplicons, (xiv) less than 10% of the amplified products are primer dimers and at least 40% of the amplified products are target amplicons, (xv) less than 5% of the amplified products are primer dimers and at least 45% of the amplified products are target amplicons; (xvi) less than 40% of the amplified products are primer dimers and at least 60% of the amplified products are target amplicons, (xvii) less than 20% of the amplified products are primer dimers and at least 80% of the amplified products are target amplicons, (xviii) less than 10% of the amplified products are primer dimers and at least 90% of the amplified products are target amplicons, or (xviiii) less than 5% of the amplified products are primer dimers and at least 95% of the amplified products are target amplicons. In some embodiments, at least 50, 60, 70, 80, 90, 95, 96, 97, 98, 99, or 99.5% of the target loci are amplified at least 5, 10, 20, 40, 50, 60, 80, 100, 120, 150, 200, 300, or 400-fold. In some embodiments, one or more of these embodiments (e.g., percent of primer dimers, target amplicons, or amplified target loci) is achieved after greater than or equal to 5, 10, 20, 30, 40, 50, or 60 cycles of PCR are performed. In some embodiments for a library that amplifies human target loci, at least 60, 70, 80, 90, 95, 96, 97, 98, 99, 99.5, or 100% of the amplified products map to the human genome.

In various embodiments, the concentration of each primer is less than 100, 75, 50, 25, 20, 10, 5, 2, 1, 0.5, 0.1, or 0.05 nM, or less than 500, 100, 10, or 1 uM. In various embodiments, the concentration of each primer is between 1 uM to 100 nM, such as between 1 uM to 1 nM, 1 to 75 nM, 1 to 20 nM, 1 to 10 nM, 2 to 50 nM or 5 to 50 nM, inclusive. In some embodiments, the concentration of one or more universal primers is between 0.2 to 3 µM, such as between 0.5 and 2.5 µM, 0.5 to 1 µM, or 1 to 2.5 µM per primer, inclusive, and the concentration of each primer except the universal primer(s) is between 1 uM to 100 nM, such as between 1 uM to 1 nM, 1 to 75 nM, 1 to 20 nM, 1 to 10 nM, 2 to 50 nM or 5 to 50 nM, inclusive. In various embodiments, the GC content of the primers is between 30 to 80%, such as between 20 to 70%, 40 to 70%, or 50 to 60%, inclusive. In some embodiments, the range of GC content of the primers is less than 30, 20, 10, or 5%. In some embodiments, the range of GC content of the primers is between 5 to 30%, such as 5 to 20% or 5 to 10%, inclusive. In some embodiments, there is a high GC content in the 3' end of the primers. In some embodiments, there are at least 2 (such as 3, 4, or 5) guanines or cytosines in the last 5 bases at the 3' end of the primers. In some embodiments, there are at least 1 (such as 2 or 3) guanines or cytosines in the last 3 bases at the 3' end of the primers. In some embodiments, a maximum of 2 (such as 2, 1, or 0) bases in the last 5 bases at the 3' end of the primers are guanines or cytosines. In some embodiments, a maximum of 1 (such as 1 or 0) base in the last 5 bases at the 3' end of the primers is a guanine or cytosine. In some embodiments, the maximum length of a homopolymer (the same base in a row) in the primers is 12, 10, 8, 6, 5, 4, 3, or 2 consecutive nucleotides. In some embodiments, the melting temperature ($T_m$) of the test primers is between 40 to 80° C., such as 50 to 70° C., 55 to 65° C., 54 to 60.5° C., or 57 to 60.5° C., inclusive. In some embodiments, the $T_m$ is calculated using the Primer3 program (libprimer3 release 2.2.3) using the built-in SantaLucia parameters (the world wide web at primer3.sourceforge.net). In some embodiments, the range of melting temperature of the primers is less than 15, 10, 5, 3, or 1° C. In some embodiments, the range of melting temperature of the primers is between 1 to 15° C., such as between 1 to 10° C., 1 to 5° C., or 1 to 3° C., inclusive. In some embodiments, the range of melting temperatures of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the primers is between 1 to 15° C., such as between 1 to 10° C., 1 to 5° C., 1 to 3° C., 2 to 5° C., 3 to 10° C., or 3 to 5° C., inclusive. In some embodiments, the length of the primers is between 15 to 100 nucleotides, such as between 15 to 75 nucleotides, 15 to 40 nucleotides, 17 to 35 nucleotides, 18 to 30 nucleotides, 20 to 65 nucleotides, inclusive. In some embodiments, the range of the length of the primers is less than 50, 40, 30, 20, 10, or 5 nucleotides. In some embodiments, the range of the length of the primers is between 5 to 50 nucleotides, such as 5 to 40 nucleotides, 5 to 20 nucleotides, or 5 to 10 nucleotides, inclusive. In some embodiments, the length of the target amplicons is between 50 and 100 nucleotides, such as between 60 and 80 nucleotides, or 60 to 75 nucleotides, inclusive. In some embodiments, the length of the target amplicons is between 30 and 400 nucleotides, such as between 30 and 200 nucleotides, or 100 and 400 nucleotides, inclusive. In some embodiments, the length of the target amplicons is at least 100; 200; 300; 400; 500; 600; 700; 800; 900; 1,000; 1,200; 1,500; 2,000; or 3,000 nucleotides. In some embodiments, the length of the target amplicons is between 100 and 1,500 nucleotides, such as between 100 to 1,000; 100 to 500, 500 to 750, or 750 to 1,000 nucleotides, inclusive. Longer amplicons may be desirable, e.g., for applications in which is it desirable to screen for multiple potential mutations in one amplicon, such as carrier screening. In some embodiments, one round of PCR is performed to produce relatively long amplicons (such as at least 250 or 500 nucleotides in length) and then a second round of PCR is performed to produce shorter amplicons (to amplify regions within the amplicons amplified in the first round of PCR, such as regions of less than 200 or 100 nucleotides in length). In some embodiments, the range of the length of the target amplicons is less than 50, 25, 15, 10, or 5 nucleotides. In some embodiments, the range of the length of the target amplicons is between 5 to 50 nucleotides, such as 5 to 25 nucleotides, 5 to 15 nucleotides, or 5 to 10 nucleotides, inclusive. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 or all of the target amplicons have a length that falls within the range of the average length of the amplicons ±5% of the average length, average length ±20%, average length ±20%, or average length ±30%, or average length ±50%.

In some embodiments, library includes at least at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primers that each includes a target specific sequence, such as a sequence that binds a target locus but does not substantially bind to other nucleic acids (such as non-target loci) in a sample, e.g., a biological sample, which naturally includes other nucleic acids. In some embodiments, each primer binds and amplifies a target locus by at least 2, 4, 6, 8, 10, 20, 50-fold or more than one or more (or all) other nucleic acids (such as non-target loci) in a sample. In some embodiments, the library includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target specific primers (e.g., primers that are specific for a target locus). In some embodiments, part or all of the polynucleotide sequence is a non-random sequence for at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primers in the library. In some embodiments, library also includes a universal primer, a random primer, a primer with a non-naturally occurring polynucleotide sequence, or a primer with a polynucleotide sequence not naturally found in a human. In some embodiments, the universal or random primer has a non-naturally occurring polynucleotide sequence or a polynucleotide sequence not naturally found in a human.

In some embodiments, the composition includes at least one primer (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers) with a polynucleotide sequence of a human nucleic acid and at least one primer (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers) with a polynucleotide sequence that is not found in a human (such as a universal primer, a primer that comprises a region or consists entirely of random nucleotides, or a primer with a region such as a tag or barcode of one or more nucleotides that are not found in a human or are not found in nature as part of the polynucleotide sequence of the primer). In some embodiments, at least one primer (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers) includes a region of one or more nucleotides that is not naturally part of the primer sequence (such as a region added to the 5' end of the target specific sequence in the primer or an internal region added between the 5' and 3' ends of the primer). In some embodiments, the primer is free of the nucleic acids (such as genes) which, in the naturally-occurring genome of the organism from which the nucleic acid of the invention is derived, flank the gene. In some embodiments, the primer has been separated from one or more components that naturally accompany the corresponding sequence in nature (such as in the genome of a human). Typically, each primer is at least 90, 95, 98, 99, 99.9, or 100%, by weight, free from the molecules (such as proteins, nucleic acids, and naturally-occurring organic molecules) that naturally accompany the corresponding sequence in nature (such as in the genome of a human). Purity can be assayed by any appropriate method, e.g., by electrophoresis or HPLC analysis.

In some embodiments, the primers in the library are not immobilized (such as not immobilized to a solid support) or not part of a microarray. In some embodiments, the primers are dissolved in solution (such as dissolved in the liquid phase). In some embodiments, the library comprises a microarray. In some embodiments, the amplified products are detected using an array, such as an array with probes to one or more chromosomes of interest (e.g., chromosome 13, 18, 21, X, Y, or any combination thereof).

In some embodiments, at least one of the primers (such as at least 20, 40, 80, 90, 95, 98, 99, 99.5, or 100% of the primers) in a library are nucleic acid analogs that have a lower likelihood of primer dimerization compared to the naturally-occurring nucleic acids (see, e.g., U.S. Pat. Nos. 7,414,118 and 6,001,611; which are each hereby incorporated by reference in its entirety). Exemplary nucleic acid analogs have a modified pyrimidine nucleobase, or a purine or pyrimidine base that contains an exocyclic amine.

In some embodiments, the primer library includes a small number of primers (such as less than 5, 2, 1, or 0.5% of the primers in the library) that do not have one or more of the properties described herein. In various embodiments, at least 80, 90, 95, 96, 97, 98, 99, 99.5, or 100% of the primers in the library have one or more of the following properties: (i) $\Delta G$ values for possible combinations of that primer with other primers in the library are all equal to or greater than −20, −18, −16, −14, −12, −10, −9, −8, −7, −6, −5, −4, −3, −2, or −1 kcal/mol; (ii) $\Delta G$ values for the possible combination of that primer with other primers in the library that have negative $\Delta G$ are between −20 and 0 kcal/mol, such as between −15 and 0 kcal/mol, −10 and 0 kcal/mol, −8 and 0 kcal/mol, −7 and 0 kcal/mol, −6 and 0 kcal/mol, −5.5 and 0 kcal/mol, −5 and 0 kcal/mol, −4.5 and 0 kcal/mol, −4 and 0 kcal/mol, −3.5 and 0 kcal/mol, −3 and 0 kcal/mol, −2.5 and 0 kcal/mol, −2 and 0 kcal/mol, or −1.5 and 0 kcal/mol, inclusive; (iii) the GC content is between 30 to 80%, such as between 20 to 70%, 40 to 70%, or 50 to 60%, inclusive; (iv) the range of GC content is less than 30, 20, 10, or 5% or the range of GC content of the primers is between 5 to 30%, such as 5 to 20%, or 5 to 10%, inclusive; (v) a maximum of 2 (such as 2, 1, or 0) bases in the last 5 bases at the 3' end of the primers are guanines or cytosines; (vi) the melting temperature ($T_m$) of the primers is between 40 to 80° C., such as 50 to 70° C., 55 to 65° C., 54 to 60.5° C., or 57 to 60.5° C., inclusive; (vii) the range of melting temperature of the primers is less than 15, 10, 5, 3, or 1° C.; (viii) the range of melting temperature of the primers is between 1 to 15° C., such as between 1 to 10° C., 1 to 5° C., 1 to 3° C., 2 to 5° C., 3 to 10° C., or 3 to 5° C., inclusive; (ix) the length of the primers is between 15 to 100 nucleotides, such as between 15 to 75 nucleotides, 15 to 40 nucleotides, 17 to 35 nucleotides, 18 to 30 nucleotides, or 20 to 65 nucleotides, inclusive; (x) the range of the length of the primers is less than 50, 40, 30, 20, 10, or 5 nucleotides; (xi) the range of the length of the primers is between 5 to 50 nucleotides, such as 5 to 40 nucleotides, 5 to 20 nucleotides, or 5 to 10 nucleotides, (xii) the length of the target amplicons is between 50 and 100 nucleotides, such as between 60 and 80 nucleotides, or 60 to 75 nucleotides; (xiii) the length of the target amplicons is between 30 and 400 nucleotides, such as between 30 and 200 nucleotides, or 100 and 400 nucleotides; (xiv) the range of the length of the target amplicons is less than 50, 25, 15, 10, or 5 nucleotides; (xv) the range of the length of the target amplicons is between 5 to 50 nucleotides, such as 5 to 25 nucleotides, 5 to 15 nucleotides, or 5 to 10 nucleotides; (xvi) the maximum length of a homopolymer in the primers is 12, 10, 8, 6, 5, 4, 3, or 2 consecutive nucleotides; (xvii) the concentration of each primer is less than 100, 75, 50, 25, 20, 10, 5, 2, 1, 0.5, 0.1, or 0.05 nM, or less than 500, 100, 10, or 1 uM; (xviii) the concentration of each primer is between 1 uM to 100 nM, such as between 1 uM to 1 nM, 1 to 75 nM, 1 to 20 nM, 1 to 10 nM, 2 to 50 nM, or 5 to 50 nM, inclusive; (xix) at least 80, 90, 92, 94, 96, 98, 99, or 100% of the molecules of that primer are extended to form amplified products; (xx) SNPs (if any) are not in the last 5 nucleotides in the 3' end of the candidate primer; (xxi) the target bases (the bases of interest in a target locus) are near an end (the 3' or 5' end) of the amplicon; (xxii) the region of hybridization is separated from the polymorphic site by a small number of bases, where the small number is selected from the group consisting of 1, 2, 3, 4, 5, 6 to 10, 11 to 15, 16 to 20, 21 to 25, 26 to 30, and 31 to 60; (xxiii) the length of the annealing step is greater than 1, 3, 5, 8, 10, 15, 20, 30, 45, 60, 75, 90, 120, 150, or 180 minutes, (xxiv) the length of the annealing step (per PCR cycle) is between 5 and 180 minutes, such as 5 to 60, 10 to 60, 5 to 30, or 10 to 30 minutes, inclusive, (xxv) the length of the annealing step is greater than 5 minutes (such greater than 10, or 15 minutes), and the concentration of each primer is less than 20 nM, (xxvi) the length of the annealing step is greater than 5 minutes (such greater than 10, or 15 minutes), and the concentration of each primer is between 1 to 20 nM, or 1 to 10 nM, inclusive; (xxvii) the length of the annealing step is greater than 20 minutes (such as greater than 30, 45, 60, or 90 minutes), and the concentration of each primer is less than 1 nM; (xxviii) the annealing temperature is at least 1, 2, 3, 4, 5, 6, 7, 8, 9, 10, 11, 12, 13, or 15° C. greater than the melting temperature (such as the empirically measured or calculated $T_m$) of the primers; (xxix) the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the melting temperature (such as the empirically measured or calculated $T_m$) of the primers; (xxx) the annealing temperature is at least 1, 2, 3, 4, 5, 6, 7, 8, 9, 10, 11, 12, 13, or 15° C. greater than the highest melting temperature of the primers; (xxxi) the annealing temperature is at least 1, 2, 3, 4, 5, 6, 7, 8, 9, 10, 11, 12, 13, or 15° C. greater than the average melting temperature of the primers, (xxxii) the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the average melting temperature of the primers; and (xxviii) any combination thereof. In various embodiments, at least 80, 90, 95, 96, 97, 98, 99, 99.5, or 100% of the primers in the library have one or more of the following properties: (i) ΔG values for possible combinations of that primer with other primers in the library are all equal to or greater than −20, −18, −16, −14, −12, −10, −9, −8, −7, −6, −5, −4, −3, −2, or −1 kcal/mol; (ii) ΔG values for the possible combination of that primer with other primers in the library that have negative ΔG are between −20 and 0 kcal/mol, such as between −15 and 0 kcal/mol, −10 and 0 kcal/mol, −8 and 0 kcal/mol, −7 and 0 kcal/mol, −6 and 0 kcal/mol, −5.5 and 0 kcal/mol, −5 and 0 kcal/mol, −4.5 and 0 kcal/mol, −4 and 0 kcal/mol, −3.5 and 0 kcal/mol, −3 and 0 kcal/mol, −2.5 and 0 kcal/mol, −2 and 0 kcal/mol, or −1.5 and 0 kcal/mol, inclusive; (iii) the melting temperature ($T_m$) of the primers is between 40 to 80° C., such as 50 to 70° C., 55 to 65° C., 54 to 60.5° C., or 57 to 60.5° C., inclusive; (iv) the range of melting temperature of the primers is less than 15, 10, 5, 3, or 1° C.; (v) the range of melting temperature of the primers is between 1 to 15° C., such as between 1 to 10° C., 1 to 5° C., 1 to 3° C., 2 to 5° C., 3 to 10° C., or 3 to 5° C., inclusive; (vi) the length of the target amplicons is between 50 and 100 nucleotides, such as between 60 and 80 nucleotides, or 60 to 75 nucleotides; (vii) the length of the target amplicons is between 30 and 400 nucleotides, such as between 30 and 200 nucleotides, or 100 and 400 nucleotides; (viii) the range of the length of the target amplicons is less than 50, 25, 15, 10, or 5 nucleotides; (ix) the range of the length of the target amplicons is between 5 to 50 nucleotides, such as 5 to 25 nucleotides, 5 to 15 nucleotides, or 5 to 10 nucleotides; (x) the concentration of each primer is less than 100, 75, 50, 25, 20, 10, 5, 2, 1, 0.5, 0.1, or 0.05 nM, or less than 500, 100, 10, or 1 uM; (xi) the concentration of each primer is between 1 uM to 100 nM, such as between 1 uM to 1 nM, 1 to 75 nM, 1 to 20 nM, 1 to 10 nM, 2 to 50 nM, or 5 to 50 nM, inclusive; (xii) the annealing temperature is at least 1, 2, 3, 4, 5, 6, 7, 8, 9, 10, 11, 12, 13, or 15° C. greater than the melting temperature (such as the empirically measured or calculated $T_m$) of the primers; (xiii) the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the melting temperature (such as the empirically measured or calculated $T_m$) of the primers; (xiv) the annealing temperature is at least 1, 2, 3, 4, 5, 6, 7, 8, 9, 10, 11, 12, 13, or 15° C. greater than the highest melting temperature of the primers; (xv) the annealing temperature is at least 1, 2, 3, 4, 5, 6, 7, 8, 9, 10, 11, 12, 13, or 15° C. greater than the average melting temperature of the primers, (xvi) the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the average melting temperature of the primers; and (xvii) any combination thereof.

In various embodiments, at least 80, 90, 95, 96, 97, 98, 99, 99.5, or 100% of the primers in the library have one or more of the following properties: (i) ΔG values for possible combinations of that primer with other primers in the library are all equal to or greater than −10 kcal/mol, (ii) the range of melting temperature of the primers is between 1 to 15° C., (iii) the length of the target amplicons is between 50 and 100 nucleotides, (iv) the concentration of each primer is less than 20 nM, (v) the length of the annealing step is greater than 5 minutes (such as greater than 10 minutes), (vi) the length of the annealing step is greater than 5 minutes (such greater than 10 minutes), and the concentration of each primer is less than 20 nM, and (vii) any combination thereof. In various embodiments, at least 80, 90, 95, 96, 97, 98, 99, 99.5, or 100% of the primers in the library have the following properties: (i) ΔG values for possible combinations of that primer with other primers in the library are all equal to or greater than −10 kcal/mol and (ii) the range of melting temperature of the primers is between 1 to 15° C. In various embodiments, at least 80, 90, 95, 96, 97, 98, 99, 99.5, or 100% of the primers in the library have the following properties: (i) the length of the target amplicons is between 50 and 100 nucleotides, and (ii) the concentration of each primer is less than 20 nM. In various embodiments, at least 80, 90, 95, 96, 97, 98, 99, 99.5, or 100% of the primers in the library have the following properties: (i) the length of the target amplicons is between 50 and 100 nucleotides and (ii) the length of the annealing step is greater than 5 minutes (such as greater than 10 minutes). In various embodiments, at least 80, 90, 95, 96, 97, 98, 99, 99.5, or 100% of the primers in the library have the following properties: (i) the length of the target amplicons is between 50 and 100 nucleotides, (ii) the length of the annealing step is greater than 5 minutes (such greater than 10 minutes), and (iii) the concentration of each primer is less than 20 nM, and (vii) any combination thereof.

In various embodiments, at least 80, 90, 95, 96, 97, 98, 99, 99.5, or 100% of the primers in the library have one or more of the following properties: (i) the annealing temperature is at least 5° C. (such as at least 6, 8, or 10° C.) greater than the melting temperature (such as the empirically measured or calculated $T_m$) of the primers; (ii) the annealing temperature is between 5 and 15° C., inclusive greater than the melting temperature of the primers; (iii) the annealing temperature is at least 5° C. (such as at least 6, 8, or 10° C.) greater than the highest melting temperature of the primers; (iv) the annealing temperature is at least 5° C. (such as at least 6, 8, or 10° C.) greater than the average melting temperature of the primers, (v) the annealing temperature is between 4 and 15° C. inclusive greater than the average melting temperature of the primers; and (vi) any combination thereof. In various embodiments, at least 80, 90, 95, 96, 97, 98, 99, 99.5, or 100% of the primers in the library have one or more of the following properties: (i) the annealing temperature is at least 5° C. (such as at least 6, 8, or 10° C.) greater than the melting temperature (such as the empirically measured or calculated $T_m$) of the primers and the length of the annealing step is greater than 5 minutes (such greater than 10 minutes); (ii) the annealing temperature is between 5 and 15° C., inclusive greater than the melting temperature of the primers and the length of the annealing step is greater than 5 minutes (such greater than 10 minutes); (iii) the annealing temperature is at least 5° C. (such as at least 6, 8, or 10° C.) greater than the highest melting temperature of the primers and the length of the annealing step is greater than 5 minutes (such greater than 10 minutes); (iv) the annealing temperature is at least 5° C. (such as at least 6, 8, or 10° C.) greater than the average melting temperature of the primers and the length of the annealing step is greater than 5 minutes (such greater than 10 minutes), (v) the annealing temperature is between 4 and 15° C. inclusive greater than the average melting temperature of the primers and the length of the annealing step is greater than 5 minutes (such greater than 10 minutes); and (vii) any combination thereof. In some embodiments, the guanine-cytosine (GC) content of the primers is between 30% and 80%, inclusive; the range of melting temperatures of the primers is less than 5° C.; and the length of the primers is between 15 to 75 nucleotides, inclusive;

In some embodiments, some (such as at least 80, 90, or 95%) or all of the adaptors or primers include one or more linkages between adjacent nucleotides other than a naturally-occurring phosphodiester linkage. Examples of such linkages include phosphoramide, phosphorothioate, and phosphorodithioate linkages. In some embodiments, some (such as at least 80, 90, or 95%) or all of the adaptors or primers include a thiophosphate (such as a monothiophosphate) between the last 3' nucleotide and the second to last 3' nucleotide. In some embodiments, some (such as at least 80, 90, or 95%) or all of the adaptors or primers include a thiophosphate (such as a monothiophosphate) between the last 2, 3, 4, or 5 nucleotides at the 3' end. In some embodiments, some (such as at least 80, 90, or 95%) or all of the adaptors or primers include a thiophosphate (such as a monothiophosphate) between at least 1, 2, 3, 4, or 5 nucleotides out of the last 10 nucleotides at the 3' end. In some embodiments, such primers are less likely to be cleaved or degraded, such primers may be desirable if a polymerase with proof-reading ability is used (to reduce or prevent the polymerase from removing nucleotides from the primers). In some embodiments, any of the embodiments involving primers with at least one linkage other than a naturally-occurring phosphodiester linkage are used with a polymerase having proof-reader activity. In some embodiments, the primers do not contain an enzyme cleavage site (such as a protease cleavage site). In some embodiments, equal to or greater than 1, 10, 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 primers in the library are non-naturally occurring nucleic acids (such nucleic acids with one or more linkages between adjacent nucleotides other than a naturally-occurring phosphodiester linkage).

In some embodiments, the primers have any combination of two or more of the aspects or embodiments disclosed herein.

These primer libraries can be used in any of the methods of the invention.

Exemplary Primers

The primer design methods of the invention have been used to generate several exemplary primer libraries to human target loci. For example, the primer design methods of the invention were used to generate the primer libraries shown in FIG. 34 (SEQ ID NOs. 1-3,600), FIG. 35 (SEQ ID NOs. 3,601-11,658), and FIG. 36 (SEQ ID NOs 11,659-44,610). Each of these libraries is composed of three primers (one each from pool A, pool B, and pool C in the same row of each figure) per target locus for 1,200; 2,686; or 10,984 different target loci, respectively. The methods of the invention can also be used to generate libraries to non-human target loci.

For an experiment using the 2,686-plex library FIG. 35 (SEQ ID NOs. 3,601-11,658) for multiplex PCR followed by sequencing, the percent of the amplified products that were primer dimers was 11.13%, the median depth of read per target that was amplified was 799.5× coverage, the percent of amplified products that were target amplicons out of the amplified products that were not primer dimers was 93.15% (this is the percent of on target reads when reads for amplified primer dimers are ignored); the number of target loci that were not amplified (failed assay count) was 246; the percent of target loci that were not amplified (failed assay percentage) was 9.16%; the percent of target loci that were amplified was 90.84%; and the total number of reads was 2,522,742. For this primer library, the ΔG values for each possible combination of two primers (each possible primer dimer) in the library are all equal to or greater than −3.86 kcal/mol. This −3.86 kcal/mol value was used as a threshold value to select candidate primer that all had a value equal to or greater than (more desirable than) this value from an initial library of candidate primers.

For an experiment using the 10,984-plex library FIG. 36 (SEQ ID NOs 11,659-44,610). for multiplex PCR followed by sequencing, the percent of the amplified products that were primer dimers was 5.50%, the median depth of read per target that was amplified was 1,286.5× coverage, the percent of amplified products that were target amplicons out of the amplified products that were not primer dimers was 60.16% (this is the percent of on target reads when reads for amplified primer dimers were ignored); the number of target loci that were not amplified (failed assay count) was 3,712; the percent of target loci that were not amplified (failed assay percentage) was 33.79%; the percent of target loci that were amplified was 66.21%; and the total number of reads was 25,372,858.

For an experiment using the 1,200-plex library FIG. 34 (SEQ ID NOs. 1-3,600), for multiplex PCR of a sample of only a single cell followed by sequencing, the percent of the amplified products that were primer dimers was 24.13%. This library has primers to human target loci on chromosome 1, chromosome 21, and the X chromosome. For chromosomes 1 and 21, the median depth of read per target that was amplified was 436× coverage; the percent of target loci that were not amplified (failed assay percentage) was 32.69%; and the percent of target loci that were amplified was 67.31%. The total number of reads was 808,106.

The primer design methods of the invention were also used to generate a library for ~11,000 different target loci (such as amplifying 10,732 different target human loci using 10,732 different primer pairs). For an experiment using this library for multiplex PCR followed by sequencing, the percent of the amplified products that were primer dimers was 14.75%, the median depth of read per target that was amplified was 72.27× coverage, the percent of the amplified products that were target amplicons was 84.32%; the number of target loci that were not amplified (failed assay count) was 118; the percent of target loci that were not amplified (failed assay percentage) was 1.10%; the percent of target loci that were amplified was 98.9%; and the total number of reads was 6,345,782. For this primer library, the ΔG values for each possible combination of two primers (each possible primer dimer) in the library are all equal to or greater than −4.28 kcal/mol. This −4.28 kcal/mol value was used as a threshold value to select candidate primer that all had a value equal to or greater than (more desirable than) this value from an initial library of candidate primers. For the initial candidate primers that were used to select primers for this library, the following interaction cost histogram shows the number of candidate primers for each of the following ranges of ΔG values. This illustrates how the values for the candidate primers compares to the −4.28 kcal/mol threshold value for the final library.

0 to −0.497 kcal/mol: 88357
−0.497 to −0.993 kcal/mol: 30529

−0.993 to −1.49 kcal/mol: 7862
−1.49 to −1.99 kcal/mol: 2639
−1.99 to −2.48 kcal/mol: 1086
−2.48 to −2.98 kcal/mol: 393
−2.98 to −3.48 kcal/mol: 148
−3.48 to −3.97 kcal/mol: 58
−3.97 to −4.47 kcal/mol: 18
−4.47 to −4.97 kcal/mol: 4
−4.97 to −5.46 kcal/mol: 3
−5.46 to −5.96 kcal/mol: 0
−5.96 to −6.46 kcal/mol: 2
−6.46 to −6.95 kcal/mol: 3

The primer design methods of the invention were also used to generate a library for ~14,000 different target loci (such as amplify 13,392 different target human loci with 13,392 different primer pairs). For an experiment using this library for multiplex PCR followed by sequencing, the percent of the amplified products that were primer dimers was 0.56%, the median depth of read per target that was amplified was 69.09× coverage, the percent of the amplified products that were target amplicons was 99.42%; the number of target loci that were not amplified (failed assay count) was 44; the percent of target loci that were not amplified (failed assay percentage) was 0.33%; the percent of target loci that were amplified was 99.67%; and the total number of reads was 7,772,454.

Figure 38:
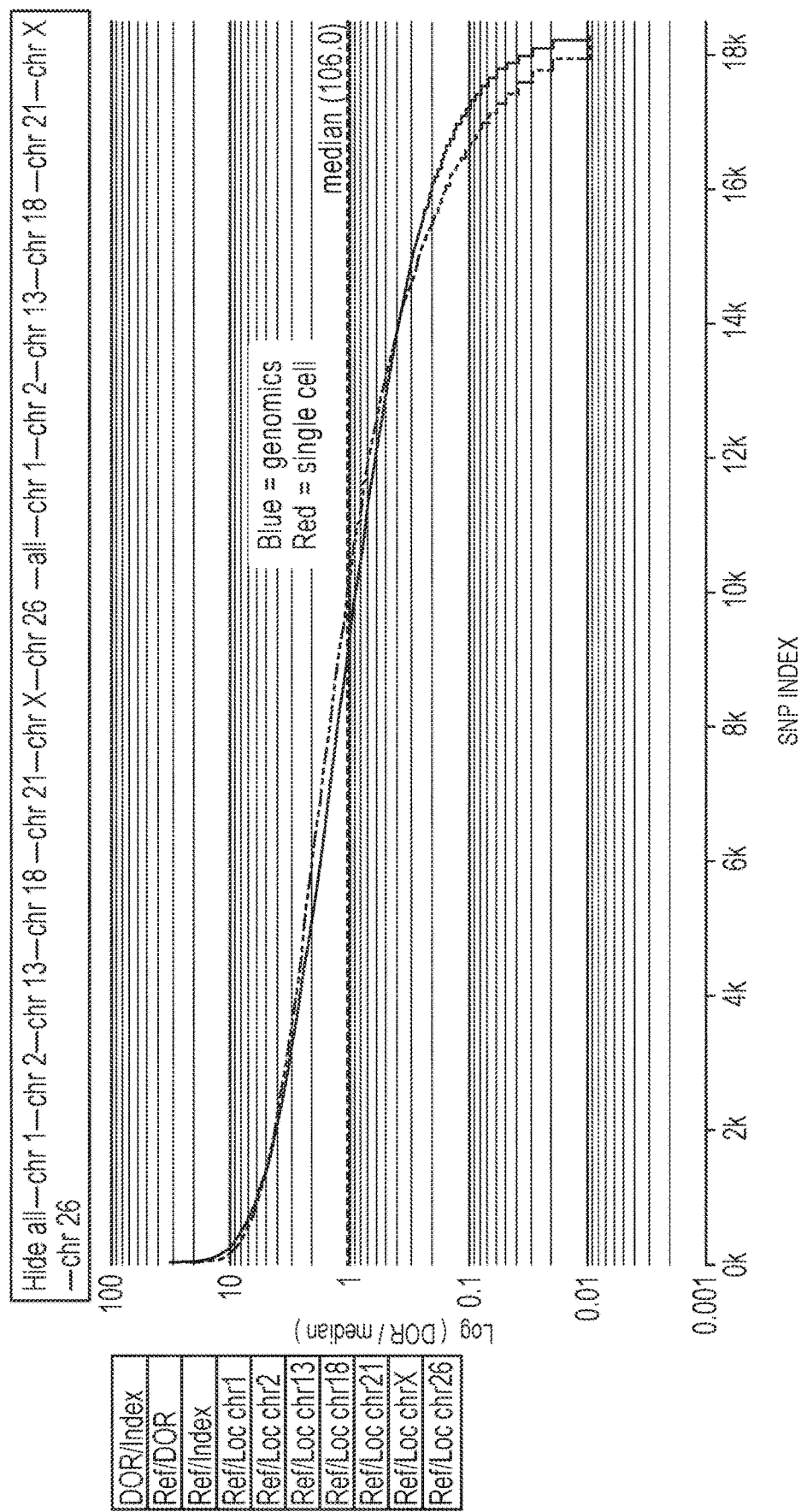
FIG. 38: Overlay of depth of read for a genomic (blue) and a single cell (red) sample for different SNPs.
Figure 40:
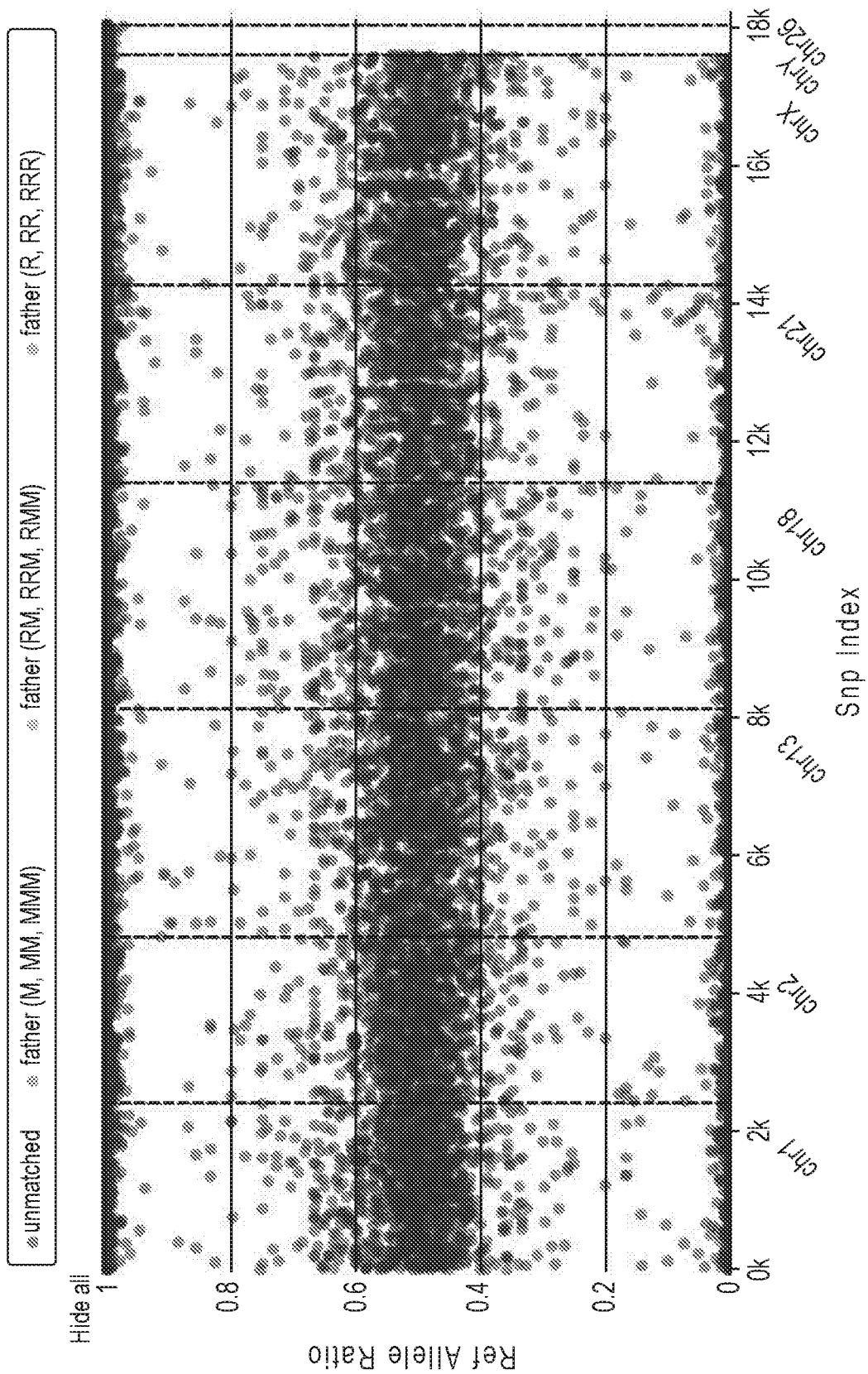
FIG. 40. Graph of reference counts (counts of one allele, such as the "A" allele) divided by total counts for that locus for a single blastocyst cell.

The primer design methods of the invention were also used to generate a library composed of three primers per target locus for 19,488 different target loci. Experiments 15, 18, and 19 describe the use of this library. During the PCR amplification and sequencing of a genomic sample, 99.4-99.7% of the sequencing reads mapped to the genome, of those, 99.99% of the mapped to target loci. For plasma samples with 10 million sequencing reads, typically at least 19,350 of the 19,488 target loci (99.3%) were amplified and sequenced. For another experiment, the percent of the amplified products that were primer dimers was 1.62%, the median depth of read per target that was amplified was 30× coverage; the percent of the amplified products that were target amplicons was 98.15%; the number of target loci that were not amplified (failed assay count) was 736; the percent of target loci that were not amplified (failed assay percentage) was 0.56%; the percent of target loci that were amplified was 99.44%; and the total number of reads was 6,476,975. For this 19,488-plex library, FIG. 37 is a table of the percentage of reads that map to target loci for genomic DNA samples and for samples of a single cell from a cell line for both mother and child samples using this primer library. There was variability in the single cell data which may have resulted from some dead cells being selected, which may have had most of the DNA leaked out. FIG. 38 is an overlay of depth of read for genomic (blue) and a single cell (red) sample for different SNPs. FIG. 39 is a table of the percentage of reads that map to target loci for blastoceol fluid and for a single blastocyst cell. The blastoceol fluid produced no mapped reads, possibly due to no DNA being detected. For a single blastocyst, 50-80% of the reads mapped to target loci. FIG. 40 is a graph of reference counts (counts of one allele, such as the "A" allele) divided by total counts for that locus for a single blastocyst cell. For this primer library, the ΔG values for each possible combination of two primers (each possible primer dimer) in the library are all equal to or greater than −3.86 kcal/mol. This −3.86 kcal/mol value was used as a threshold value to select candidate primer that all had a value equal to or greater than (more desirable than) this value from an initial library of candidate primers.

The primer design methods of the invention were used to generate a library for ~28,000 different target loci (such as amplifying 27,744 different loci with 27,744 different primer pairs). For multiplex PCR and sequencing of genomic DNA samples, 99% of the sequencing reads mapped to target loci. The number of different target human loci that were amplified was 23,776.

For an experiment using this library, the percent of the amplified products that were primer dimers was 0.63%, the median depth of read per target that was amplified was 20× coverage, the percent of the amplified products that were target amplicons was 99.33%; the number of target loci that were not amplified (failed assay count) was 3,968; the percent of target loci that were not amplified (failed assay percentage) was 14.29%; the percent of target loci that were amplified was 85.71%; and the total number of reads was 4,456,636. For a single cell from a cell line, between 2 and 8% of the reads mapped to target loci.

The primer design methods of the invention were used to generate a library for ~9,600 different target loci. As described in Experiment 10, 7.6 million (97%) of reads mapped to the genome, and 6.3 million (80%) of the reads mapped to the targeted SNPs. The average depth of read was 751, and the median depth of read was 396. As described in Experiment 9, another experiment produced 3.7 million reads mapping to the genome (94%), and of those, 2.9 million reads (74%) mapped to targeted SNPs with an average depth of read of 344 and a median depth of read of 255.

The primer design methods of the invention were used to generate a library for ~2,400 different target loci. As described in Experiment 12, when four portions were each amplified with ~2,400 primers, 4.5 million reads mapped to targeted SNPs, the average depth of read was 535 and the median depth of read was 412.

If desired, any of the results may be improved by increasing the number of cells or the amount of nucleic acid template used for the analysis or by optimizing the conditions. For example, if results from single cell samples are not as good as desired for a particular application, a sample with more cells or more nucleic acids may be used instead (such as to decrease the percentage of primer dimers, increase the percentage of target amplicons, or increase the percentage of target loci that are amplified). Samples with more nucleic acids have more template molecules for the primers to bind (instead of primers binding each other and forming primer dimers).

These primer libraries can be used in any of the PCR methods of the invention. In some embodiments, primers from one of the primer pools in FIG. 34, 35, or 36 (either pool A, pool B, or pool C) are used in combination with a universal primer to amplify the target loci. In some embodiments, multiple rounds of PCR are performed in which each round of PCR uses primers from one of the primer pools of FIG. 34, 35, or 36 and a universal primer. In some embodiments, primer from two of the primer pools (such as primers from pools C and B or primers from pools A and C) are used to amplify the target loci. In some embodiments, multiple rounds of PCR are performed. In some embodiments, primers from pools C and B are used for the first round of PCR and then primers from pools A and C are used for the second of PCR. In some embodiments, primers from pools C and B are used for the first round of PCR and then primers from pools A and B are used for the second of PCR. In some embodiments, at least 60, 70, 80, 90, 95, or 100% of the primers from one or more of the primer pools in FIG. 34, 35, or 36 (e.g., pool A, pool B, and/or pool C) are used for the PCR amplification. In some embodiments, primers from FIG. 34, 35, or 36 are combined with other primers that are not included in FIG. 34, 35, or 36.

In one aspect, the invention features one or more primers (e.g., at least 10; 20; 50; 75; 100; 300; 500; 750; 1,000; 2,000; 5,000; 7,500; 10,000; 15,000; 20,000; 25,000; 30,000; 40,000; or 50,000 different primers) with at least 60, 70, 80, 90, 95, 96, 97, 98, 99, 99.5, or 100% identity to the corresponding region (e.g., a region of at least 10, 20, 30, 40, 50 or more contiguous nucleotides) of a primer in pool A, pool B, and/or pool C in FIG. 34, 35, or 36 (SEQ ID NOs 1-44,610). In one aspect, the invention features one or more primers (e.g., at least 10; 20; 50; 75; 100; 300; 500; 750; 1,000; 2,000; 5,000; 7,500; 10,000; 15,000; 20,000; 25,000; 30,000; 40,000; or 50,000 different primers) with at least 60, 70, 80, 90, 95, 96, 97, 98, 99, 99.5, or 100% identity over the entire length of a primer in pool A, pool B, and/or pool C in FIG. 34, 35, or 36. If desired, the primers in FIG. 34, 35, or 36 can be modified by the insertion, deletion, or substitution of one or more nucleotides (e.g., at least 1, 2, 3, 4, 5, 6, 8, 10, 20, or more nucleotides). In some embodiments, a region that is not specific for a target locus (such as a tag, bar code, or universal binding site) is added to one or more primers in FIG. 34, 35, or 36. In various embodiments, the nonspecific region is added to the 5' end of the primer, to the 3' end of the primer, or to an internal region of the primer. In some embodiments, the primers are fragments (such as fragments of at least 10, 20, 30, 40, 50 or more contiguous nucleotides that are less than full-length) of primers in FIG. 34, 35, or 36.

In some embodiments, the invention provides a library of primers that includes at least 10; 20; 50; 75; 100; 300; 500; 750; 1,000; 2,000; 5,000; 7,500; 10,000; 15,000; 20,000; 25,000; 30,000; 40,000; or 50,000 different primers that comprise the polynucleotide sequence of a primer in pool A, pool B, and/or pool C in FIG. 34, 35, or 36. In some embodiments, the invention provides a library of primers that includes at least 10; 20; 50; 75; 100; 300; 500; 750; 1,000; 2,000; 5,000; 7,500; 10,000; 15,000; 20,000; 25,000; 30,000; 40,000; or 50,000 different primers or all of the primer from pool A, pool B, and/or pool C in one of FIG. 34, 35, or 36.

In some embodiment, some or all of the primers in two or three of the primer libraries of FIG. 34, 35, or 36 are combined.

Percent identity in reference to nucleic acid sequences refers to the degree of sequence identity between nucleic acid sequences. Percent identity can be determined in various ways that are within the skill in the art, for instance, using publicly available computer software with the default parameters such as Smith Waterman Alignment (Smith and Waterman J. Mol. Biol. 147:195-7, 1981); "BestFit" (Smith and Waterman, Advances in Applied Mathematics, 482-489, 1981); Basic Local Alignment Search Tool (BLAST, Altschul, S. F., W. Gish, et al., J. Mol. Biol. 215: 403-410, 1990; available through the U.S. government's National Center for Biotechnology Information web site at the world wide web at ncbi.nlm.nih.gov), BLAST-2, BLAST-N, WU-BLAST, WU-BLAST-2, ENTREZ (available through the National Center for Biotechnology Information), CLUSTALW, CLUSTAL Omega, or Megalign (DNASTAR, Inc. Madison, Wis.) software. In addition, those skilled in the art can determine appropriate parameters for measuring alignment, including any algorithms needed to achieve maximal alignment over the length of the sequences being compared. In general, the length of comparison will generally be at least 20, 30, 40, 45, 50, or more nucleotides.

In some embodiments, percent identity is calculated by determining the number of matched positions in aligned nucleic acid sequences, dividing the number of matched positions by the total number of aligned nucleotides, and multiplying by 100. A matched position refers to a position in which identical nucleotides occur at the same position in aligned nucleic acid sequences. The percent identity over a particular length is determined by counting the number of matched positions over that length and dividing that number by the length followed by multiplying the resulting value by 100. For example, if (i) a 500-nucleotide nucleic acid target sequence is compared to a subject nucleic acid sequence, (ii) an alignment program presents 200 nucleotides from the target sequence aligned with a region of the subject sequence where the first and last nucleotides of that 200-nucleotide region are matches, and (iii) the number of matches over those 200 aligned nucleotides is 180, then the 500-nucleotide nucleic acid target sequence contains a length of 200 and a sequence identity over that length of 90% (i.e., 180, 200×100=90).

In one aspect, the invention features one or more primers (e.g., at least 10; 20; 50; 75; 100; 300; 500; 750; 1,000; 2,000; 5,000; 7,500; 10,000; 15,000; 20,000; 25,000; 30,000; 40,000; or 50,000 different primers) that comprise a polynucleotide sequence that hybridizes to the complement of a primer in pool A, pool B, and/or pool C in FIG. 34, 35, or 36 under very high stringency hybridization conditions, high stringency hybridization conditions, or low stringency hybridization conditions. In some embodiments, one or more primers (e.g., at least 10; 20; 50; 75; 100; 300; 500; 750; 1,000; 2,000; 5,000; 7,500; 10,000; 15,000; 20,000; 25,000; 30,000; 40,000; or 50,000 different primers) hybridize to the complement of a primer in pool A, pool B, and/or pool C in FIG. 34, 35, or 36 under very high stringency hybridization conditions, high stringency hybridization conditions, or low stringency hybridization conditions. Hybridization conditions resulting in a particular degree of stringency will vary depending upon the nature of the hybridization method and the composition and length of the hybridizing nucleic acid sequences. Generally, the temperature of hybridization and the ionic strength (such as the $Na^+$ concentration) of the hybridization buffer will determine the stringency of hybridization. Calculations regarding hybridization conditions for attaining particular degrees of stringency are discussed in Sambrook et al., (1989) Molecular Cloning, second edition, Cold Spring Harbor Laboratory, Plainview, N.Y. (chapters 9 and 11); Nucleic Acid Hybridization, A Practical Approach, Ed. Hames, B. D. and Higgins, S. J., IRL Press, 1985; Ausubel et al. Current Protocols in Molecular Biology, Wiley, New York 1994; and U.S. Pat. No. 8,357,488, filed May 16, 2008. In some embodiments, very high stringency hybridization conditions include an overnight incubation at 42° C. in a solution comprising 50% formamide, 5×SSC (750 mM NaCl, 75 mM trisodium citrate), 50 mM sodium phosphate (pH 7.6), 5×Denhardt's solution, 10% dextran sulfate, and 20 µg/ml denatured, sheared salmon sperm DNA, followed by washing the filters in 0.1×SSC at about 65° C. The following is an exemplary set of hybridization conditions and is not limiting:

Very High Stringency (Detects Sequences that Share at Least 90% Identity)
 a) Hybridization: 5×SSC at 65° C. for 16 hours
 b) Wash twice: 2×SSC at room temperature for 15 minutes each
 c) Wash twice: 0.5×SSC at 65° C. for 20 minutes each High Stringency (Detects Sequences that Share at Least 80% Identity)
  a) Hybridization: 5x-6xSSC at 65° C.-70° C. for 16-20 hours
  b) Wash twice: 2xSSC at room temperature for 5-20 minutes each
  c) Wash twice: 1xSSC at 55° C.-70° C. for 30 minutes each Low Stringency (Detects Sequences that Share at Least 50% Identity)
  a) Hybridization: 6xSSC at room temperature to 55° C. for 16-20 hours
  b) Wash at least twice: 2x-3xSSC at room temperature to 55° C. for 20-30 minutes each These primers can be used in any of the primer libraries or methods of the invention. In some embodiments, the library of primers consists essentially of, or consists of primers from any one of FIGS. 34-36.

Exemplary Primer Libraries for Detection of Recombination

In some embodiments, primers in the primer library are designed to determine whether or not recombination occurred at one or more known recombination hotspots (such as crossovers between homologous human chromosomes). Knowing what crossovers occurred between chromosomes allows more accurate phased genetic data to be determined for an individual. Recombination hotspots are local regions of chromosomes in which recombination events tend to be concentrated. Often they are flanked by "coldspots," regions of lower than average frequency of recombination. Recombination hotspots tend to share a similar morphology and are approximately 1 to 2 kb in length. The hotspot distribution is positively correlated with GC content and repetitive element distribution. A partially degenerated 13-mer motif CCNCCNTNNCCNC plays a role in some hotspot activity. It has been shown that the zinc finger protein called PRDM9 binds to this motif and initiates recombination at its location. The average distance between the centers of recombination hot spots is reported to be ~80 kb. In some embodiments, the distance between the centers of recombination hot spots ranges between ~3 kb to ~100 kb. Public databases include a large number of known human recombination hotspots, such as the HUMHOT and International HapMap Project databases (see, for example, Nishant et al., "HUMHOT: a database of human meiotic recombination hot spots," Nucleic Acids Research, 34: D25-D28, 2006, Database issue; Mackiewicz et al., "Distribution of Recombination Hotspots in the Human Genome—A Comparison of Computer Simulations with Real Data" PLoS ONE 8(6): e65272, doi:10.1371/journal.pone.0065272; and the world wide web at hapmap.ncbi.nlm.nih.gov/downloads/index.html.en, which are each hereby incorporated by reference in its entirety).

In some embodiments, primers in the primer library are clustered at or near recombination hotspots (such as known human recombination hotspots). In some embodiments, the corresponding amplicons are used to determine the sequence within or near a recombination hotspot to determine whether or not recombination occurred at that particular hotspot (such as whether the sequence of the amplicon is the sequence expected if a recombination had occurred or the sequence expected if a recombination had not occurred). In some embodiments, primers are designed to amplify part or all of a recombination hotspot (and optionally sequence flanking a recombination hotspot). In some embodiments, long read sequencing (such as sequencing using the Moleculo Technology developed by Illumina to sequence up to ~10 kb) or paired end sequencing is used to sequence part or all of a recombination hotspot. Knowledge of whether or not a recombination event occurred can be used to determine which haplotype blocks flank the hotspot. If desired, the presence of particular haplotype blocks can be confirmed using primers specific to regions within the haplotype blocks. In some embodiments, it is assumed there are no crossovers between known recombination hotspots. In some embodiments, primers in the primer library are clustered at or near the ends of chromosomes. For example, such primers can be used to determine whether or not a particular arm or section at the end of a chromosome is present. In some embodiments, primers in the primer library are clustered at or near recombination hotspots and at or near the ends of chromosomes.

In some embodiments, the primer library includes one or more primers (such as at least 5; 10; 50; 100; 200; 500; 750; 1,000; 2,000; 5,000; 7,500; 10,000; 20,000; 25,000; 30,000; 40,000; or 50,000 different primers or different primer pairs) that are specific for a recombination hotspot (such as a known human recombination hotspot) and/or are specific for a region near a recombination hotspot (such as within 10, 8, 5, 3, 2, 1, or 0.5 kb of the 5' or 3' end of a recombination hotspot). In some embodiments, at least 1, 5, 10, 20, 40, 60, 80, 100, or 150 different primers (or primer pairs) are specific for the same recombination hotspot, or are specific for the same recombination hotspot or a region near the recombination hotspot. In some embodiments, at least 1, 5, 10, 20, 40, 60, 80, 100, or 150 different primers (or primer pairs) are specific for a region between recombination hotspots (such as a region unlikely to have undergone recombination); these primers can be used to confirm the presence of haplotype blocks (such as those that would be expected depending on whether or not recombination has occurred). In some embodiments, at least 10, 20, 30, 40, 50, 60, 70, 80, or 90% of the primers in the primer library are specific for a recombination hotspot and/or are specific for a region near a recombination hotspot (such as within 10, 8, 5, 3, 2, 1, or 0.5 kb of the 5' or 3' end of the recombination hotspot). In some embodiments, the primer library is used to determine whether or not recombination has occurred at greater than or equal to 5; 10; 50; 100; 200; 500; 750; 1,000; 2,000; 5,000; 7,500; 10,000; 20,000; 25,000; 30,000; 40,000; or 50,000 different recombination hotspots (such as known human recombination hotspots). In some embodiments, the regions targeted by primers to a recombination hotspot or nearby region are approximately evenly spread out along that portion of the genome. In some embodiments, at least 1, 5, 10, 20, 40, 60, 80, 100, or 150 different primers (or primer pairs) are specific for a region at or near the end of a chromosome (such as a region within 20, 10, 5, 1, 0.5, 0.1, 0.01, or 0.001 mb from the end of a chromosome). In some embodiments, at least 10, 20, 30, 40, 50, 60, 70, 80, or 90% of the primers in the primer library are specific for a region at or near the end of a chromosome (such as a region within 20, 10, 5, 1, 0.5, 0.1, 0.01, or 0.001 mb from the end of a chromosome). In some embodiments, at least 1, 5, 10, 20, 40, 60, 80, 100, or 150 different primers (or primer pairs) are specific for a region within a potential microdeletion in a chromosome. In some embodiments, at least 10, 20, 30, 40, 50, 60, 70, 80, or 90% of the primers in the primer library are specific for a region within a potential microdeletion in a chromosome. In some embodiments, at least 10, 20, 30, 40, 50, 60, 70, 80, or 90% of the primers in the primer library are specific for a recombination hotspot, a region near a recombination hotspot, a region at or near the end of a chromosome, or a region within a potential microdeletion in a chromosome. In some embodiments, the primers have one or more of the properties described herein. Other embodiments are disclosed in U.S. Ser. Nos. 61/987,407, filed May 1, 2014 and 62/066,514, filed Oct. 21, 2014.

Exemplary Primer Kits

In one aspect, the invention features a kit (such as kits for amplifying target loci in a nucleic acid sample) the includes any of the primer libraries of the invention. In some embodiments, a kit may be formulated that comprises a plurality of primers designed to achieve the methods described in this disclosure. The primers may be outer forward and reverse primers, inner forward and reverse primers as disclosed herein, they could be primers that have been designed to have low binding affinity to other primers in the kit as disclosed in the section on primer design, they could be hybrid capture probes or pre-circularized probes as described in the relevant sections, or some combination thereof. In an embodiment, a kit may be formulated for determining a ploidy status of a target chromosome in a gestating fetus designed to be used with the methods disclosed herein, the kit comprising a plurality of inner forward primers and optionally the plurality of inner reverse primers, and optionally outer forward primers and outer reverse primers, where each of the primers is designed to hybridize to the region of DNA immediately upstream and/or downstream from one of the target sites (e.g., polymorphic sites) on the target chromosome, and optionally additional chromosomes. In an embodiment, the primer kit may be used in combination with the diagnostic box described elsewhere in this document. In some embodiments, the kit includes instructions for using the library to amplify the target loci. In some embodiments, the kit consists essentially of, or consists of primers (or of primers and instructions for using the primers).

Exemplary Amplicons

In one aspect, the invention provides a composition comprising at least 100 different amplicons (e.g., at least 300, 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical amplicons) in solution in one reaction volume. In some embodiments, the amplicons are produced from the simultaneous PCR amplification of at least 100 different target loci (e.g., at least 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical target loci) using at least 100 different primers or primer pairs (e.g., at least 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers or primer pairs) in one reaction volume. In some embodiments, (i) less than 60% of the amplified products are primer dimers and at least 40% of the amplified products are target amplicons, (ii) less than 40% of the amplified products are primer dimers and at least 60% of the amplified products are target amplicons, (iii) less than 20% of the amplified products are primer dimers and at least 80% of the amplified products are target amplicons, (iv) less than 10% of the amplified products are primer dimers and at least 90% of the amplified products are target amplicons, or (v) less than 5% of the amplified products are primer dimers and at least 95% of the amplified products are target amplicons. In some embodiments, the length of the target amplicons is between 50 and 100 nucleotides, such as between 60 and 80 nucleotides, or 60 to 75 nucleotides, inclusive. In some embodiments, the range of the length of the target amplicons is less than 50, 25, 15, 10, or 5 nucleotides. In some embodiments, the range of the length of the target amplicons is between 5 to 50 nucleotides, such as 5 to 25 nucleotides, 5 to 15 nucleotides, or 5 to 10 nucleotides, inclusive. In some embodiments, the composition includes at least 1,000 different amplicons in solution in one reaction volume; wherein the amplicons are produced from the simultaneous PCR amplification of at least 1,000 different target human loci using at least 1,000 different primers in one reaction volume; wherein (i) less than 20% of the amplicons are primer dimers, and (ii) at least 80% of the amplicons comprise one of the target human loci and are between 50 and 100 nucleotides in length, inclusive. In some embodiments, the composition consists essentially of, or consists of one or more of the following: amplicons, primers (such as any of the primers disclosed herein), free nucleotide(s), non-human or non-naturally occurring enzyme(s), buffer(s), or any combination thereof.

In some embodiments, a large percentage or substantially all of the primers used for the multiplex PCR method are consumed during the PCR reaction or are removed from the reaction volume after the PCR amplification. In some embodiments, at least 80, 90, 92, 94, 96, 98, 99, or 100% of the primer molecules are extended to form amplified products. In some embodiments, for at least 80, 90, 92, 94, 96, 98, 99, or 100% of target loci, at least 80, 90, 92, 94, 96, 98, 99, or 100% of the primer molecules to that target loci are extended to form amplified products. In some embodiments, multiple cycles are performed until all or substantially all of the primers are consumed. If desired, a higher percentage of the primers can be consumed by decreasing the initial primer concentration and/or increasing the number of PCR cycles that are performed. In some embodiments, at least 80, 90, 95, 96, 97, 98, 99, or 100% of the nucleic acids in the composition are amplicons (instead of unextended dimers).

In one aspect, the invention provides a composition comprising at least 100 different primers or primer pairs (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers or primer pairs) and at least 100 different amplicons (e.g., at least 300, 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical amplicons) in solution in one reaction volume. In some embodiments, the amplicons are produced from the simultaneous PCR amplification of at least 100 different target loci (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical target loci) using the primers or primer pairs in one reaction volume. In some embodiments, (i) less than 60% of the amplified products are primer dimers and at least 40% of the amplified products are target amplicons, (ii) less than 40% of the amplified products are primer dimers and at least 60% of the amplified products are target amplicons, (iii) less than 20% of the amplified products are primer dimers and at least 80% of the amplified products are target amplicons, (iv) less than 10% of the amplified products are primer dimers and at least 90% of the amplified products are target amplicons, or (v) less than 5% of the amplified products are primer dimers and at least 95% of the amplified products are target amplicons. In some embodiments, the length of the target amplicons is between 50 and 100 nucleotides, such as between 60 and 80 nucleotides, or 60 to 75 nucleotides, inclusive. In some embodiments, the range of the length of the target amplicons is less than 50, 25, 15, 10, or 5 nucleotides. In some embodiments, the range of the length of the target amplicons is between 5 to 50 nucleotides, such as 5 to 25 nucleotides, 5 to 15 nucleotides, or 5 to 10 nucleotides, inclusive. In some embodiments, the composition comprising at least 1,000 different primers and at least 1,000 different amplicons in solution in one reaction volume; wherein the amplicons are produced from the simultaneous PCR amplification of at least 1,000 different target human loci with the primers in one reaction volume; wherein (i) less than 20% of the amplicons are primer dimers, and (ii) at least 80% of the amplicons comprise one of the target loci and are between 50 and 100 nucleotides in length, inclusive. In some embodiments, the composition consists essentially of, or consists of one or more of the following: amplicons, primers (such as any of the primers disclosed herein), free nucleotide(s), non-human or non-naturally occurring enzyme(s), buffer(s), or any combination thereof.

In some embodiments, the amplification of different target loci is substantially uniform. In some embodiments, target loci (such as nonpolymorphic target loci or polymorphic target loci that are amplified regardless of what allele is present at the polymorphic site) that were present in the same amount (or substantially the same amount) in the initial unamplified sample are also present in substantially the same amount in the PCR-amplified products. In some embodiments, for at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different targets, the target loci that is amplified the most out of these targets (which can be all of the targets or a subset of the targets for a library) is amplified less than 2,000; 1,500; 1,000; 500, 400, 300, 200, 100%, 50, 20, 10, 5, or 2% more than the target loci that is amplified the least out of these targets. In some embodiments, for at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target amplicons, the target amplicon in greatest abundance out of these target amplicons (which can be all of the target amplicons or a subset of the target amplicons produced by a library) is present in an amount that is less than 2,000; 1,500; 1,000; 500, 400, 300, 200, 100%, 50, 20, 10, 5, or 2% more than the target amplicon in least abundance out of these target amplicons. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target amplicons are present in an amount that is at least 5, 10, 15, 20, 40, 50, 60, 70, 80, or 90% of the amount of the target amplicon in greatest abundance. In some embodiments, for at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different amplicons that are produced by multiplex PCR and then sequenced, at least 80, 90, 95, 96, 97, 98, 99, or 99.5% of the target amplicons produce a number of sequencing reads within 20, 30, 50, or 80% above or below the mean number of sequences for target amplicons. If desired, the uniformity can be increased by using primers with more similar primer lengths, target amplicon lengths, GC contents, melting temperatures, or any combination thereof. In some embodiments, the uniformity can be increased by using TMAC in the reaction volume during amplification. In some embodiments, having most or all the primers consumed in the PCR reaction increases the uniformity of amplification.

If desired, the uniformity in DOR can be measured using standard methods such as depth of read slope (DOR slope), normalized median depth of read (nmDOR), or breadth of read (BOR). DOR slope represents the slope of the line in the linear portion of a list of loci sorted in descending DOR order. Closer to zero is better, as it represents a flat line. In some embodiments, the uniformity in DOR can be measured using the Percent of reads in the $90^{th}$-$95^{th}$ Percentile. For this measurement, the loci are sorted in descending DOR order. In the ideal DOR distribution, the $90^{th}$-$95^{th}$ percentile should contain 5% of reads. The reads of all loci between the $90^{th}$ Percentile and $95^{th}$ percentile are counted and divided by the total reads for all loci. In one experiment, the DOR slope versus percent of reads in the $90^{th}$-$95^{th}$ percentile for all samples had an $R^2$=0.81.

In some embodiments, the magnitude of the DOR slope is less than 0.005, 0.001, 0.0005, 0.0001, 0.00005, 0.00001, 0.000005, or 0.000001. In some embodiments, the magnitude of the DOR slope is between 0 and 0.005, such as 0.000001 to 0.005, such as between 0.000005 to 0.00001, 0.00001 to 0.00005, 0.00005 to 0.0001, 0.0001 to 0.0005, 0.0005 to 0.001, or 0.001 to 0.005, inclusive. In some embodiments, the percent of reads in the $90^{th}$-$95^{th}$ percentile is between 0.2 and 9%, such as between 1 to 8%, 2 to 7%, 0.2 to 1.0%, 1 to 2%, 2 to 3%, 2 to 4%, 3 to 4%, 4 to 5%, 5 to 6%, or 6 to 8%, or 7 to 9% inclusive. In some embodiments, the invention features a composition comprising at least 100 different amplicons (e.g., at least 300, 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical amplicons) with the magnitude of the DOR slope in any of these ranges or with a percent of reads in the $90^{th}$-$95^{th}$ percentile in any of these ranges. In some embodiments, the amplification method produces at least 100 different amplicons (e.g., at least 300, 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical amplicons) with the magnitude of the DOR slope in any of these ranges or with a percent of reads in the $90^{th}$-$95^{th}$ percentile in any of these ranges.

Exemplary Multiplex PCR Methods

In one aspect, the invention features methods of amplifying target loci in a nucleic acid sample that involve (i) contacting the nucleic acid sample with a library of primers that simultaneously hybridize to least 1,000; 2,000; 5,000; 7,500; 10,000; 15,000; 19,000; 20,000; 25,000; 27,000; 28,000; 30,000; 40,000; 50,000; 75,000; or 100,000 different target loci to produce a reaction mixture; and (ii) subjecting the reaction mixture to primer extension reaction conditions (such as PCR conditions) to produce amplified products that include target amplicons. In some embodiments, the method also includes determining the presence or absence of at least one target amplicon (such as at least 50, 60, 70, 80, 90, 95, 96, 97, 98, 99, or 99.5% of the target amplicons). In some embodiments, the method also includes determining the sequence of at least one target amplicon (such as at least 50, 60, 70, 80, 90, 95, 96, 97, 98, 99, or 99.5% of the target amplicons). In some embodiments, at least 50, 60, 70, 80, 90, 95, 96, 97, 98, 99, or 99.5% of the target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, 99.5, or 100% of the target loci are amplified at least 5, 10, 20, 40, 50, 60, 80, 100, 120, 150, 200, 300, or 400-fold. In various embodiments, less than 60, 50, 40, 30, 20, 10, 5, 4, 3, 2, 1, 0.5, 0.25, 0.1, or 0.05% of the amplified products are primer dimers. In some embodiments, the method involves multiplex PCR and sequencing (such as high throughput sequencing).

In various embodiments, long annealing times and/or low primer concentrations are used. In various embodiments, the length of the annealing step is greater than 3, 5, 8, 10, 15, 20, 30, 45, 60, 75, 90, 120, 150, or 180 minutes. In various embodiments, the length of the annealing step (per PCR cycle) is between 5 and 180 minutes, such as 5 to 60, 10 to 60, 5 to 30, or 10 to 30 minutes, inclusive. In various embodiments, the length of the annealing step is greater than 5 minutes (such greater than 10, or 15 minutes), and the concentration of each primer is less than 20 nM. In various embodiments, the length of the annealing step is greater than 5 minutes (such greater than 10, or 15 minutes), and the concentration of each primer is between 1 to 20 nM, or 1 to 10 nM, inclusive. In various embodiments, the length of the annealing step is greater than 20 minutes (such as greater than 30, 45, 60, or 90 minutes), and the concentration of each primer is less than 1 nM.

At high level of multiplexing, the solution may become viscous due to the large amount of primers in solution. If the solution is too viscous, one can reduce the primer concentration to an amount that is still sufficient for the primers to bind the template DNA. In various embodiments, less than 60,000 different primers are used and the concentration of each primer is less than 20 nM, such as less than 10 nM or between 1 and 10 nM, inclusive. In various embodiments, more than 60,000 different primers (such as between 60,000 and 120,000 different primers) are used and the concentration of each primer is less than 10 nM, such as less than 5 nM or between 1 and 10 nM, inclusive.

It was discovered that the annealing temperature can optionally be higher than the melting temperatures of some or all of the primers (in contrast to other methods that use an annealing temperature below the melting temperatures of the primers) (Experiment 25). The melting temperature ($T_m$) is the temperature at which one-half (50%) of a DNA duplex of an oligonucleotide (such as a primer) and its perfect complement dissociates and becomes single strand DNA. The annealing temperature ($T_A$) is the temperature one runs the PCR protocol at. For prior methods, it is usually 5 C below the lowest $T_m$ of the primers used, thus close to all possible duplexes are formed (such that essentially all the primer molecules bind the template nucleic acid). While this is highly efficient, at lower temperatures there are more unspecific reactions bound to occur. One consequence of having too low a $T_A$ is that primers may anneal to sequences other than the true target, as internal single-base mismatches or partial annealing may be tolerated. In some embodiments of the present inventions, the $_{TA}$ is higher than ($T_m$), where at a given moment only a small fraction of the targets have a primer annealed (such as only ~1-5%). If these get extended, they are removed from the equilibrium of annealing and dissociating primers and target (as extension increases $T_m$ quickly to above 70 C), and a new ~1-5% of targets has primers. Thus, by giving the reaction long time for annealing, one can get ~100% of the targets copied per cycle. Thus, the most stable molecule pairs (those with perfect DNA pairing between the primer and the template DNA) are preferentially extended to produce the correct target amplicons. For example, the same experiment was performed with 57° C. as the annealing temperature and with 63° C. as the annealing temperature with primers that had a melting temperature below 63° C. When the annealing temperature was 57° C., the percent of mapped reads for the amplified PCR products was as low as 50% (with~50% of the amplified products being primer-dimer). When the annealing temperature was 63° C., the percentage of amplified products that were primer dimer dropped to ~2%.

In various embodiments, the annealing temperature is at least 1, 2, 3, 4, 5, 6, 7, 8, 9, 10, 11, 12, 13, or 15° C. greater than the melting temperature (such as the empirically measured or calculated $T_m$) of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers. In some embodiments, the annealing temperature is at least 1, 2, 3, 4, 5, 6, 7, 8, 9, 10, 11, 12, 13, or 15° C. greater than the melting temperature (such as the empirically measured or calculated $T_m$) of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers, and the length of the annealing step (per PCR cycle) is greater than 1, 3, 5, 8, 10, 15, 20, 30, 45, 60, 75, 90, 120, 150, or 180 minutes.

In various embodiments, the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the melting temperature (such as the empirically measured or calculated $T_m$) of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers. In various embodiments, the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the melting temperature (such as the empirically measured or calculated $T_m$) of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers, and the length of the annealing step (per PCR cycle) is between 5 and 180 minutes, such as 5 to 60, 10 to 60, 5 to 30, or 10 to 30 minutes, inclusive.

In some embodiments, the annealing temperature is at least 1, 2, 3, 4, 5, 6, 7, 8, 9, 10, 11, 12, 13, or 15° C. greater than the highest melting temperature (such as the empirically measured or calculated $T_m$) of the primers. In some embodiments, the annealing temperature is at least 1, 2, 3, 4, 5, 6, 7, 8, 9, 10, 11, 12, 13, or 15° C. greater than the highest melting temperature (such as the empirically measured or calculated $T_m$) of the primers, and the length of the annealing step (per PCR cycle) is greater than 1, 3, 5, 8, 10, 15, 20, 30, 45, 60, 75, 90, 120, 150, or 180 minutes In some embodiments, the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the highest melting temperature (such as the empirically measured or calculated $T_m$) of the primers. In some embodiments, the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the highest melting temperature (such as the empirically measured or calculated $T_m$) of the primers, and the length of the annealing step (per PCR cycle) is between 5 and 180 minutes, such as 5 to 60, 10 to 60, 5 to 30, or 10 to 30 minutes, inclusive.

In some embodiments, the annealing temperature is at least 1, 2, 3, 4, 5, 6, 7, 8, 9, 10, 11, 12, 13, or 15° C. greater than the average melting temperature (such as the empirically measured or calculated $T_m$) of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers.

In some embodiments, the annealing temperature is at least 1, 2, 3, 4, 5, 6, 7, 8, 9, 10, 11, 12, 13, or 15° C. greater than the average melting temperature (such as the empirically measured or calculated $T_m$) of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers, and the length of the annealing step (per PCR cycle) is greater than 1, 3, 5, 8, 10, 15, 20, 30, 45, 60, 75, 90, 120, 150, or 180 minutes.

In some embodiments, the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the average melting temperature (such as the empirically measured or calculated $T_m$) of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers. In some embodiments, the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the average melting temperature (such as the empirically measured or calculated $T_m$) of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers, and the length of the annealing step (per PCR cycle) is between 5 and 180 minutes, such as 5 to 60, 10 to 60, 5 to 30, or 10 to 30 minutes, inclusive.

In some embodiments, the annealing temperature is between 50 to 70° C., such as between 55 to 60, 60 to 65, or 65 to 70° C., inclusive. In some embodiments, the annealing temperature is between 50 to 70° C., such as between 55 to 60, 60 to 65, or 65 to 70° C., inclusive, and either (i) the length of the annealing step (per PCR cycle) is greater than 3, 5, 8, 10, 15, 20, 30, 45, 60, 75, 90, 120, 150, or 180 minutes or (ii) the length of the annealing step (per PCR cycle) is between 5 and 180 minutes, such as 5 to 60, 10 to 60, 5 to 30, or 10 to 30 minutes, inclusive.

In some embodiments, one or more of the following conditions are used for empirical measurement of $T_m$ or are assumed for calculation of $T_m$: temperature: of 60.0° C., primer concentration of 100 nM, and/or salt concentration of 100 mM. In some embodiments, other conditions are used, such as the conditions that will be used for multiplex PCR with the library. In some embodiments, 100 mM KCl, 50 mM $(NH_4)_2SO_4$, 3 mM $MgCl_2$, 7.5 nM of each primer, and 50 mM TMAC, at pH 8.1 is used. In some embodiments, the $T_m$ is calculated using the Primer3 program (libprimer3 release 2.2.3) using the built-in SantaLucia parameters (the world wide web at primer3.sourceforge.net, which is hereby incorporated by reference in its entirety). For example, the $T_m$ values may be calculated using the method in Experiment 25. In some embodiments, the calculated melting temperature for a primer is the temperature at which half of the primers molecules are expected to be annealed. As discussed above, even at a temperature higher than the calculated melting temperature, a percentage of primers will be annealed, and therefore PCR extension is possible. In some embodiments, the empirically measured Tm (the actual Tm) is determined by using a thermostatted cell in a UV spectrophotometer. In some embodiments, temperature is plotted vs. absorbance, generating an S-shaped curve with two plateaus. The absorbance reading halfway between the plateaus corresponds to Tm.

In some embodiments, the absorbance at 260 nm is measured as a function of temperature on an ultrospec 2100 pr UV/visible spectrophotometer (Amershambiosciences) (see, e.g., Takiya et al., "An empirical approach for thermal stability (Tm) prediction of PNA/DNA duplexes," Nucleic Acids Symp Ser (Oxf); (48):131-2, 2004, which is hereby incorporated by reference in its entirety). In some embodiments, absorbance at 260 nm is measured by decreasing the temperature in steps of 2° C. per minute from 95 to 20° C. In some embodiments, a primer and its perfect complement (such as 2 uM of each paired oligomer) are mixed and then annealing is performed by heating the sample to 95° C., keeping it there for 5 minutes, followed by cooling to room temperature during 30 minutes, and keeping the samples at 95° C. for at least 60 minutes. In some embodiments, melting temperature is determined by analyzing the data using SWIFT Tm software. In some embodiments of any of the methods of the invention, the method includes empirically measuring or calculating (such as calculating with a computer) the melting temperature for at least 50, 80, 90, 92, 94, 96, 98, 99, or 100% of the primers in the library either before or after the primers are used for PCR amplification of target loci.

In some embodiments, the library comprises a microarray. In some embodiments, the library does not comprise a microarray.

In some embodiments, most or all of the primers are extended to form amplified products. Having all the primers consumed in the PCR reaction increases the uniformity of amplification of the different target loci since the same or similar number of primer molecules are converted to target amplicons for each target loci. In some embodiment, at least 80, 90, 92, 94, 96, 98, 99, or 100% of the primer molecules are extended to form amplified products. In some embodiments, for at least 80, 90, 92, 94, 96, 98, 99, or 100% of target loci, at least 80, 90, 92, 94, 96, 98, 99, or 100% of the primer molecules to that target loci are extended to form amplified products. In some embodiments, multiple cycles are performed until this percentage of the primers are consumed. In some embodiments, multiple cycles are performed until all or substantially all of the primers are consumed. If desired, a higher percentage of the primers can be consumed by decreasing the initial primer concentration and/or increasing the number of PCR cycles that are performed.

In some embodiments, the PCR methods may be performed with microliter reaction volumes, for which it can be harder to achieve specific PCR amplification (due to the lower local concentration of the template nucleic acids) compared to nanoliter or picoliter reaction volumes used in microfluidics applications. In some embodiments, the reaction volume is between 1 and 60 uL, such as between 5 and 50 uL, 10 and 50 uL, 10 and 20 uL, 20 and 30 uL, 30 and 40 uL, or 40 to 50 uL, inclusive.

In an embodiment, a method disclosed herein uses highly efficient highly multiplexed targeted PCR to amplify DNA followed by high throughput sequencing to determine the allele frequencies at each target locus. The ability to multiplex more than about 50 or 100 PCR primers in one reaction volume in a way that most of the resulting sequence reads map to targeted loci is novel and non-obvious. One technique that allows highly multiplexed targeted PCR to perform in a highly efficient manner involves designing primers that are unlikely to hybridize with one another. The PCR probes, typically referred to as primers, are selected by creating a thermodynamic model of potentially adverse interactions between at least 300; at least 500; at least 750;

at least 1,000; at least 2,000; at least 5,000; at least 7,500; at least 10,000; at least 20,000; at least 25,000; at least 30,000; at least 40,000; at least 50,000; at least 75,000; or at least 100,000 potential primer pairs, or unintended interactions between primers and sample DNA, and then using the model to eliminate designs that are incompatible with other the designs in the pool. Another technique that allows highly multiplexed targeted PCR to perform in a highly efficient manner is using a partial or full nesting approach to the targeted PCR. Using one or a combination of these approaches allows multiplexing of at least 300, at least 800, at least 1,200, at least 4,000 or at least 10,000 primers in a single pool with the resulting amplified DNA comprising a majority of DNA molecules that, when sequenced, will map to targeted loci. Using one or a combination of these approaches allows multiplexing of a large number of primers in a single pool with the resulting amplified DNA comprising greater than 50%, greater than 60%, greater than 67%, greater than 80%, greater than 90%, greater than 95%, greater than 96%, greater than 97%, greater than 98%, greater than 99%, or greater than 99.5% DNA molecules that map to targeted loci.

In some embodiments the detection of the target genetic material may be done in a multiplexed fashion. The number of genetic target sequences that may be run in parallel can range from one to ten, ten to one hundred, one hundred to one thousand, one thousand to ten thousand, ten thousand to one hundred thousand, one hundred thousand to one million, or one million to ten million. Prior attempts to multiplex more than 100 primers per pool have resulted in significant problems with unwanted side reactions such as primer-dimer formation.

Targeted PCR

In some embodiments, PCR can be used to target specific locations of the genome. In plasma samples, the original DNA is highly fragmented (typically less than 500 bp, with an average length less than 200 bp). In PCR, both forward and reverse primers anneal to the same fragment to enable amplification. Therefore, if the fragments are short, the PCR assays must amplify relatively short regions as well Like MIPS, if the polymorphic positions are too close the polymerase binding site, it could result in biases in the amplification from different alleles. Currently, PCR primers that target polymorphic regions, such as those containing SNPs, are typically designed such that the 3' end of the primer will hybridize to the base immediately adjacent to the polymorphic base or bases. In an embodiment of the present disclosure, the 3' ends of both the forward and reverse PCR primers are designed to hybridize to bases that are one or a few positions away from the variant positions (polymorphic sites) of the targeted allele. The number of bases between the polymorphic site (SNP or otherwise) and the base to which the 3' end of the primer is designed to hybridize may be one base, it may be two bases, it may be three bases, it may be four bases, it may be five bases, it may be six bases, it may be seven to ten bases, it may be eleven to fifteen bases, or it may be sixteen to twenty bases. The forward and reverse primers may be designed to hybridize a different number of bases away from the polymorphic site.

PCR assay can be generated in large numbers, however, the interactions between different PCR assays makes it difficult to multiplex them beyond about one hundred assays. Various complex molecular approaches can be used to increase the level of multiplexing, but it may still be limited to fewer than 100, perhaps 200, or possibly 500 assays per reaction. Samples with large quantities of DNA can be split among multiple sub-reactions and then recombined before sequencing. For samples where either the overall sample or some subpopulation of DNA molecules is limited, splitting the sample would introduce statistical noise. In an embodiment, a small or limited quantity of DNA may refer to an amount below 10 pg, between 10 and 100 pg, between 100 pg and 1 ng, between 1 and 10 ng, or between 10 and 100 ng. Note that while this method is particularly useful on small amounts of DNA where other methods that involve splitting into multiple pools can cause significant problems related to introduced stochastic noise, this method still provides the benefit of minimizing bias when it is run on samples of any quantity of DNA. In these situations, a universal pre-amplification step may be used to increase the overall sample quantity. Ideally, this pre-amplification step should not appreciably alter the allelic distributions.

In an embodiment, a method of the present disclosure can generate PCR products that are specific to a large number of targeted loci, specifically 1,000 to 5,000 loci, 5,000 to 10,000 loci or more than 10,000 loci, for genotyping by sequencing or some other genotyping method, from limited samples such as single cells or DNA from body fluids. Currently, performing multiplex PCR reactions of more than 5 to 10 targets presents a major challenge and is often hindered by primer side products, such as primer dimers, and other artifacts. When detecting target sequences using microarrays with hybridization probes, primer dimers and other artifacts may be ignored, as these are not detected. However, when using sequencing as a method of detection, the vast majority of the sequencing reads would sequence such artifacts and not the desired target sequences in a sample. Methods described in the prior art used to multiplex more than 50 or 100 reactions in one reaction volume followed by sequencing will typically result in more than 20%, and often more than 50%, in many cases more than 80% and in some cases more than 90% off-target sequence reads.

In general, to perform targeted sequencing of multiple (n) targets of a sample (greater than 50, greater than 100, greater than 500, or greater than 1,000), one can split the sample into a number of parallel reactions that amplify one individual target. This has been performed in PCR multiwell plates or can be done in commercial platforms such as the FLUIDIGM ACCESS ARRAY (48 reactions per sample in microfluidic chips) or DROPLET PCR by RAIN DANCE TECHNOLOGY (100s to a few thousands of targets). Unfortunately, these split-and-pool methods are problematic for samples with a limited amount of DNA, as there is often not enough copies of the genome to ensure that there is one copy of each region of the genome in each well. This is an especially severe problem when polymorphic loci are targeted, and the relative proportions of the alleles at the polymorphic loci are needed, as the stochastic noise introduced by the splitting and pooling will cause very poorly accurate measurements of the proportions of the alleles that were present in the original sample of DNA. Described here is a method to effectively and efficiently amplify many PCR reactions that is applicable to cases where only a limited amount of DNA is available. In an embodiment, the method may be applied for analysis of single cells, body fluids, mixtures of DNA such as the free floating DNA found in maternal plasma, biopsies, environmental and/or forensic samples.

In an embodiment, the targeted sequencing may involve one, a plurality, or all of the following steps. a) Generate and amplify a library with adaptor sequences on both ends of DNA fragments. b) Divide into multiple reactions after library amplification. c) Generate and optionally amplify a library with adaptor sequences on both ends of DNA fragments. d) Perform 1000- to 10,000-plex amplification of selected targets using one target specific "Forward" primer per target and one tag specific primer. e) Perform a second amplification from this product using "Reverse" target specific primers and one (or more) primer specific to a universal tag that was introduced as part of the target specific forward primers in the first round. f) Perform a 1000-plex preamplification of selected target for a limited number of cycles. g) Divide the product into multiple aliquots and amplify subpools of targets in individual reactions (for example, 50 to 500-plex, though this can be used all the way down to singleplex. h) Pool products of parallel subpools reactions. i) During these amplifications primers may carry sequencing compatible tags (partial or full length) such that the products can be sequenced.

Highly Multiplexed PCR

Disclosed herein are methods that permit the targeted amplification of over a hundred to tens of thousands of target sequences (e.g., SNP loci) from a nucleic acid sample such as genomic DNA obtained from plasma. The amplified sample may be relatively free of primer dimer products and have low allelic bias at target loci. If during or after amplification the products are appended with sequencing compatible adaptors, analysis of these products can be performed by sequencing.

Performing a highly multiplexed PCR amplification using methods known in the art results in the generation of primer dimer products that are in excess of the desired amplification products and not suitable for sequencing. These can be reduced empirically by eliminating primers that form these products, or by performing in silico selection of primers. However, the larger the number of assays, the more difficult this problem becomes.

One solution is to split the 5000-plex reaction into several lower-plexed amplifications, e.g. one hundred 50-plex or fifty 100-plex reactions, or to use microfluidics or even to split the sample into individual PCR reactions. However, if the sample DNA is limited, such as in non-invasive prenatal diagnostics from pregnancy plasma, dividing the sample between multiple reactions should be avoided as this will result in bottlenecking.

Described herein are methods to first globally amplify the plasma DNA of a sample and then divide the sample up into multiple multiplexed target enrichment reactions with more moderate numbers of target sequences per reaction. In an embodiment, a method of the present disclosure can be used for preferentially enriching a DNA mixture at a plurality of loci, the method comprising one or more of the following steps: generating and amplifying a library from a mixture of DNA where the molecules in the library have adaptor sequences ligated on both ends of the DNA fragments, dividing the amplified library into multiple reactions, performing a first round of multiplex amplification of selected targets using one target specific "forward" primer per target and one or a plurality of adaptor specific universal "reverse" primers. In an embodiment, a method of the present disclosure further includes performing a second amplification using "reverse" target specific primers and one or a plurality of primers specific to a universal tag that was introduced as part of the target specific forward primers in the first round. In an embodiment, the method may involve a fully nested, hemi-nested, semi-nested, one sided fully nested, one sided hemi-nested, or one sided semi-nested PCR approach. In an embodiment, a method of the present disclosure is used for preferentially enriching a DNA mixture at a plurality of loci, the method comprising performing a multiplex preamplification of selected targets for a limited number of cycles, dividing the product into multiple aliquots and amplifying subpools of targets in individual reactions, and pooling products of parallel subpools reactions. Note that this approach could be used to perform targeted amplification in a manner that would result in low levels of allelic bias for 50-500 loci, for 500 to 5,000 loci, for 5,000 to 50,000 loci, or even for 50,000 to 500,000 loci. In an embodiment, the primers carry partial or full length sequencing compatible tags.

The workflow may entail (1) extracting DNA such as plasma DNA, (2) preparing fragment library with universal adaptors on both ends of fragments, (3) amplifying the library using universal primers specific to the adaptors, (4) dividing the amplified sample "library" into multiple aliquots, (5) performing multiplex (e.g. about 100-plex, 1,000, or 10,000-plex with one target specific primer per target and a tag-specific primer) amplifications on aliquots, (6) pooling aliquots of one sample, (7) barcoding the sample, (8) mixing the samples and adjusting the concentration, (9) sequencing the sample. The workflow may comprise multiple sub-steps that contain one of the listed steps (e.g. step (2) of preparing the library step could entail three enzymatic steps (blunt ending, dA tailing and adaptor ligation) and three purification steps). Steps of the workflow may be combined, divided up or performed in different order (e.g. bar coding and pooling of samples).

It is important to note that the amplification of a library can be performed in such a way that it is biased to amplify short fragments more efficiently. In this manner it is possible to preferentially amplify shorter sequences, e.g. mononucleosomal DNA fragments as the cell free fetal DNA (of placental origin) found in the circulation of pregnant women. Note that PCR assays can have the tags, for example sequencing tags, (usually a truncated form of 15-25 bases). After multiplexing, PCR multiplexes of a sample are pooled and then the tags are completed (including bar coding) by a tag-specific PCR (could also be done by ligation). Also, the full sequencing tags can be added in the same reaction as the multiplexing. In the first cycles targets may be amplified with the target specific primers, subsequently the tag-specific primers take over to complete the SQ-adaptor sequence. The PCR primers may carry no tags. The sequencing tags may be appended to the amplification products by ligation.

In an embodiment, highly multiplex PCR followed by evaluation of amplified material by clonal sequencing may be used for various applications such as the detection of fetal aneuploidy. Whereas traditional multiplex PCRs evaluate up to fifty loci simultaneously, the approach described herein may be used to enable simultaneous evaluation of more than 50 loci simultaneously, more than 100 loci simultaneously, more than 500 loci simultaneously, more than 1,000 loci simultaneously, more than 5,000 loci simultaneously, more than 10,000 loci simultaneously, more than 50,000 loci simultaneously, and more than 100,000 loci simultaneously. Experiments have shown that up to, including and more than 10,000 distinct loci can be evaluated simultaneously, in a single reaction, with sufficiently good efficiency and specificity to make non-invasive prenatal aneuploidy diagnoses and/or copy number calls with high accuracy. Assays may be combined in a single reaction with the entirety of a sample such as a cfDNA sample isolated from maternal plasma, a fraction thereof, or a further processed derivative of the cfDNA sample. The sample (e.g., cfDNA or derivative) may also be split into multiple parallel multiplex reactions. The optimum sample splitting and multiplex is determined by trading off various performance specifications. Due to the limited amount of material, splitting the sample into multiple fractions can introduce sampling noise, handling time, and increase the possibility of error. Conversely, higher multiplexing can result in greater amounts of spurious amplification and greater inequalities in amplification both of which can reduce test performance.

Two crucial related considerations in the application of the methods described herein are the limited amount of original sample (e.g., plasma) and the number of original molecules in that material from which allele frequency or other measurements are obtained. If the number of original molecules falls below a certain level, random sampling noise becomes significant, and can affect the accuracy of the test. Typically, data of sufficient quality for making non-invasive prenatal aneuploidy diagnoses can be obtained if measurements are made on a sample comprising the equivalent of 500-1000 original molecules per target locus. There are a number of ways of increasing the number of distinct measurements, for example increasing the sample volume. Each manipulation applied to the sample also potentially results in losses of material. It is essential to characterize losses incurred by various manipulations and avoid, or as necessary improve yield of certain manipulations to avoid losses that could degrade performance of the test.

In an embodiment, it is possible to mitigate potential losses in subsequent steps by amplifying all or a fraction of the original sample (e.g., cfDNA sample). Various methods are available to amplify all of the genetic material in a sample, increasing the amount available for downstream procedures. In an embodiment, ligation mediated PCR (LM-PCR) DNA fragments are amplified by PCR after ligation of either one distinct adaptors, two distinct adapters, or many distinct adaptors. In an embodiment, multiple displacement amplification (MDA) phi-29 polymerase is used to amplify all DNA isothermally. In DOP-PCR and variations, random priming is used to amplify the original material DNA. Each method has certain characteristics such as uniformity of amplification across all represented regions of the genome, efficiency of capture and amplification of original DNA, and amplification performance as a function of the length of the fragment.

In an embodiment LM-PCR may be used with a single heteroduplexed adaptor having a 3-prime tyrosine. The heteroduplexed adaptor enables the use of a single adaptor molecule that may be converted to two distinct sequences on 5-prime and 3-prime ends of the original DNA fragment during the first round of PCR. In an embodiment, it is possible to fractionate the amplified library by size separations, or products such as AMPURE, TASS or other similar methods. Prior to ligation, sample DNA may be blunt ended, and then a single adenosine base is added to the 3-prime end. Prior to ligation the DNA may be cleaved using a restriction enzyme or some other cleavage method. During ligation the 3-prime adenosine of the sample fragments and the complementary 3-prime tyrosine overhang of adaptor can enhance ligation efficiency. The extension step of the PCR amplification may be limited from a time standpoint to reduce amplification from fragments longer than about 200 bp, about 300 bp, about 400 bp, about 500 bp or about 1,000 bp. Since longer DNA found in the maternal plasma is nearly exclusively maternal, this may result in the enrichment of fetal DNA by 10-50% and improvement of test performance. A number of reactions were run using conditions as specified by commercially available kits; the resulted in successful ligation of fewer than 10% of sample DNA molecules. A series of optimizations of the reaction conditions for this improved ligation to approximately 70%.

Mini-PCR

The following Mini-PCR method is desirable for samples containing short nucleic acids, digested nucleic acids, or fragmented nucleic acids, such as cfDNA. Traditional PCR assay design results in significant losses of distinct fetal molecules, but losses can be greatly reduced by designing very short PCR assays, termed mini-PCR assays. Fetal cfDNA in maternal serum is highly fragmented and the fragment sizes are distributed in approximately a Gaussian fashion with a mean of 160 bp, a standard deviation of 15 bp, a minimum size of about 100 bp, and a maximum size of about 220 bp. The distribution of fragment start and end positions with respect to the targeted polymorphisms, while not necessarily random, vary widely among individual targets and among all targets collectively and the polymorphic site of one particular target locus may occupy any position from the start to the end among the various fragments originating from that locus. Note that the term mini-PCR may equally well refer to normal PCR with no additional restrictions or limitations.

During PCR, amplification will only occur from template DNA fragments comprising both forward and reverse primer sites. Because fetal cfDNA fragments are short, the likelihood of both primer sites being present the likelihood of a fetal fragment of length L comprising both the forward and reverse primers sites is ratio of the length of the amplicon to the length of the fragment. Under ideal conditions, assays in which the amplicon is 45, 50, 55, 60, 65, or 70 bp will successfully amplify from 72%, 69%, 66%, 63%, 59%, or 56%, respectively, of available template fragment molecules. The amplicon length is the distance between the 5-prime ends of the forward and reverse priming sites. Amplicon length that is shorter than typically used by those known in the art may result in more efficient measurements of the desired polymorphic loci by only requiring short sequence reads. In an embodiment, a substantial fraction of the amplicons should be less than 100 bp, less than 90 bp, less than 80 bp, less than 70 bp, less than 65 bp, less than 60 bp, less than 55 bp, less than 50 bp, or less than 45 bp.

Note that in methods known in the prior art, short assays such as those described herein are usually avoided because they are not required and they impose considerable constraint on primer design by limiting primer length, annealing characteristics, and the distance between the forward and reverse primer.

Also note that there is the potential for biased amplification if the 3-prime end of the either primer is within roughly 1-6 bases of the polymorphic site. This single base difference at the site of initial polymerase binding can result in preferential amplification of one allele, which can alter observed allele frequencies and degrade performance. All of these constraints make it very challenging to identify primers that will amplify a particular locus successfully and furthermore, to design large sets of primers that are compatible in the same multiplex reaction. In an embodiment, the 3' end of the inner forward and reverse primers are designed to hybridize to a region of DNA upstream from the polymorphic site, and separated from the polymorphic site by a small number of bases. Ideally, the number of bases may be between 6 and 10 bases, but may equally well be between 4 and 15 bases, between three and 20 bases, between two and 30 bases, or between 1 and 60 bases, and achieve substantially the same end.

Multiplex PCR may involve a single round of PCR in which all targets are amplified or it may involve one round of PCR followed by one or more rounds of nested PCR or some variant of nested PCR. Nested PCR consists of a subsequent round or rounds of PCR amplification using one or more new primers that bind internally, by at least one base pair, to the primers used in a previous round. Nested PCR reduces the number of spurious amplification targets by amplifying, in subsequent reactions, only those amplification products from the previous one that have the correct internal sequence. Reducing spurious amplification targets improves the number of useful measurements that can be obtained, especially in sequencing. Nested PCR typically entails designing primers completely internal to the previous primer binding sites, necessarily increasing the minimum DNA segment size required for amplification. For samples such as maternal plasma cfDNA, in which the DNA is highly fragmented, the larger assay size reduces the number of distinct cfDNA molecules from which a measurement can be obtained. In an embodiment, to offset this effect, one may use a partial nesting approach where one or both of the second round primers overlap the first binding sites extending internally some number of bases to achieve additional specificity while minimally increasing in the total assay size.

In an embodiment, a multiplex pool of PCR assays are designed to amplify potentially heterozygous SNP or other polymorphic or non-polymorphic loci on one or more chromosomes and these assays are used in a single reaction to amplify DNA. The number of PCR assays may be between 50 and 200 PCR assays, between 200 and 1,000 PCR assays, between 1,000 and 5,000 PCR assays, or between 5,000 and 20,000 PCR assays (50 to 200-plex, 200 to 1,000-plex, 1,000 to 5,000-plex, 5,000 to 20,000-plex, more than 20,000-plex respectively). In an embodiment, a multiplex pool of about 10,000 PCR assays (10,000-plex) are designed to amplify potentially heterozygous SNP loci on chromosomes X, Y, 13, 18, and 21 and 1 or 2 and these assays are used in a single reaction to amplify cfDNA obtained from a material plasma sample, chorion villus samples, amniocentesis samples, single or a small number of cells, other bodily fluids or tissues, cancers, or other genetic matter. The SNP frequencies of each locus may be determined by clonal or some other method of sequencing of the amplicons. Statistical analysis of the allele frequency distributions or ratios of all assays may be used to determine if the sample contains a trisomy of one or more of the chromosomes included in the test. In another embodiment the original cfDNA samples is split into two samples and parallel 5,000-plex assays are performed. In another embodiment the original cfDNA samples is split into n samples and parallel (10,000/n)-plex assays are performed where n is between 2 and 12, or between 12 and 24, or between 24 and 48, or between 48 and 96. Data is collected and analyzed in a similar manner to that already described. Note that this method is equally well applicable to detecting translocations, deletions, duplications, and other chromosomal abnormalities.

In an embodiment, tails with no homology to the target genome may also be added to the 3-prime or 5-prime end of any of the primers. These tails facilitate subsequent manipulations, procedures, or measurements. In an embodiment, the tail sequence can be the same for the forward and reverse target specific primers. In an embodiment, different tails may be used for the forward and reverse target specific primers. In an embodiment, a plurality of different tails may be used for different loci or sets of loci. Certain tails may be shared among all loci or among subsets of loci. For example, using forward and reverse tails corresponding to forward and reverse sequences required by any of the current sequencing platforms can enable direct sequencing following amplification. In an embodiment, the tails can be used as common priming sites among all amplified targets that can be used to add other useful sequences. In some embodiments, the inner primers may contain a region that is designed to hybridize either upstream or downstream of the targeted locus (e.g., a polymorphic locus). In some embodiments, the primers may contain a molecular barcode. In some embodiments, the primer may contain a universal priming sequence designed to allow PCR amplification.

In an embodiment, a 10,000-plex PCR assay pool is created such that forward and reverse primers have tails corresponding to the required forward and reverse sequences required by a high throughput sequencing instrument such as the HISEQ, GAIIX, or MYSEQ available from ILLUMINA. In addition, included 5-prime to the sequencing tails is an additional sequence that can be used as a priming site in a subsequent PCR to add nucleotide barcode sequences to the amplicons, enabling multiplex sequencing of multiple samples in a single lane of the high throughput sequencing instrument.

In an embodiment, a 10,000-plex PCR assay pool is created such that reverse primers have tails corresponding to the required reverse sequences required by a high throughput sequencing instrument. After amplification with the first 10,000-plex assay, a subsequent PCR amplification may be performed using another 10,000-plex pool having partly nested forward primers (e.g. 6-bases nested) for all targets and a reverse primer corresponding to the reverse sequencing tail included in the first round. This subsequent round of partly nested amplification with just one target specific primer and a universal primer limits the required size of the assay, reducing sampling noise, but greatly reduces the number of spurious amplicons. The sequencing tags can be added to appended ligation adaptors and/or as part of PCR probes, such that the tag is part of the final amplicon.

Fetal fraction affects performance of the test. There are a number of ways to enrich the fetal fraction of the DNA found in maternal plasma. Fetal fraction can be increased by the previously described LM-PCR method already discussed as well as by a targeted removal of long maternal fragments. In an embodiment, prior to multiplex PCR amplification of the target loci, an additional multiplex PCR reaction may be carried out to selectively remove long and largely maternal fragments corresponding to the loci targeted in the subsequent multiplex PCR. Additional primers are designed to anneal a site a greater distance from the polymorphism than is expected to be present among cell free fetal DNA fragments. These primers may be used in a one cycle multiplex PCR reaction prior to multiplex PCR of the target polymorphic loci. These distal primers are tagged with a molecule or moiety that can allow selective recognition of the tagged pieces of DNA. In an embodiment, these molecules of DNA may be covalently modified with a biotin molecule that allows removal of newly formed double stranded DNA comprising these primers after one cycle of PCR. Double stranded DNA formed during that first round is likely maternal in origin. Removal of the hybrid material may be accomplished by the use of magnetic streptavidin beads. There are other methods of tagging that may work equally well. In an embodiment, size selection methods may be used to enrich the sample for shorter strands of DNA; for example, those less than about 800 bp, less than about 500 bp, or less than about 300 bp. Amplification of short fragments can then proceed as usual.

The mini-PCR method described in this disclosure enables highly multiplexed amplification and analysis of hundreds to thousands or even millions of loci in a single reaction, from a single sample. At the same, the detection of the amplified DNA can be multiplexed; tens to hundreds of samples can be multiplexed in one sequencing lane by using barcoding PCR. This multiplexed detection has been successfully tested up to 49-plex, and a much higher degree of multiplexing is possible. In effect, this allows hundreds of samples to be genotyped at thousands of SNPs in a single sequencing run. For these samples, the method allows determination of genotype and heterozygosity rate and simultaneously determination of copy number, both of which may be used for the purpose of aneuploidy detection. This method is particularly useful in detecting aneuploidy of a gestating fetus from the free floating DNA found in maternal plasma. This method may be used as part of a method for sexing a fetus, and/or predicting the paternity of the fetus. It may be used as part of a method for mutation dosage. This method may be used for any amount of DNA or RNA, and the targeted regions may be SNPs, other polymorphic regions, non-polymorphic regions, and combinations thereof.

In some embodiments, ligation mediated universal-PCR amplification of fragmented DNA may be used. The ligation mediated universal-PCR amplification can be used to amplify plasma DNA, which can then be divided into multiple parallel reactions. It may also be used to preferentially amplify short fragments, thereby enriching fetal fraction. In some embodiments the addition of tags to the fragments by ligation can enable detection of shorter fragments, use of shorter target sequence specific portions of the primers and/or annealing at higher temperatures which reduces unspecific reactions.

The methods described herein may be used for a number of purposes where there is a target set of DNA that is mixed with an amount of contaminating DNA. In some embodiments, the target DNA and the contaminating DNA may be from individuals who are genetically related. For example, genetic abnormalities in a fetus (target) may be detected from maternal plasma which contains fetal (target) DNA and also maternal (contaminating) DNA; the abnormalities include whole chromosome abnormalities (e.g. aneuploidy) partial chromosome abnormalities (e.g. deletions, duplications, inversions, translocations), polynucleotide polymorphisms (e.g. STRs), single nucleotide polymorphisms, and/or other genetic abnormalities or differences. In some embodiments, the target and contaminating DNA may be from the same individual, but where the target and contaminating DNA are different by one or more mutations, for example in the case of cancer. (see e.g. H. Mamon et al. *Preferential Amplification of Apoptotic DNA from Plasma: Potential for Enhancing Detection of Minor DNA Alterations in Circulating DNA*. Clinical Chemistry 54:9 (2008). In some embodiments, the DNA may be found in cell culture (apoptotic) supernatant. In some embodiments, it is possible to induce apoptosis in biological samples (e.g., blood) for subsequent library preparation, amplification and/or sequencing. A number of enabling workflows and protocols to achieve this end are presented elsewhere in this disclosure.

In some embodiments, the target DNA may originate from single cells, from samples of DNA consisting of less than one copy of the target genome, from low amounts of DNA, from DNA from mixed origin (e.g. pregnancy plasma: placental and maternal DNA; cancer patient plasma and tumors: mix between healthy and cancer DNA, transplantation etc), from other body fluids, from cell cultures, from culture supernatants, from forensic samples of DNA, from ancient samples of DNA (e.g. insects trapped in amber), from other samples of DNA, and combinations thereof.

In some embodiments, a short amplicon size may be used. Short amplicon sizes are especially suited for fragmented DNA (see e.g. A. Sikora, et sl. Detection of increased amounts of cell-free fetal DNA with short PCR amplicons. Clin Chem. 2010 January; 56(1):136-8.)

The use of short amplicon sizes may result in some significant benefits. Short amplicon sizes may result in optimized amplification efficiency. Short amplicon sizes typically produce shorter products, therefore there is less chance for nonspecific priming. Shorter products can be clustered more densely on sequencing flow cell, as the clusters will be smaller. Note that the methods described herein may work equally well for longer PCR amplicons. Amplicon length may be increased if necessary, for example, when sequencing larger sequence stretches. Experiments with 146-plex targeted amplification with assays of 100 bp to 200 bp length as first step in a nested-PCR protocol were run on single cells and on genomic DNA with positive results.

In some embodiments, the methods described herein may be used to amplify and/or detect SNPs, copy number, nucleotide methylation, mRNA levels, other types of RNA expression levels, other genetic and/or epigenetic features. The mini-PCR methods described herein may be used along with next-generation sequencing; it may be used with other downstream methods such as microarrays, counting by digital PCR, real-time PCR, Mass-spectrometry analysis etc.

In some embodiment, the mini-PCR amplification methods described herein may be used as part of a method for accurate quantification of minority populations. It may be used for absolute quantification using spike calibrators. It may be used for mutation/minor allele quantification through very deep sequencing, and may be run in a highly multiplexed fashion. It may be used for standard paternity and identity testing of relatives or ancestors, in human, animals, plants or other creatures. It may be used for forensic testing. It may be used for rapid genotyping and copy number analysis (CN), on any kind of material, e.g. amniotic fluid and CVS, sperm, product of conception (POC). It may be used for single cell analysis, such as genotyping on samples biopsied from embryos. It may be used for rapid embryo analysis (within less than one, one, or two days of biopsy) by targeted sequencing using min-PCR.

In some embodiments, it may be used for tumor analysis: tumor biopsies are often a mixture of health and tumor cells. Targeted PCR allows deep sequencing of SNPs and loci with close to no background sequences. It may be used for copy number and loss of heterozygosity analysis on tumor DNA. Said tumor DNA may be present in many different body fluids or tissues of tumor patients. It may be used for detection of tumor recurrence, and/or tumor screening. It may be used for quality control testing of seeds. It may be used for breeding, or fishing purposes. Note that any of these methods could equally well be used targeting non-polymorphic loci for the purpose of ploidy calling.

Some literature describing some of the fundamental methods that underlie the methods disclosed herein include: (1) Wang H Y, Luo M, Tereshchenko I V, Frikker D M, Cui X, Li J Y, Hu G, Chu Y, Azaro M A, Lin Y, Shen L, Yang Q, Kambouris M E, Gao R, Shih W, Li H. Genome Res. 2005 February; 15(2):276-83. Department of Molecular Genetics, Microbiology and Immunology/The Cancer Institute of New Jersey, Robert Wood Johnson Medical School, New Brunswick, N.J. 08903, USA. (2) High-throughput genotyping of single nucleotide polymorphisms with high sensitivity. Li H, Wang H Y, Cui X, Luo M, Hu G, Greenawalt D M, Tereshchenko I V, Li J Y, Chu Y, Gao R. Methods Mol Biol.

2007; 396-PubMed PMID: 18025699. (3) A method comprising multiplexing of an average of 9 assays for sequencing is described in: Nested Patch PCR enables highly multiplexed mutation discovery in candidate genes. Varley K E, Mitra R D. Genome Res. 2008 November; 18(11): 1844-50. Epub 2008 Oct. 10. Note that the methods disclosed herein allow multiplexing of orders of magnitude more than in the above references.

Targeted PCR Variants—Nesting

There are many workflows that are possible when conducting PCR; some workflows typical to the methods disclosed herein are described. The steps outlined herein are not meant to exclude other possible steps nor does it imply that any of the steps described herein are required for the method to work properly. A large number of parameter variations or other modifications are known in the literature, and may be made without affecting the essence of the invention. One particular generalized workflow is given below followed by a number of possible variants. The variants typically refer to possible secondary PCR reactions, for example different types of nesting that may be done (step 3). It is important to note that variants may be done at different times, or in different orders than explicitly described herein. Examples that use polymorphic loci for illustration can be readily adapted for the amplification of nonpolymorphic loci if desired.

1. The DNA in the sample may have ligation adapters, often referred to as library tags or ligation adaptor tags (LTs), appended, where the ligation adapters contain a universal priming sequence, followed by a universal amplification. In an embodiment, this may be done using a standard protocol designed to create sequencing libraries after fragmentation. In an embodiment, the DNA sample can be blunt ended, and then an A can be added at the 3' end. A Y-adaptor with a T-overhang can be added and ligated. In some embodiments, other sticky ends can be used other than an A or T overhang. In some embodiments, other adaptors can be added, for example looped ligation adaptors. In some embodiments, the adaptors may have tag designed for PCR amplification.

2. Specific Target Amplification (STA): Pre-amplification of hundreds to thousands to tens of thousands and even hundreds of thousands of targets may be multiplexed in one reaction volume. STA is typically run from 10 to 30 cycles, though it may be run from 5 to 40 cycles, from 2 to 50 cycles, and even from 1 to 100 cycles. Primers may be tailed, for example for a simpler workflow or to avoid sequencing of a large proportion of dimers. Note that typically, dimers of both primers carrying the same tag will not be amplified or sequenced efficiently. In some embodiments, between 1 and 10 cycles of PCR may be carried out; in some embodiments between 10 and 20 cycles of PCR may be carried out; in some embodiments between 20 and 30 cycles of PCR may be carried out; in some embodiments between 30 and 40 cycles of PCR may be carried out; in some embodiments more than 40 cycles of PCR may be carried out. The amplification may be a linear amplification. The number of PCR cycles may be optimized to result in an optimal depth of read (DOR) profile. Different DOR profiles may be desirable for different purposes. In some embodiments, a more even distribution of reads between all assays is desirable; if the DOR is too small for some assays, the stochastic noise can be too high for the data to be too useful, while if the depth of read is too high, the marginal usefulness of each additional read is relatively small.

Primer tails may improve the detection of fragmented DNA from universally tagged libraries. If the library tag and the primer-tails contain a homologous sequence, hybridization can be improved (for example, melting temperature ($T_M$) is lowered) and primers can be extended if only a portion of the primer target sequence is in the sample DNA fragment. In some embodiments, 13 or more target specific base pairs may be used. In some embodiments, 10 to 12 target specific base pairs may be used. In some embodiments, 8 to 9 target specific base pairs may be used. In some embodiments, 6 to 7 target specific base pairs may be used. In some embodiments, STA may be performed on pre-amplified DNA, e.g. MDA, RCA, other whole genome amplifications, or adaptor-mediated universal PCR. In some embodiments, STA may be performed on samples that are enriched or depleted of certain sequences and populations, e.g. by size selection, target capture, directed degradation.

3. In some embodiments, it is possible to perform secondary multiplex PCRs or primer extension reactions to increase specificity and reduce undesirable products. For example, full nesting, semi-nesting, hemi-nesting, and/or subdividing into parallel reactions of smaller assay pools are all techniques that may be used to increase specificity. Experiments have shown that splitting a sample into three 400-plex reactions resulted in product DNA with greater specificity than one 1,200-plex reaction with exactly the same primers. Similarly, experiments have shown that splitting a sample into four 2,400-plex reactions resulted in product DNA with greater specificity than one 9,600-plex reaction with exactly the same primers. In an embodiment, it is possible to use target-specific and tag specific primers of the same and opposing directionality.

4. In some embodiments, it is possible to amplify a DNA sample (dilution, purified or otherwise) produced by an STA reaction using tag-specific primers and "universal amplification", i.e. to amplify many or all pre-amplified and tagged targets. Primers may contain additional functional sequences, e.g. barcodes, or a full adaptor sequence necessary for sequencing on a high throughput sequencing platform.

These methods may be used for analysis of any sample of DNA, and are especially useful when the sample of DNA is particularly small, or when it is a sample of DNA where the DNA originates from more than one individual, such as in the case of maternal plasma. These methods may be used on DNA samples such as a single or small number of cells, genomic DNA, plasma DNA, amplified plasma libraries, amplified apoptotic supernatant libraries, or other samples of mixed DNA. In an embodiment, these methods may be used in the case where cells of different genetic constitution may be present in a single individual, such as with cancer or transplants. In an embodiment, some of the DNA is from the recipient of a transplant (such as recipient cell-free or cellular DNA) and some of the DNA is from the donor of the transplant (such as cell-free or cellular DNA from the transplant). In an embodiment, the method is used to amplify one or more loci that differ between the recipient and the donor (such as loci for which a different combination of alleles are present in the recipient compared to the donor). In some embodiments, the recipient is homozygous for a first allele (such as AA) and the donor is homozygous for a second allele (such as BB) or is heterozygous with the first allele and a second allele (such as AB) at one or more loci. In some embodiments, the method is used to measure the absolute or relative amount of DNA from the donor of the transplant (such as cell-free or cellular DNA from the transplant). In some embodiments, this method is used to prognose, diagnose, detect, or monitor a transplant status or outcome, such as transplant rejection, tolerance, non-rejection based allograft injury, transplant function, transplant survival, chronic transplant injury, or tittering of pharmacological immunosuppression.

Protocol Variants (Variants and/or Additions to the Workflow Above)

Direct Multiplexed Mini-PCR: Specific target amplification (STA) of a plurality of target sequences with tagged primers is shown in FIG. 1. 101 denotes double stranded DNA with a polymorphic locus of interest at X. 102 denotes the double stranded DNA with ligation adaptors added for universal amplification. 103 denotes the single stranded DNA that has been universally amplified with PCR primers hybridized. 104 denotes the final PCR product. In some embodiments, STA may be done on more than 100, more than 200, more than 500, more than 1,000, more than 2,000, more than 5,000, more than 10,000, more than 20,000, more than 50,000, more than 100,000 or more than 200,000 targets. In a subsequent reaction, tag-specific primers amplify all target sequences and lengthen the tags to include all necessary sequences for sequencing, including sample indexes. In an embodiment, primers may not be tagged or only certain primers may be tagged. Sequencing adaptors may be added by conventional adaptor ligation. In an embodiment, the initial primers may carry the tags.

In an embodiment, primers are designed so that the length of DNA amplified is unexpectedly short. Prior art demonstrates that ordinary people skilled in the art typically design 100+bp amplicons. In an embodiment, the amplicons may be designed to be less than 80 bp. In an embodiment, the amplicons may be designed to be less than 70 bp. In an embodiment, the amplicons may be designed to be less than 60 bp. In an embodiment, the amplicons may be designed to be less than 50 bp. In an embodiment, the amplicons may be designed to be less than 45 bp. In an embodiment, the amplicons may be designed to be less than 40 bp. In an embodiment, the amplicons may be designed to be less than 35 bp. In an embodiment, the amplicons may be designed to be between 40 and 65 bp.

An experiment was performed using this protocol using 1200-plex amplification. Both genomic DNA and pregnancy plasma were used; about 70% of sequence reads mapped to targeted sequences. Details are given elsewhere in this document. Sequencing of a 1042-plex without design and selection of assays resulted in >99% of sequences being primer dimer products.

Sequential PCR: After STA1 multiple aliquots of the product may be amplified in parallel with pools of reduced complexity with the same primers. The first amplification can give enough material to split. This method is especially good for small samples, for example those that are about 6-100 pg, about 100 pg to 1 ng, about 1 ng to 10 ng, or about 10 ng to 100 ng. The protocol was performed with 1200-plex into three 400-plexes. Mapping of sequencing reads increased from around 60 to 70% in the 1200-plex alone to over 95%.

Figure 2:
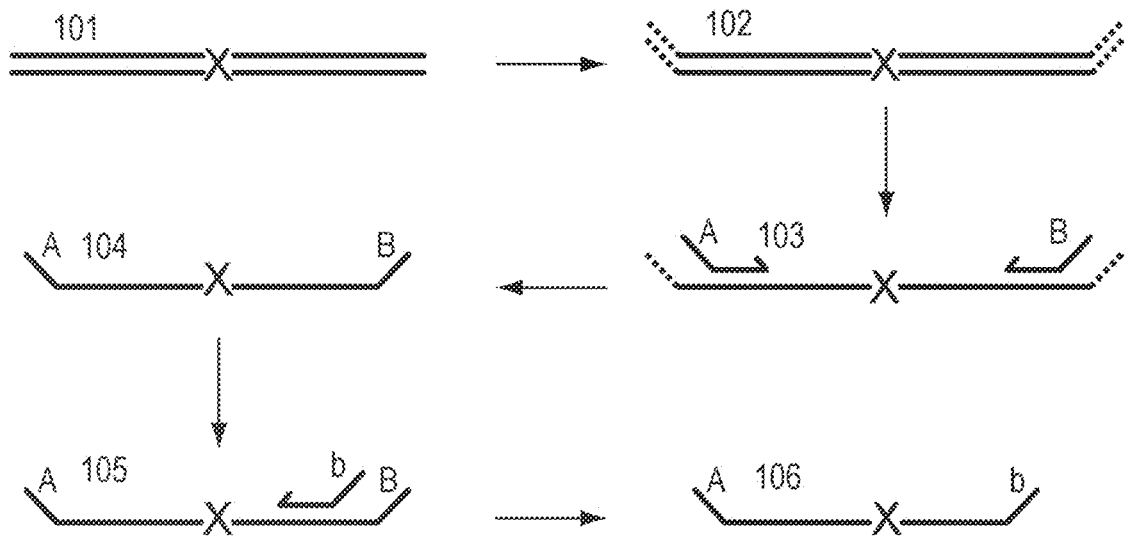
FIG. 2: Graphical representation of semi-nested mini-PCR method.

Semi-nested mini-PCR: (see FIG. 2) After STA 1 a second STA is performed comprising a multiplex set of internal nested Forward primers (103 B, 105 b) and one (or few) tag-specific Reverse primers (103 A). 101 denotes double stranded DNA with a polymorphic locus of interest at X. 102 denotes the double stranded DNA with ligation adaptors added for universal amplification. 103 denotes the single stranded DNA that has been universally amplified with Forward Primer B and Reverse Primer A hybridized. 104 denotes the PCR product from 103. 105 denotes the product from 104 with nested Forward primer b hybridized, and Reverse tag A already part of the molecule from the PCR that occurred between 103 and 104. 106 denotes the final PCR product. With this workflow usually greater than 95% of sequences map to the intended targets. The nested primer may overlap with the outer Forward primer sequence but introduces additional 3'-end bases. In some embodiments it is possible to use between one and 20 extra 3' bases. Experiments have shown that using 9 or more extra 3' bases in a 1200-plex designs works well. As readily apparent, the primers for the second STA can alternatively be considered a multiplex set of internal nested Reverse primers and one (or a few) tag-specific Forward primers.

Figure 3:
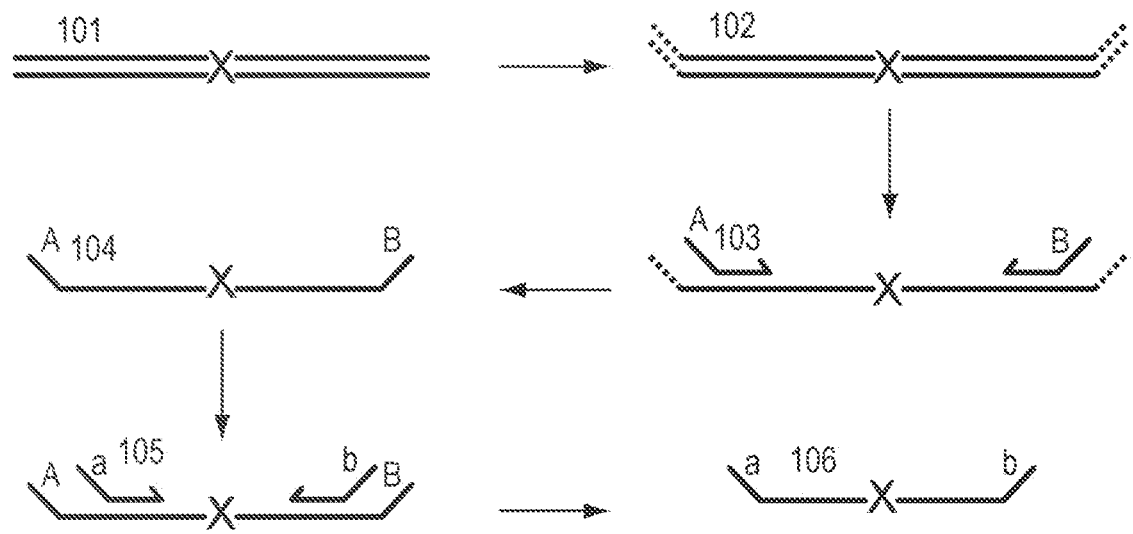
FIG. 3: Graphical representation of fully nested mini-PCR method.

Fully nested mini-PCR: (see FIG. 3) After STA step 1, it is possible to perform a second multiplex PCR (or parallel m.p. PCRs of reduced complexity) with two nested primers carrying tags (A, a, B, b). 101 denotes double stranded DNA with a polymorphic locus of interest at X. 102 denotes the double stranded DNA with ligation adaptors added for universal amplification. 103 denotes the single stranded DNA that has been universally amplified with Forward Primer B and Reverse Primer A hybridized. 104 denotes the PCR product from 103. 105 denotes the product from 104 with nested Forward primer b and nested Reverse primer a hybridized. 106 denotes the final PCR product. In some embodiments, it is possible to use two full sets of primers. Experiments using a fully nested mini-PCR protocol were used to perform 146-plex amplification on single and three cells without step 102 of appending universal ligation adaptors and amplifying.

Figure 4:
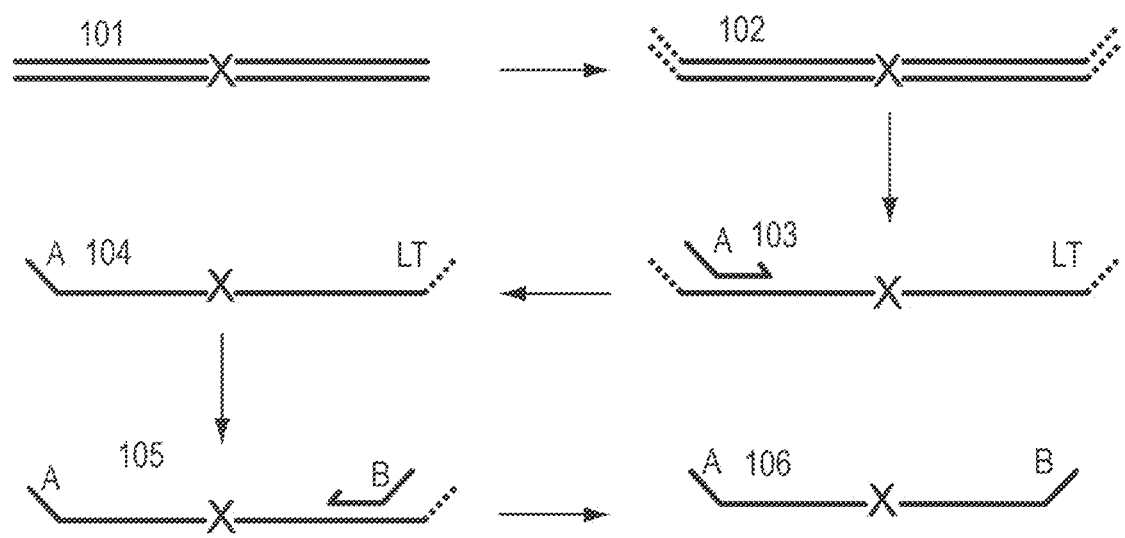
FIG. 4: Graphical representation of hemi-nested mini-PCR method.

Hemi-nested mini-PCR: (see FIG. 4) It is possible to use target DNA that has and adaptors at the fragment ends. STA is performed comprising a multiplex set of Forward primers (B) and one (or few) tag-specific Reverse primers (A). A second STA can be performed using a universal tag-specific Forward primer and target specific Reverse primer. 101 denotes double stranded DNA with a polymorphic locus of interest at X. 102 denotes the double stranded DNA with ligation adaptors added for universal amplification. 103 denotes the single stranded DNA that has been universally amplified with Reverse Primer A hybridized. 104 denotes the PCR product from 103 that was amplified using Reverse primer A and ligation adaptor tag primer LT. 105 denotes the product from 104 with Forward primer B hybridized. 106 denotes the final PCR product. In this workflow, target specific Forward and Reverse primers are used in separate reactions, thereby reducing the complexity of the reaction and preventing dimer formation of forward and reverse primers. Note that in this example, primers A and B may be considered to be first primers, and primers 'a' and 'b' may be considered to be inner primers. This method is a big improvement on direct PCR as it is as good as direct PCR, but it avoids primer dimers. After first round of hemi nested protocol one typically sees ~99% non-targeted DNA, however, after second round there is typically a big improvement. As readily apparent, the primers for the first STA can be considered a multiplex set of Reverse primers and one (or few) tag-specific Forward primers, and the primers for the second STA can be considered a universal tag-specific Reverse primer and target specific Forward primer(s).

Figure 5:
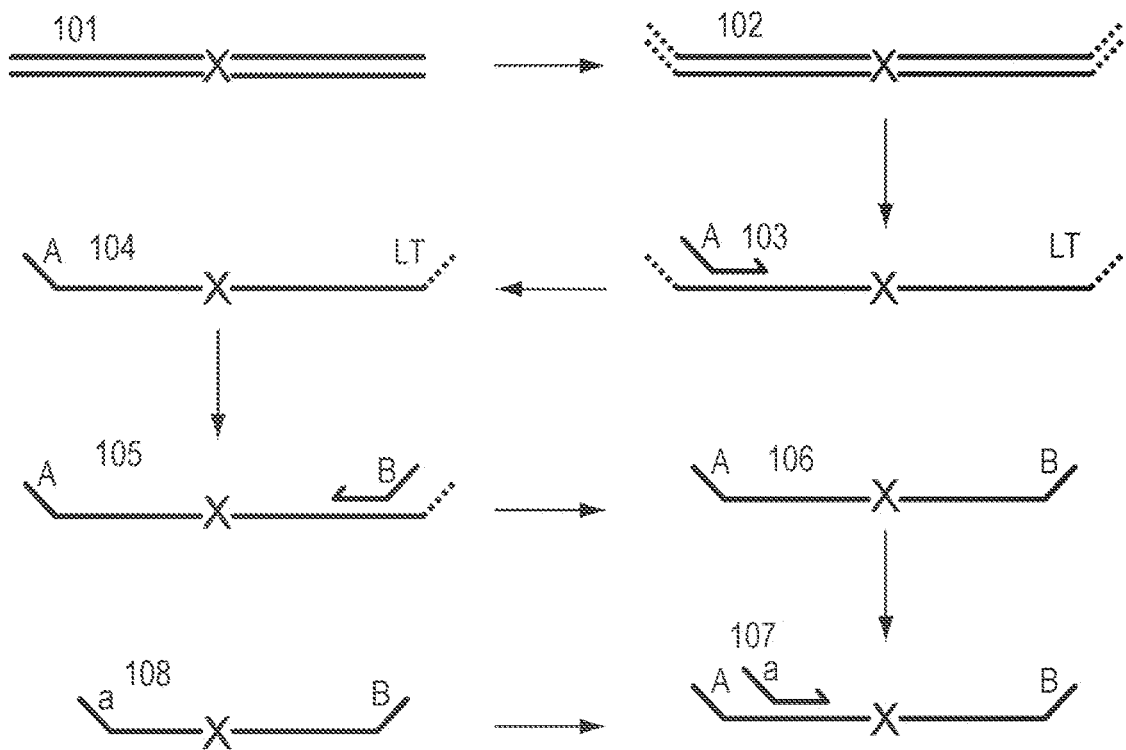
FIG. 5: Graphical representation of triply hemi-nested mini-PCR method.

Triply hemi-nested mini-PCR: (see FIG. 5) It is possible to use target DNA that has and adaptor at the fragment ends. STA is performed comprising a multiplex set of Forward primers (B) and one (or few) tag-specific Reverse primers (A) and (a). A second STA can be performed using a universal tag-specific Forward primer and target specific Reverse primer. 101 denotes double stranded DNA with a polymorphic locus of interest at X. 102 denotes the double stranded DNA with ligation adaptors added for universal amplification. 103 denotes the single stranded DNA that has been universally amplified with Reverse Primer A hybridized. 104 denotes the PCR product from 103 that was amplified using Reverse primer A and ligation adaptor tag primer LT. 105 denotes the product from 104 with Forward primer B hybridized. 106 denotes the PCR product from 105 that was amplified using Reverse primer A and Forward primer B. 107 denotes the product from 106 with Reverse primer 'a' hybridized. 108 denotes the final PCR product. Note that in this example, primers 'a' and B may be considered to be inner primers, and A may be considered to be a first primer. Optionally, both A and B may be considered to be first primers, and 'a' may be considered to be an inner primer. The designation of reverse and forward primers may be switched. In this workflow, target specific Forward and Reverse primers are used in separate reactions, thereby reducing the complexity of the reaction and preventing dimer formation of forward and reverse primers. This method is a big improvement on direct PCR as it is as good as direct PCR, but it avoids primer dimers. After first round of hemi nested protocol one typically sees ~99% non-targeted DNA, however, after second round there is typically a big improvement.

Figure 6:
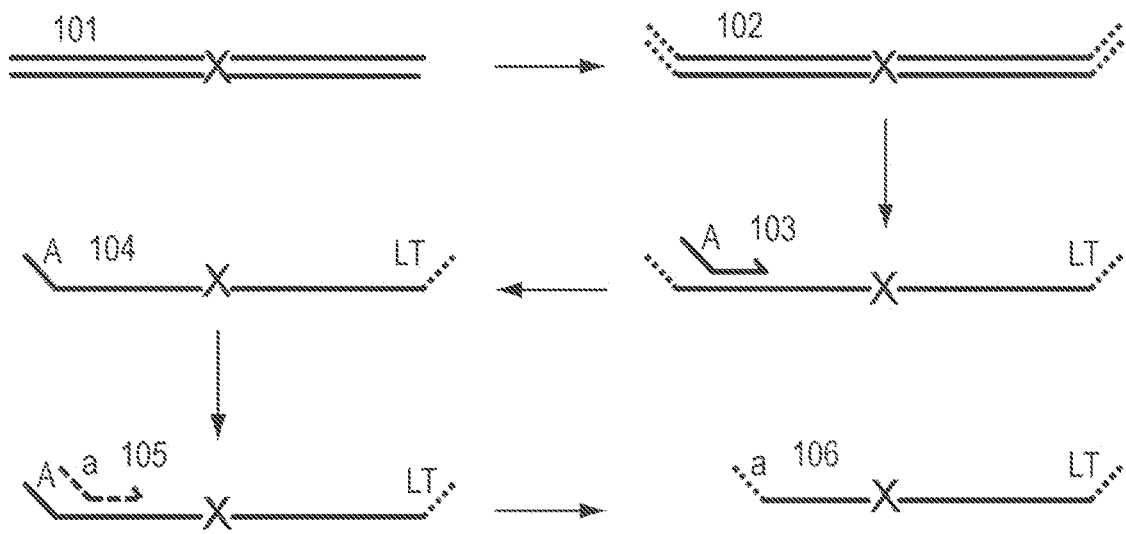
FIG. 6: Graphical representation of one-sided nested mini-PCR method.
Figure 7:
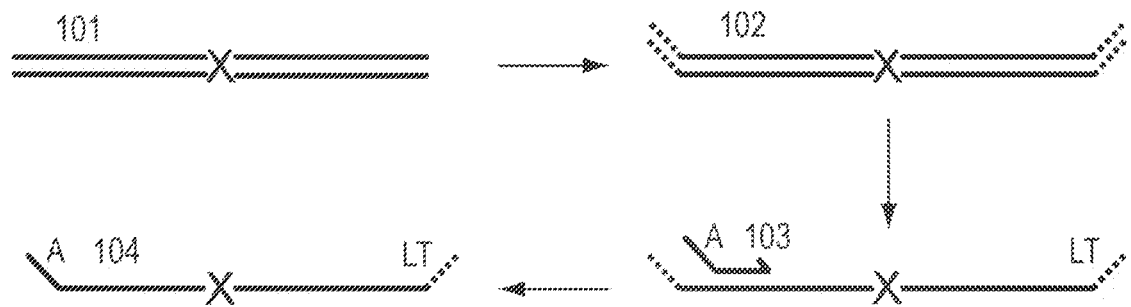
FIG. 7: Graphical representation of one-sided mini-PCR method.
Figure 8:
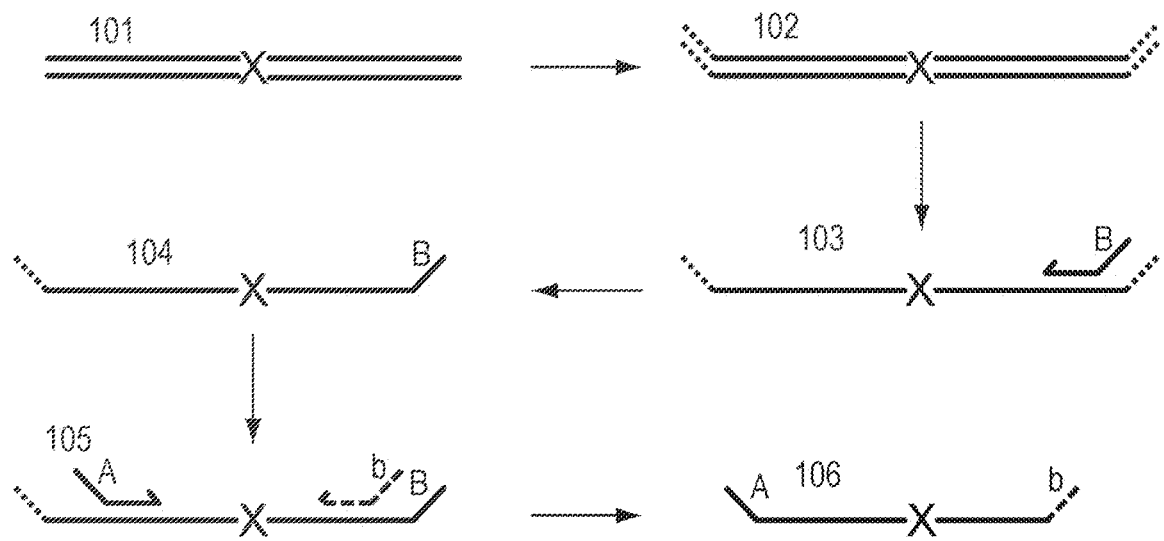
FIG. 8: Graphical representation of reverse semi-nested mini-PCR method.

One-sided nested mini-PCR: (see FIG. 6) It is possible to use target DNA that has an adaptor at the fragment ends. STA may also be performed with a multiplex set of nested Forward primers and using the ligation adapter tag as the Reverse primer. A second STA may then be performed using a set of nested Forward primers and a universal Reverse primer. 101 denotes double stranded DNA with a polymorphic locus of interest at X. 102 denotes the double stranded DNA with ligation adaptors added for universal amplification. 103 denotes the single stranded DNA that has been universally amplified with Forward Primer A hybridized. 104 denotes the PCR product from 103 that was amplified using Forward primer A and ligation adaptor tag Reverse primer LT. 105 denotes the product from 104 with nested Forward primer a hybridized. 106 denotes the final PCR product. This method can detect shorter target sequences than standard PCR by using overlapping primers in the first and second STAs. The method is typically performed off a sample of DNA that has already undergone STA step 1 above—appending of universal tags and amplification; the two nested primers are only on one side, the other side uses the library tag. The method was performed on libraries of apoptotic supernatants and pregnancy plasma. With this workflow around 60% of sequences mapped to the intended targets. Note that reads that contained the reverse adaptor sequence were not mapped, so this number is expected to be higher if those reads that contain the reverse adaptor sequence are mapped One-sided mini-PCR: It is possible to use target DNA that has an adaptor at the fragment ends (see FIG. 7). STA may be performed with a multiplex set of Forward primers and one (or few) tag-specific Reverse primer. 101 denotes double stranded DNA with a polymorphic locus of interest at X. 102 denotes the double stranded DNA with ligation adaptors added for universal amplification. 103 denotes the single stranded DNA with Forward Primer A hybridized. 104 denotes the PCR product from 103 that was amplified using Forward primer A and ligation adaptor tag Reverse primer LT, and which is the final PCR product. This method can detect shorter target sequences than standard PCR. However it may be relatively unspecific, as only one target specific primer is used. This protocol is effectively half of the one sided nested mini PCR Reverse semi-nested mini-PCR: It is possible to use target DNA that has an adaptor at the fragment ends (see FIG. 8). STA may be performed with a multiplex set of Forward primers and one (or few) tag-specific Reverse primer. 101 denotes double stranded DNA with a polymorphic locus of interest at X. 102 denotes the double stranded DNA with ligation adaptors added for universal amplification. 103 denotes the single stranded DNA with Reverse Primer B hybridized. 104 denotes the PCR product from 103 that was amplified using Reverse primer B and ligation adaptor tag Forward primer LT. 105 denotes the PCR product 104 with hybridized Forward Primer A, and inner Reverse primer 'b'. 106 denotes the PCR product that has been amplified from 105 using Forward primer A and Reverse primer 'b', and which is the final PCR product. This method can detect shorter target sequences than standard PCR.

There also may be more variants that are simply iterations or combinations of the above methods such as doubly nested PCR, where three sets of primers are used. Another variant is one-and-a-half sided nested mini-PCR, where STA may also be performed with a multiplex set of nested Forward primers and one (or few) tag-specific Reverse primer.

Note that in all of these variants, the identity of the Forward primer and the Reverse primer may be interchanged. Note that in some embodiments, the nested variant can equally well be run without the initial library preparation that comprises appending the adapter tags, and a universal amplification step. Note that in some embodiments, additional rounds of PCR may be included, with additional Forward and/or Reverse primers and amplification steps; these additional steps may be particularly useful if it is desirable to further increase the percent of DNA molecules that correspond to the targeted loci.

Nesting Workflows

Figure 9:
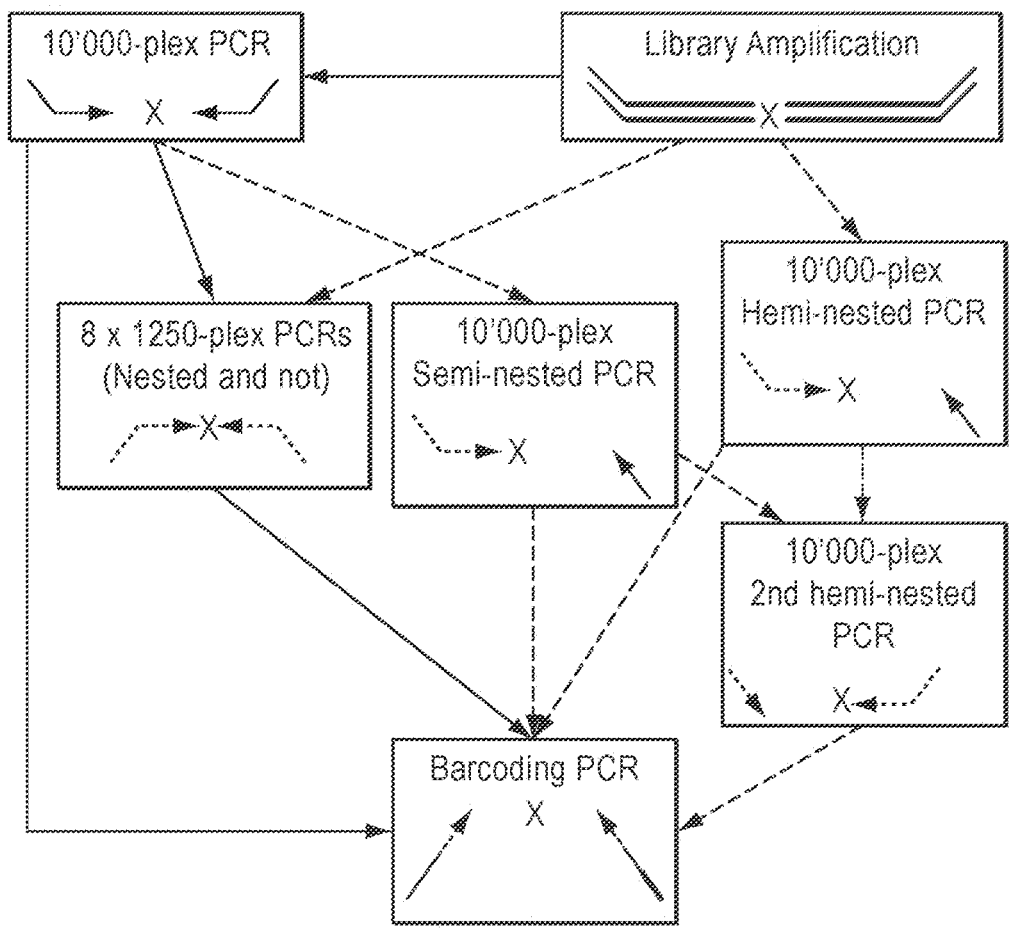
FIG. 9: Some possible workflows for semi-nested methods.

There are many ways to perform the amplification, with different degrees of nesting, and with different degrees of multiplexing. In FIG. 9, a flow chart is given with some of the possible workflows. Note that the use of 10,000-plex PCR is only meant to be an example; these flow charts would work equally well for other degrees of multiplexing.

Looped Ligation Adaptors

When adding universal tagged adaptors for example for the purpose of making a library for sequencing, there are a number of ways to ligate adaptors. One way is to blunt end the sample DNA, perform A-tailing, and ligate with adaptors that have a T-overhang. There are a number of other ways to ligate adaptors. There are also a number of adaptors that can be ligated. For example, a Y-adaptor can be used where the adaptor consists of two strands of DNA where one strand has a double strand region, and a region specified by a forward primer region, and where the other strand specified by a double strand region that is complementary to the double strand region on the first strand, and a region with a reverse primer. The double stranded region, when annealed, may contain a T-overhang for the purpose of ligating to double stranded DNA with an A overhang.

In an embodiment, the adaptor can be a loop of DNA where the terminal regions are complementary, and where the loop region contains a forward primer tagged region (LFT), a reverse primer tagged region (LRT), and a cleavage site between the two (See FIG. 10). 101 refers to the double stranded, blunt ended target DNA. 102 refers to the A-tailed target DNA. 103 refers to the looped ligation adaptor with T overhang 'T' and the cleavage site 'Z'. 104 refers to the target DNA with appended looped ligation adaptors. 105 refers to the target DNA with the ligation adaptors appended cleaved at the cleavage site. LFT refers to the ligation adaptor Forward tag, and the LRT refers to the ligation adaptor Reverse tag. The complementary region may end on a T overhang, or other feature that may be used for ligation to the target DNA. The cleavage site may be a series of uracils for cleavage by UNG, or a sequence that may be recognized and cleaved by a restriction enzyme or other method of cleavage or just a basic amplification. These adaptors can be uses for any library preparation, for example, for sequencing. These adaptors can be used in combination with any of the other methods described herein, for example the mini-PCR amplification methods.

Internally Tagged Primers

Figure 11:
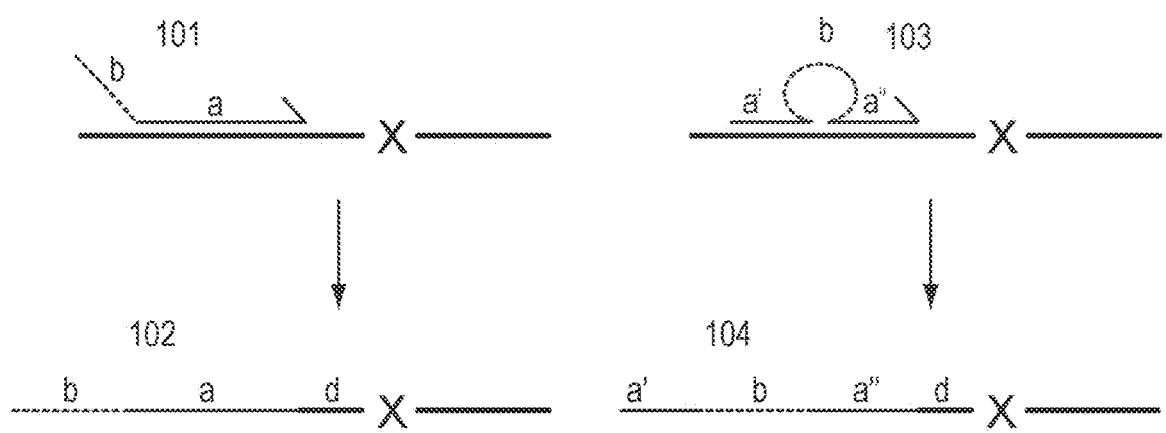
FIG. 11: Graphical representation of internally tagged primers.

When using sequencing to determine the allele present at a given polymorphic locus, the sequence read typically begins upstream of the primer binding site (a), and then to the polymorphic site (X). Tags are typically configured as shown in FIG. 11, left. 101 refers to the single stranded target DNA with polymorphic locus of interest 'X', and primer 'a' with appended tag 'b'. In order to avoid nonspecific hybridization, the primer binding site (region of target DNA complementary to 'a') is typically 18 to 30 bp in length. Sequence tag 'b' is typically about 20 bp; in theory these can be any length longer than about 15 bp, though many people use the primer sequences that are sold by the sequencing platform company. The distance 'd' between 'a' and 'X' may be at least 2 bp so as to avoid allele bias. When performing multiplexed PCR amplification using the methods disclosed herein or other methods, where careful primer design is necessary to avoid excessive primer primer interaction, the window of allowable distance 'd' between 'a' and 'X' may vary quite a bit: from 2 bp to 10 bp, from 2 bp to 20 bp, from 2 bp to 30 bp, or even from 2 bp to more than 30 bp. Therefore, when using the primer configuration shown in FIG. 11, left, sequence reads must be a minimum of 40 bp to obtain reads long enough to measure the polymorphic locus, and depending on the lengths of 'a' and 'd' the sequence reads may need to be up to 60 or 75 bp. Usually, the longer the sequence reads, the higher the cost and time of sequencing a given number of reads, therefore, minimizing the necessary read length can save both time and money. In addition, since, on average, bases read earlier on the read are read more accurately than those read later on the read, decreasing the necessary sequence read length can also increase the accuracy of the measurements of the polymorphic region.

In an embodiment, termed internally tagged primers, the primer binding site (a) is split in to a plurality of segments (a', a'', a''' . . . ), and the sequence tag (b) is on a segment of DNA that is in the middle of two of the primer binding sites, as shown in FIG. 11, 103. This configuration allows the sequencer to make shorter sequence reads. In an embodiment, a'+a'' should be at least about 18 bp, and can be as long as 30, 40, 50, 60, 80, 100 or more than 100 bp. In an embodiment, a'' should be at least about 6 bp, and in an embodiment is between about 8 and 16 bp. All other factors being equal, using the internally tagged primers can cut the length of the sequence reads needed by at least 6 bp, as much as 8 bp, 10 bp, 12 bp, 15 bp, and even by as many as 20 or 30 bp. This can result in a significant money, time and accuracy advantage. An example of internally tagged primers is given in FIG. 12.

Primers with Ligation Adaptor Binding Region

Figure 10:
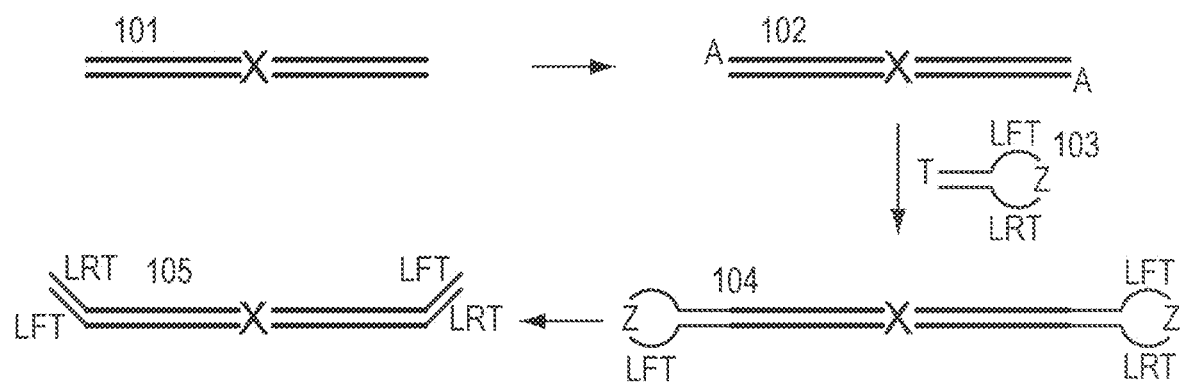
FIG. 10: Graphical representation of looped ligation adaptors.
Figure 13:
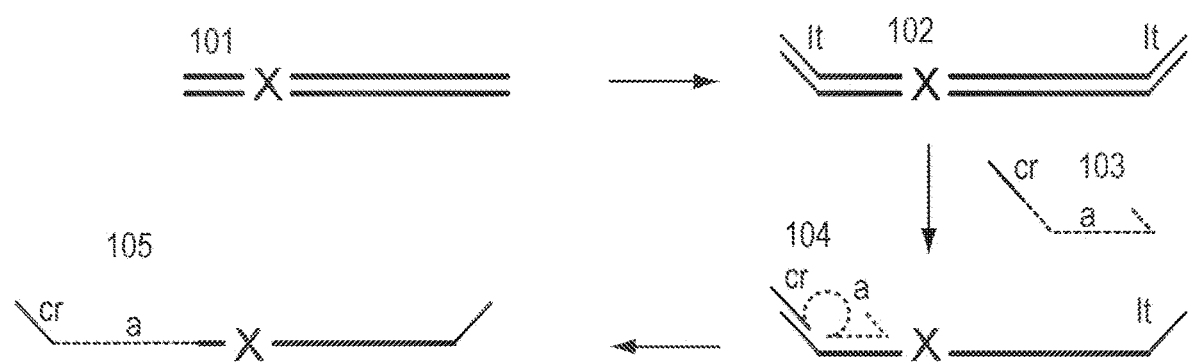
FIG. 13: Graphical representation of a method using primers with a ligation adaptor binding region.

One issue with fragmented DNA is that since it is short in length, the chance that a polymorphism is close to the end of a DNA strand is higher than for a long strand (e.g. 101, FIG. 10). Since PCR capture of a polymorphism requires a primer binding site of suitable length on both sides of the polymorphism, a significant number of strands of DNA with the targeted polymorphism will be missed due to insufficient overlap between the primer and the targeted binding site. In an embodiment, the target DNA 101 can have ligation adaptors appended 102, and the target primer 103 can have a region (cr) that is complementary to the ligation adaptor tag (lt) appended upstream of the designed binding region (a) (see FIG. 13); thus in cases where the binding region (region of 101 that is complementary to a) is shorter than the 18 bp typically required for hybridization, the region (cr) on the primer than is complementary to the library tag is able to increase the binding energy to a point where the PCR can proceed. Note that any specificity that is lost due to a shorter binding region can be made up for by other PCR primers with suitably long target binding regions. Note that this embodiment can be used in combination with direct PCR, or any of the other methods described herein, such as nested PCR, semi nested PCR, hemi nested PCR, one sided nested or semi or hemi nested PCR, or other PCR protocols.

When using the sequencing data to determine ploidy in combination with an analytical method that involves comparing the observed allele data to the expected allele distributions for various hypotheses, each additional read from alleles with a low depth of read will yield more information than a read from an allele with a high depth of read. Therefore, ideally, one would wish to see uniform depth of read (DOR) where each locus will have a similar number of representative sequence reads. Therefore, it is desirable to minimize the DOR variance. In an embodiment, it is possible to decrease the coefficient of variance of the DOR (this may be defined as the standard deviation of the DOR/the average DOR) by increasing the annealing times. In some embodiments the annealing temperatures may be longer than 2 minutes, longer than 4 minutes, longer than ten minutes, longer than 30 minutes, and longer than one hour, or even longer. Since annealing is an equilibrium process, there is no limit to the improvement of DOR variance with increasing annealing times. In an embodiment, increasing the primer concentration may decrease the DOR variance.

Exemplary Amplification Methods

Improved PCR amplification methods have also been developed that minimize or prevent interference due to the amplification of nearby or adjacent target loci in the same reaction volume (such as part of the sample multiplex PCR reaction that simultaneously amplifies all the target loci) (see, U.S. Ser. No. 61/982,245, filed Apr. 21, 2014; U.S. Ser. No. 61/987,407, filed May 1, 2014, and U.S. Ser. No. 62/066,514, filed Oct. 21, 2014, which are each hereby incorporated by reference in its entirety). These methods can be used to simultaneously amplify nearby or adjacent target loci, which is faster and cheaper than having to separate nearby target loci into different reaction volumes so that they can be amplified separately to avoid interference. In particular embodiments, these methods are used to tile a region such that the amplicons include all the nucleotides in the region (such as an exon or all the exons of a gene such as cystic fibrosis).

In some embodiments, the amplification of target loci is performed using a polymerase (e.g., a DNA polymerase, RNA polymerase, or reverse transcriptase) with low 5'→3' exonuclease and/or low strand displacement activity. In some embodiments, the low level of 5'→3' exonuclease reduces or prevents the degradation of a nearby primer (e.g., an unextended primer or a primer that has had one or more nucleotides added to during primer extension). In some embodiments, the low level of strand displacement activity reduces or prevents the displacement of a nearby primer (e.g., an unextended primer or a primer that has had one or more nucleotides added to it during primer extension). In some embodiments, target loci that are adjacent to each other (e.g., no bases between the target loci) or nearby (e.g., loci are within 50, 40, 30, 20, 15, 10, 9, 8, 7, 6, 5, 4, 3, 2, or 1 base) are amplified. In some embodiments, the 3' end of one locus is within 50, 40, 30, 20, 15, 10, 9, 8, 7, 6, 5, 4, 3, 2, or 1 base of the 5' end of next downstream locus.

In some embodiments, at least 100, 200, 500, 750, 1,000; 2,000; 5,000; 7,500; 10,000; 15,000; 19,000; 20,000; 25,000; 27,000; 28,000; 30,000; 40,000; 50,000; 75,000; or 100,000 different target loci are amplified, such as by the simultaneous amplification in one reaction volume In some embodiments, at least 50, 60, 70, 80, 90, 95, 96, 97, 98, 99, or 99.5% of the amplified products are target amplicons. In various embodiments, the amount of amplified products that are target amplicons is between 50 to 99.5%, such as between 60 to 99%, 70 to 98%, 80 to 98%, 90 to 99.5%, or 95 to 99.5%, inclusive. In some embodiments, at least 50, 60, 70, 80, 90, 95, 96, 97, 98, 99, or 99.5% of the target loci are amplified (e.g., amplified at least 5, 10, 20, 30, 50, or 100-fold compared to the amount prior to amplification), such as by the simultaneous amplification in one reaction volume. In various embodiments, the amount target loci that are amplified (e.g., amplified at least 5, 10, 20, 30, 50, or 100-fold compared to the amount prior to amplification) is between 50 to 99.5%, such as between 60 to 99%, 70 to 98%, 80 to 99%, 90 to 99.5%, 95 to 99.9%, or 98 to 99.99% inclusive. In some embodiments, fewer non-target amplicons are produced, such as fewer amplicons formed from a forward primer from a first primer pair and a reverse primer from a second primer pair. Such undesired non-target amplicons can be produced using prior amplification methods if, e.g., the reverse primer from the first primer pair and/or the forward primer from the second primer pair are degraded and/or displaced.

In some embodiments, these methods allow longer extension times to be used since the polymerase bound to a primer being extended is less likely to degrade and/or displace a nearby primer (such as the next downstream primer) given the low 5'→3' exonuclease and/or low strand displacement activity of the polymerase. In various embodiments, reaction conditions (such as the extension time and temperature) are used such that the extension rate of the polymerase allows the number of nucleotides that are added to a primer being extended to be equal to or greater than 80, 90, 95, 100, 110, 120, 130, 140, 150, 175, or 200% of the number of nucleotides between the 3' end of the primer binding site and the 5' end of the next downstream primer binding site on the same strand.

In some embodiments, a DNA polymerase is used produce DNA amplicons using DNA as a template. In some embodiments, a RNA polymerase is used produce RNA amplicons using DNA as a template. In some embodiments, a reverse transcriptase is used produce cDNA amplicons using RNA as a template.

In some embodiments, the low level of 5'→3' exonuclease of the polymerase is less than 80, 70, 60, 50, 40, 30, 20, 10, 5, 1, or 0.1% of the activity of the same amount of *Thermus aquaticus* polymerase ("Taq" polymerase, which is a commonly used DNA polymerase from a thermophilic bacterium, PDB 1BGX, EC 2.7.7.7, Murali et al., "Crystal structure of Taq DNA polymerase in complex with an inhibitory Fab: the Fab is directed against an intermediate in the helix-coil dynamics of the enzyme," Proc. Natl. Acad. Sci. USA 95:12562-12567, 1998, which is hereby incorporated by reference in its entirety) under the same conditions.

In some embodiments, the low level of strand displacement activity of the polymerase is less than 80, 70, 60, 50, 40, 30, 20, 10, 5, 1, or 0.1% of the activity of the same amount of Taq polymerase under the same conditions.

In some embodiments, the polymerase is a PUSHION DNA polymerase, such as PHUSION High Fidelity DNA polymerase (M0530S, New England BioLabs, Inc.) or PHUSION Hot Start Flex DNA polymerase (M0535S, New England BioLabs, Inc.; Frey and Suppman *BioChemica.* 2:34-35, 1995; Chester and Marshak *Analytical Biochemistry.* 209:284-290, 1993, which are each hereby incorporated by reference in its entirety). The PHUSION DNA polymerase is a *Pyrococcus*-like enzyme fused with a processivity-enhancing domain. PHUSION DNA polymerase possesses 5'→3' polymerase activity and 3'→5' exonuclease activity, and generates blunt-ended products. PHUSION DNA polymerase lacks 5'→3' exonuclease activity and strand displacement activity.

In some embodiments, the polymerase is a Q5® DNA Polymerase, such as Q5® High-Fidelity DNA Polymerase (M0491S, New England BioLabs, Inc.) or Q5® Hot Start High-Fidelity DNA Polymerase (M0493S, New England BioLabs, Inc.). Q5® High-fidelity DNA polymerase is a high-fidelity, thermostable, DNA polymerase with 3'→5' exonuclease activity, fused to a processivity-enhancing Sso7d domain. Q5® High-fidelity DNA polymerase lacks 5'→3' exonuclease activity and strand displacement activity.

In some embodiments, the polymerase is a T4 DNA polymerase (M0203S, New England BioLabs, Inc.; Tabor and Struh. (1989). "DNA-Dependent DNA Polymerases," In Ausebel et al. (Ed.), *Current Protocols in Molecular Biology.* 3.5.10-3.5.12. New York: John Wiley & Sons, Inc., 1989; Sambrook et al. *Molecular Cloning: A Laboratory Manual.* (2nd ed.), 5.44-5.47. Cold Spring Harbor: Cold Spring Harbor Laboratory Press, 1989, which are each hereby incorporated by reference in its entirety). T4 DNA Polymerase catalyzes the synthesis of DNA in the 5'→3' direction and requires the presence of template and primer. This enzyme has a 3'→5' exonuclease activity which is much more active than that found in DNA Polymerase I. T4 DNA polymerase lacks 5'→3' exonuclease activity and strand displacement activity.

In some embodiments, the polymerase is a *Sulfolobus* DNA Polymerase IV (M0327S, New England BioLabs, Inc.; (Boudsocq, et al. (2001). *Nucleic Acids Res.,* 29:4607-4616, 2001; McDonald, et al. (2006). *Nucleic Acids Res.,* 34:1102-1111, 2006, which are each hereby incorporated by reference in its entirety). *Sulfolobus* DNA Polymerase IV is a thermostable Y-family lesion-bypass DNA Polymerase that efficiently synthesizes DNA across a variety of DNA template lesions McDonald, J. P. et al. (2006). *Nucleic Acids Res.,* 34, 1102-1111, which is hereby incorporated by reference in its entirety). *Sulfolobus* DNA Polymerase IV lacks 5'→3' exonuclease activity and strand displacement activity.

In some embodiments, if a primer binds a region with a SNP, the primer may bind and amplify the different alleles with different efficiencies or may only bind and amplify one allele. For subjects who are heterozygous, one of the alleles may not be amplified by the primer. In some embodiments, a primer is designed for each allele. For example, if there are two alleles (e.g., a biallelic SNP), then two primers can be used to bind the same location of a target locus (e.g., a forward primer to bind the "A" allele and a forward primer to bind the "B" allele). Standard methods, such as the dbSNP database, can be used to determine the location of known SNPs, such as SNP hot spots that have a high heterozygosity rate.

In some embodiments, the amplicons are similar in size. In some embodiments, the range of the length of the target amplicons is less than 100, 75, 50, 25, 15, 10, or 5 nucleotides. In some embodiments (such as the amplification of target loci in fragmented DNA or RNA), the length of the target amplicons is between 50 and 100 nucleotides, such as between 60 and 80 nucleotides, or 60 and 75 nucleotides, inclusive. In some embodiments (such as the amplification of multiple target loci throughout an exon or gene), the length of the target amplicons is between 100 and 500 nucleotides, such as between 150 and 450 nucleotides, 200 and 400 nucleotides, 200 and 300 nucleotides, or 300 and 400 nucleotides, inclusive.

In some embodiments, multiple target loci are simultaneously amplified using a primer pair that includes a forward and reverse primer for each target locus to be amplified in that reaction volume. In some embodiments, one round of PCR is performed with a single primer per target locus, and then a second round of PCR is performed with a primer pair per target locus. For example, the first round of PCR may be performed with a single primer per target locus such that all the primers bind the same strand (such as using a forward primer for each target locus). This allows the PCR to amplify in a linear manner and reduces or eliminates amplification bias between amplicons due to sequence or length differences. In some embodiments, the amplicons are then amplified using a forward and reverse primer for each target locus.

Exemplary Whole Genome Amplification Methods

In some embodiments, a method of the present disclosure may involve amplifying DNA, such as the use of whole genome application to amplify a nucleic acid sample before amplifying just the target loci. Amplification of the DNA, a process which transforms a small amount of genetic material to a larger amount of genetic material that comprises a similar set of genetic data, can be done by a wide variety of methods, including, but not limited to polymerase chain reaction (PCR). One method of amplifying DNA is whole genome amplification (WGA). There are a number of methods available for WGA: ligation-mediated PCR (LM-PCR), degenerate oligonucleotide primer PCR (DOP-PCR), and multiple displacement amplification (MDA). In LM-PCR, short DNA sequences called adapters are ligated to blunt ends of DNA. These adapters contain universal amplification sequences, which are used to amplify the DNA by PCR. In DOP-PCR, random primers that also contain universal amplification sequences are used in a first round of annealing and PCR. Then, a second round of PCR is used to amplify the sequences further with the universal primer sequences. MDA uses the phi-29 polymerase, which is a highly processive and non-specific enzyme that replicates DNA and has been used for single-cell analysis. The major limitations to amplification of material from a single cell are (1) necessity of using extremely dilute DNA concentrations or extremely small volume of reaction mixture, and (2) difficulty of reliably dissociating DNA from proteins across the whole genome. Regardless, single-cell whole genome amplification has been used successfully for a variety of applications for a number of years. There are other methods of amplifying DNA from a sample of DNA. The DNA amplification transforms the initial sample of DNA into a sample of DNA that is similar in the set of sequences, but of much greater quantity. In some cases, amplification may not be required.

In some embodiments, DNA may be amplified using a universal amplification, such as WGA or MDA. In some embodiments, DNA may be amplified by targeted amplification, for example using targeted PCR, or circularizing probes. In some embodiments, the DNA may be preferentially enriched using a targeted amplification method, or a method that results in the full or partial separation of desired from undesired DNA, such as capture by hybridization approaches. In some embodiments, DNA may be amplified by using a combination of a universal amplification method and a preferential enrichment method. A fuller description of some of these methods can be found elsewhere in this document.

Exemplary Enrichment and Sequencing Methods

In an embodiment, a method disclosed herein uses selective enrichment techniques that preserve the relative allele frequencies that are present in the original sample of DNA at each target loci (e.g., each polymorphic locus) from a set of target loci (e.g., polymorphic loci). While enrichment is particularly advantageous for methods for analyzing polymorphic loci, these enrichment methods can be readily adapted for nonpolymorphic loci if desired. In some embodiments the amplification and/or selective enrichment technique may involve PCR such as ligation mediated PCR, fragment capture by hybridization, Molecular Inversion Probes, or other circularizing probes. In some embodiments, methods for amplification or selective enrichment may involve using probes where, upon correct hybridization to the target sequence, the 3-prime end or 5-prime end of a nucleotide probe is separated from the polymorphic site of the allele by a small number of nucleotides. This separation reduces preferential amplification of one allele, termed allele bias. This is an improvement over methods that involve using probes where the 3-prime end or 5-prime end of a correctly hybridized probe are directly adjacent to or very near to the polymorphic site of an allele. In an embodiment, probes in which the hybridizing region may or certainly contains a polymorphic site are excluded. Polymorphic sites at the site of hybridization can cause unequal hybridization or inhibit hybridization altogether in some alleles, resulting in preferential amplification of certain alleles. These embodiments are improvements over other methods that involve targeted amplification and/or selective enrichment in that they better preserve the original allele frequencies of the sample at each polymorphic locus, whether the sample is pure genomic sample from a single individual or mixture of individuals.

The use of a technique to enrich a sample of DNA at a set of target loci followed by sequencing as part of a method for non-invasive prenatal allele calling or ploidy calling may confer a number of unexpected advantages. In some embodiments of the present disclosure, the method involves measuring genetic data for use with an informatics based method, such as PARENTAL SUPPORT™ (PS). The ultimate outcome of some of the embodiments is the actionable genetic data of an embryo or a fetus. There are many methods that may be used to measure the genetic data of the individual and/or the related individuals as part of embodied methods. In an embodiment, a method for enriching the concentration of a set of targeted alleles is disclosed herein, the method comprising one or more of the following steps: targeted amplification of genetic material, addition of loci specific oligonucleotide probes, ligation of specified DNA strands, isolation of sets of desired DNA, removal of unwanted components of a reaction, detection of certain sequences of DNA by hybridization, and detection of the sequence of one or a plurality of strands of DNA by DNA sequencing methods. In some cases the DNA strands may refer to target genetic material, in some cases they may refer to primers, in some cases they may refer to synthesized sequences, or combinations thereof. These steps may be carried out in a number of different orders.

For example, a universal amplification step of the DNA prior to targeted amplification may confer several advantages, such as removing the risk of bottlenecking and reducing allelic bias. The DNA may be mixed an oligonucleotide probe that can hybridize with two neighboring regions of the target sequence, one on either side. After hybridization, the ends of the probe may be connected by adding a polymerase, a means for ligation, and any necessary reagents to allow the circularization of the probe. After circularization, an exonuclease may be added to digest to non-circularized genetic material, followed by detection of the circularized probe. The DNA may be mixed with PCR primers that can hybridize with two neighboring regions of the target sequence, one on either side. After hybridization, the ends of the probe may be connected by adding a polymerase, a means for ligation, and any necessary reagents to complete PCR amplification. Amplified or unamplified DNA may be targeted by hybrid capture probes that target a set of loci; after hybridization, the probe may be localized and separated from the mixture to provide a mixture of DNA that is enriched in target sequences.

The use of a method to target certain loci followed by sequencing as part of a method for allele calling or ploidy calling may confer a number of unexpected advantages. Some methods by which DNA may be targeted, or preferentially enriched, include using circularizing probes, linked inverted probes (LIPs, MIPs), capture by hybridization methods such as SURESELECT, and targeted PCR or ligation-mediated PCR amplification strategies.

In some embodiments, a method of the present disclosure involves measuring genetic data for use with an informatics based method, such as PARENTAL SUPPORT™ (PS), which is described further herein. PARENTAL SUPPORT™ is an informatics based approach to manipulating genetic data, aspects of which are described herein. The ultimate outcome of some of the embodiments is the actionable genetic data of an embryo or a fetus followed by a clinical decision based on the actionable data. The algorithms behind the PS method take the measured genetic data of the target individual, often an embryo or fetus, and the measured genetic data from related individuals, and are able to increase the accuracy with which the genetic state of the target individual is known. In an embodiment, the measured genetic data is used in the context of making ploidy determinations during prenatal genetic diagnosis. In an embodiment, the measured genetic data is used in the context of making ploidy determinations or allele calls on embryos during in vitro fertilization. There are many methods that may be used to measure the genetic data of the individual and/or the related individuals in the aforementioned contexts. The different methods comprise a number of steps, those steps often involving amplification of genetic material, addition of oligonucleotide probes, ligation of specified DNA strands, isolation of sets of desired DNA, removal of unwanted components of a reaction, detection of certain sequences of DNA by hybridization, detection of the sequence of one or a plurality of strands of DNA by DNA sequencing methods. In some cases the DNA strands may refer to target genetic material, in some cases they may refer to primers, in some cases they may refer to synthesized sequences, or combinations thereof. These steps may be carried out in a number of different orders.

Note that in theory it is possible to target any number loci in the genome, anywhere from one loci to well over one million loci. If a sample of DNA is subjected to targeting, and then sequenced, the percentage of the alleles that are read by the sequencer will be enriched with respect to their natural abundance in the sample. The degree of enrichment can be anywhere from one percent (or even less) to ten-fold, a hundred-fold, a thousand-fold or even many million-fold. In the human genome there are roughly 3 billion base pairs, and nucleotides, comprising approximately 75 million polymorphic loci. The more loci that are targeted, the smaller the degree of enrichment is possible. The fewer the number of loci that are targeted, the greater degree of enrichment is possible, and the greater depth of read may be achieved at those loci for a given number of sequence reads.

In an embodiment of the present disclosure, the targeting or preferential may focus entirely on SNPs. In an embodiment, the targeting or preferential may focus on any polymorphic site. A number of commercial targeting products are available to enrich exons. Surprisingly, targeting exclusively SNPs, or exclusively polymorphic loci, is particularly advantageous when using a method for NPD that relies on allele distributions. There are also published methods for NPD using sequencing, for example U.S. Pat. No. 7,888,017, involving a read count analysis where the read counting focuses on counting the number of reads that map to a given chromosome, where the analyzed sequence reads do not focus on regions of the genome that are polymorphic. Those types of methodology that do not focus on polymorphic alleles would not benefit as much from targeting or preferential enrichment of a set of alleles.

In an embodiment of the present disclosure, it is possible to use a targeting method that focuses on SNPs to enrich a genetic sample in polymorphic regions of the genome. In an embodiment, it is possible to focus on a small number of SNPs, for example between 1 and 100 SNPs, or a larger number, for example, between 100 and 1,000, between 1,000 and 10,000, between 10,000 and 100,000 or more than 100,000 SNPs. In an embodiment, it is possible to focus on one or a small number of chromosomes that are correlated with live trisomic births, for example chromosomes 13, 18, 21, X and Y, or some combination thereof. In an embodiment, it is possible to enrich the targeted SNPs by a small factor, for example between 1.01 fold and 100 fold, or by a larger factor, for example between 100 fold and 1,000,000 fold, or even by more than 1,000,000 fold. In an embodiment of the present disclosure, it is possible to use a targeting method to create a sample of DNA that is preferentially enriched in polymorphic regions of the genome. In an embodiment, it is possible to use this method to create a mixture of DNA with any of these characteristics where the mixture of DNA contains maternal DNA and also free floating fetal DNA. In an embodiment, it is possible to use this method to create a mixture of DNA that has any combination of these factors. For example, the method described herein may be used to produce a mixture of DNA that comprises maternal DNA and fetal DNA, and that is preferentially enriched in DNA that corresponds to 200 SNPs, all of which are located on either chromosome 18 or 21, and which are enriched an average of 1000 fold. In another example, it is possible to use the method to create a mixture of DNA that is preferentially enriched in 10,000 SNPs that are all or mostly located on chromosomes 13, 18, 21, X and Y, and the average enrichment per loci is greater than 500 fold. Any of the targeting methods described herein can be used to create mixtures of DNA that are preferentially enriched in certain loci.

In some embodiments, a method of the present disclosure further includes measuring the DNA in the mixed fraction using a high throughput DNA sequencer, where the DNA in the mixed fraction contains a disproportionate number of sequences from one or more chromosomes, wherein the one or more chromosomes are taken from the group comprising chromosome 13, chromosome 18, chromosome 21, chromosome X, chromosome Y and combinations thereof.

Described herein are three methods: multiplex PCR, targeted capture by hybridization, and linked inverted probes (LIPs), which may be used to obtain and analyze measurements from a sufficient number of polymorphic loci from a maternal plasma sample in order to detect fetal aneuploidy; this is not meant to exclude other methods of selective enrichment of targeted loci. Other methods may equally well be used without changing the essence of the method. In each case the polymorphism assayed may include single nucleotide polymorphisms (SNPs), small indels, or STRs. A preferred method involves the use of SNPs. Each approach produces allele frequency data; allele frequency data for each targeted locus and/or the joint allele frequency distributions from these loci may be analyzed to determine the ploidy of the fetus. Each approach has its own considerations due to the limited source material and the fact that maternal plasma consists of mixture of maternal and fetal DNA. This method may be combined with other approaches to provide a more accurate determination. In an embodiment, this method may be combined with a sequence counting approach such as that described in U.S. Pat. No. 7,888,017. The approaches described could also be used to detect fetal paternity noninvasively from maternal plasma samples. In addition each approach may be applied to other mixtures of DNA or pure DNA samples to detect the presence or absence of aneuploid chromosomes, to genotype a large number of SNP from degraded DNA samples, to detect segmental copy number variations (CNVs), to detect other genotypic states of interest, or some combination thereof.

Accurately Measuring the Allelic Distributions in a Sample

Current sequencing approaches can be used to estimate the distribution of alleles in a sample. One such method involves randomly sampling sequences from a pool DNA, termed shotgun sequencing. The proportion of a particular allele in the sequencing data is typically very low and can be determined by simple statistics. The human genome contains approximately 3 billion base pairs. So, if the sequencing method used make 100 bp reads, a particular allele will be measured about once in every 30 million sequence reads.

In an embodiment, a method of the present disclosure is used to determine the presence or absence of two or more different haplotypes that contain the same set of loci in a sample of DNA from the measured allele distributions of loci from that chromosome. The different haplotypes could represent two different homologous chromosomes from one individual, three different homologous chromosomes from a trisomic individual, three different homologous haplotypes from a mother and a fetus where one of the haplotypes is shared between the mother and the fetus, three or four haplotypes from a mother and fetus where one or two of the haplotypes are shared between the mother and the fetus, or other combinations. Alleles that are polymorphic between the haplotypes tend to be more informative, however any alleles where the mother and father are not both homozygous for the same allele will yield useful information through measured allele distributions beyond the information that is available from simple read count analysis.

Shotgun sequencing of such a sample, however, is extremely inefficient as it results in many sequences for regions that are not polymorphic between the different haplotypes in the sample, or are for chromosomes that are not of interest, and therefore reveal no information about the proportion of the target haplotypes. Described herein are methods that specifically target and/or preferentially enrich segments of DNA in the sample that are more likely to be polymorphic in the genome to increase the yield of allelic information obtained by sequencing. Note that for the measured allele distributions in an enriched sample to be truly representative of the actual amounts present in the target individual, it is critical that there is little or no preferential enrichment of one allele as compared to the other allele at a given loci in the targeted segments. Current methods known in the art to target polymorphic alleles are designed to ensure that at least some of any alleles present are detected. However, these methods were not designed for the purpose of measuring the unbiased allelic distributions of polymorphic alleles present in the original mixture. It is non-obvious that any particular method of target enrichment would be able to produce an enriched sample wherein the measured allele distributions would accurately represent the allele distributions present in the original unamplified sample better than any other method. While many enrichment methods may be expected, in theory, to accomplish such an aim, an ordinary person skilled in the art is well aware that there is a great deal of stochastic or deterministic bias in current amplification, targeting and other preferential enrichment methods. One embodiment of a method described herein allows a plurality of alleles found in a mixture of DNA that correspond to a given locus in the genome to be amplified, or preferentially enriched in a way that the degree of enrichment of each of the alleles is nearly the same. Another way to say this is that the method allows the relative quantity of the alleles present in the mixture as a whole to be increased, while the ratio between the alleles that correspond to each locus remains essentially the same as they were in the original mixture of DNA. For some reported methods, preferential enrichment of loci can result in allelic biases of more than 1%, more than 2%, more than 5% and even more than 10%. This preferential enrichment may be due to capture bias when using a capture by hybridization approach, or amplification bias which may be small for each cycle, but can become large when compounded over 20, 30 or 40 cycles. For the purposes of this disclosure, for the ratio to remain essentially the same means that the ratio of the alleles in the original mixture divided by the ratio of the alleles in the resulting mixture is between 0.95 and 1.05, between 0.98 and 1.02, between 0.99 and 1.01, between 0.995 and 1.005, between 0.998 and 1.002, between 0.999 and 1.001, or between 0.9999 and 1.0001. Note that the calculation of the allele ratios presented here may not be used in the determination of the ploidy state of the target individual, and may only a metric to be used to measure allelic bias.

In an embodiment, once a mixture has been preferentially enriched at the set of target loci, it may be sequenced using any one of the previous, current, or next generation of sequencing instruments that sequences a clonal sample (a sample generated from a single molecule; examples include ILLUMINA GAIIx, ILLUMINA HiSeq, LIFE TECHNOLOGIES SOLiD, 5500XL). The ratios can be evaluated by sequencing through the specific alleles within the targeted region. These sequencing reads can be analyzed and counted according the allele type and the rations of different alleles determined accordingly. For variations that are one to a few bases in length, detection of the alleles will be performed by sequencing and it is essential that the sequencing read span the allele in question in order to evaluate the allelic composition of that captured molecule. The total number of captured molecules assayed for the genotype can be increased by increasing the length of the sequencing read. Full sequencing of all molecules would guarantee collection of the maximum amount of data available in the enriched pool. However, sequencing is currently expensive, and a method that can measure allele distributions using a lower number of sequence reads will have great value. In addition, there are technical limitations to the maximum possible length of read as well as accuracy limitations as read lengths increase. The alleles of greatest utility will be of one to a few bases in length, but theoretically any allele shorter than the length of the sequencing read can be used. While allele variations come in all types, the examples provided herein focus on SNPs or variants contained of just a few neighboring base pairs. Larger variants such as segmental copy number variants can be detected by aggregations of these smaller variations in many cases as whole collections of SNP internal to the segment are duplicated. Variants larger than a few bases, such as STRs require special consideration and some targeting approaches work while others will not.

There are multiple targeting approaches that can be used to specifically isolate and enrich a one or a plurality of variant positions in the genome. Typically, these rely on taking advantage of the invariant sequence flanking the variant sequence. There are reports by others related to targeting in the context of sequencing where the substrate is maternal plasma (see, e.g., Liao et al., Clin. Chem. 2011; 57(1): pp. 92-101). However, these approaches use targeting probes that target exons, and do not focus on targeting polymorphic regions of the genome. In an embodiment, a method of the present disclosure involves using targeting probes that focus exclusively or almost exclusively on polymorphic regions. In an embodiment, a method of the present disclosure involves using targeting probes that focus exclusively or almost exclusively on SNPs. In some embodiments of the present disclosure, the targeted polymorphic sites consist of at least 10% SNPs, at least 20% SNPs, at least 30% SNPs, at least 40% SNPs, at least 50% SNPs, at least 60% SNPs, at least 70% SNPs, at least 80% SNPs, at least 90% SNPs, at least 95% SNPs, at least 98% SNPs, at least 99% SNPs, at least 99.9% SNPs, or exclusively SNPs.

In an embodiment, a method of the present disclosure can be used to determine genotypes (base composition of the DNA at specific loci) and relative proportions of those genotypes from a mixture of DNA molecules, where those DNA molecules may have originated from one or a number of genetically distinct individuals. In an embodiment, a method of the present disclosure can be used to determine the genotypes at a set of polymorphic loci, and the relative ratios of the amount of different alleles present at those loci. In an embodiment the polymorphic loci may consist entirely of SNPs. In an embodiment, the polymorphic loci can comprise SNPs, single tandem repeats, and other polymorphisms. In an embodiment, a method of the present disclosure can be used to determine the relative distributions of alleles at a set of polymorphic loci in a mixture of DNA, where the mixture of DNA comprises DNA that originates from a mother, and DNA that originates from a fetus. In an embodiment, the joint allele distributions can be determined on a mixture of DNA isolated from blood from a pregnant woman. In an embodiment, the allele distributions at a set of loci can be used to determine the ploidy state of one or more chromosomes on a gestating fetus.

In an embodiment, the mixture of DNA molecules could be derived from DNA extracted from multiple cells of one individual. In an embodiment, the original collection of cells from which the DNA is derived may comprise a mixture of diploid or haploid cells of the same or of different genotypes, if that individual is mosaic (germline or somatic). In an embodiment, the mixture of DNA molecules could also be derived from DNA extracted from single cells. In an embodiment, the mixture of DNA molecules could also be derived from DNA extracted from mixture of two or more cells of the same individual, or of different individuals. In an embodiment, the mixture of DNA molecules could be derived from DNA isolated from biological material that has already liberated from cells such as blood plasma, which is known to contain cell free DNA. In an embodiment, the biological material may be a mixture of DNA from one or more individuals, as is the case during pregnancy where it has been shown that fetal DNA is present in the mixture. In an embodiment, the biological material could be from a mixture of cells that were found in maternal blood, where some of the cells are fetal in origin. In an embodiment, the biological material could be cells from the blood of a pregnant which have been enriched in fetal cells.

Circularizing Probes

Some embodiments of the present disclosure involve the use of "Linked Inverted Probes" (LIPs), which have been previously described in the literature, to amplify the target loci before or after amplification using primers that are not LIPs in the multiplex PCR methods of the invention. LIPs is a generic term meant to encompass technologies that involve the creation of a circular molecule of DNA, where the probes are designed to hybridize to targeted region of DNA on either side of a targeted allele, such that addition of appropriate polymerases and/or ligases, and the appropriate conditions, buffers and other reagents, will complete the complementary, inverted region of DNA across the targeted allele to create a circular loop of DNA that captures the information found in the targeted allele. LIPs may also be called pre-circularized probes, pre-circularizing probes, or circularizing probes. The LIPs probe may be a linear DNA molecule between 50 and 500 nucleotides in length, and in an embodiment between 70 and 100 nucleotides in length; in some embodiments, it may be longer or shorter than described herein. Others embodiments of the present disclosure involve different incarnations, of the LIPs technology, such as Padlock Probes and Molecular Inversion Probes (MIPs).

One method to target specific locations for sequencing is to synthesize probes in which the 3' and 5' ends of the probes anneal to target DNA at locations adjacent to and on either side of the targeted region, in an inverted manner, such that the addition of DNA polymerase and DNA ligase results in extension from the 3' end, adding bases to single stranded probe that are complementary to the target molecule (gap-fill), followed by ligation of the new 3' end to the 5' end of the original probe resulting in a circular DNA molecule that can be subsequently isolated from background DNA. The probe ends are designed to flank the targeted region of interest. One aspect of this approach is commonly called MIPS and has been used in conjunction with array technologies to determine the nature of the sequence filled in. One drawback to the use of MIPs in the context of measuring allele ratios is that the hybridization, circularization and amplification steps do not happed at equal rates for different alleles at the same loci. This results in measured allele ratios that are not representative of the actual allele ratios present in the original mixture.

In an embodiment, the circularizing probes are constructed such that the region of the probe that is designed to hybridize upstream of the targeted polymorphic locus and the region of the probe that is designed to hybridize downstream of the targeted polymorphic locus are covalently connected through a non-nucleic acid backbone. This backbone can be any biocompatible molecule or combination of biocompatible molecules. Some examples of possible biocompatible molecules are poly(ethylene glycol), polycarbonates, polyurethanes, polyethylenes, polypropylenes, sulfone polymers, silicone, cellulose, fluoropolymers, acrylic compounds, styrene block copolymers, and other block copolymers.

In an embodiment of the present disclosure, this approach has been modified to be easily amenable to sequencing as a means of interrogating the filled in sequence. In order to retain the original allelic proportions of the original sample at least one key consideration must be taken into account. The variable positions among different alleles in the gap-fill region must not be too close to the probe binding sites as there can be initiation bias by the DNA polymerase resulting in differential of the variants. Another consideration is that additional variations may be present in the probe binding sites that are correlated to the variants in the gap-fill region which can result unequal amplification from different alleles. In an embodiment of the present disclosure, the 3' ends and 5' ends of the pre-circularized probe are designed to hybridize to bases that are one or a few positions away from the variant positions (polymorphic sites) of the targeted allele. The number of bases between the polymorphic site (SNP or otherwise) and the base to which the 3' end and/or 5' of the pre-circularized probe is designed to hybridize may be one base, it may be two bases, it may be three bases, it may be four bases, it may be five bases, it may be six bases, it may be seven to ten bases, it may be eleven to fifteen bases, or it may be sixteen to twenty bases, twenty to thirty bases, or thirty to sixty bases. The forward and reverse primers may be designed to hybridize a different number of bases away from the polymorphic site. Circularizing probes can be generated in large numbers with current DNA synthesis technology allowing very large numbers of probes to be generated and potentially pooled, enabling interrogation of many loci simultaneously. It has been reported to work with more than 300,000 probes. Two papers that discuss a method involving circularizing probes that can be used to measure the genomic data of the target individual include: Porreca et al., Nature Methods, 2007 4(11), pp. 931-936.; and also Turner et al., Nature Methods, 2009, 6(5), pp. 315-316. The methods described in these papers may be used in combination with other methods described herein. Certain steps of the method from these two papers may be used in combination with other steps from other methods described herein.

In some embodiments of the methods disclosed herein, the genetic material of the target individual is optionally amplified, followed by hybridization of the pre-circularized probes, performing a gap fill to fill in the bases between the two ends of the hybridized probes, ligating the two ends to form a circularized probe, and amplifying the circularized probe, using, for example, rolling circle amplification. Once the desired target allelic genetic information is captured by circularizing appropriately designed oligonucleotide probes, such as in the LIPs system, the genetic sequence of the circularized probes may be being measured to give the desired sequence data. In an embodiment, the appropriately designed oligonucleotides probes may be circularized directly on unamplified genetic material of the target individual, and amplified afterwards. Note that a number of amplification procedures may be used to amplify the original genetic material, or the circularized LIPs, including rolling circle amplification, MDA, or other amplification protocols.

Different methods may be used to measure the genetic information on the target genome, for example using high throughput sequencing, Sanger sequencing, other sequencing methods, capture-by-hybridization, capture-by-circularization, multiplex PCR, other hybridization methods, and combinations thereof.

Once the genetic material of the individual has been measured using one or a combination of the above methods, an informatics based method, such as the PARENTAL SUPPORT™ method, along with the appropriate genetic measurements, can then be used to determination the ploidy state of one or more chromosomes on the individual, and/or the genetic state of one or a set of alleles, specifically those alleles that are correlated with a disease or genetic state of interest. Note that the use of LIPs has been reported for multiplexed capture of genetic sequences, followed by genotyping with sequencing. However, the use of sequencing data resulting from a LIPs-based strategy for the amplification of the genetic material found in a single cell, a small number of cells, or extracellular DNA, has not been used for the purpose of determining the ploidy state of a target individual.

Applying an informatics based method to determine the ploidy state of an individual from genetic data as measured by hybridization arrays, such as the ILLUMINA INFINIUM array, or the AFFYMETRIX gene chip has been described in documents references elsewhere in this document. However, the method described herein shows improvements over methods described previously in the literature. For example, the LIPs based approach followed by high throughput sequencing unexpectedly provides better genotypic data due to the approach having better capacity for multiplexing, better capture specificity, better uniformity, and low allelic bias. Greater multiplexing allows more alleles to be targeted, giving more accurate results. Better uniformity results in more of the targeted alleles being measured, giving more accurate results. Lower rates of allelic bias result in lower rates of miscalls, giving more accurate results. More accurate results result in an improvement in clinical outcomes, and better medical care.

It is important to note that LIPs may be used as a method for targeting specific loci in a sample of DNA for genotyping by methods other than sequencing. For example, LIPs may be used to target DNA for genotyping using SNP arrays or other DNA or RNA based microarrays.

Ligation-mediated PCR

Ligation-mediated PCR may be used to amplify the target loci before or after PCR amplification using primers that are not ligated. Ligation-mediated PCR is a method of PCR used to preferentially enrich a sample of DNA by amplifying one or a plurality of loci in a mixture of DNA, the method comprising: obtaining a set of primer pairs, where each primer in the pair contains a target specific sequence and a non-target sequence, where the target specific sequence is preferably designed to anneal to a target region, one upstream and one downstream from the polymorphic site, and which can be separated from the polymorphic site by 0, 1, 2, 3, 4, 5, 6, 7, 8, 9, 10, 11-20, 21-30, 31-40, 41-50, 51-100, or more than 100; polymerization of the DNA from the 3-prime end of upstream primer to the fill the single strand region between it and the 5-prime end of the downstream primer with nucleotides complementary to the target molecule; ligation of the last polymerized base of the upstream primer to the adjacent 5-prime base of the downstream primer; and amplification of only polymerized and ligated molecules using the non-target sequences contained at the 5-prime end of the upstream primer and the 3-prime end of the downstream primer. Pairs of primers to distinct targets may be mixed in the same reaction. The non-target sequences serve as universal sequences such that of all pairs of primers that have been successfully polymerized and ligated may be amplified with a single pair of amplification primers.

Capture by Hybridization

In some embodiments, a method of the present disclosure may involve using any of the following capture by hybridization methods in addition to using multiplex PCR to amplify the target loci. Preferential enrichment of a specific set of sequences in a target genome can be accomplished in a number of ways. Elsewhere in this document is a description of how LIPs can be used to target a specific set of sequences, but in all of those applications, other targeting and/or preferential enrichment methods can be used equally well for the same ends. One example of another targeting method is the capture by hybridization approach. Some examples of commercial capture by hybridization technologies include AGILENT's SURE SELECT and ILLUMINA's TRUSEQ. In capture by hybridization, a set of oligonucleotides that is complimentary or mostly complimentary to the desired targeted sequences is allowed to hybridize to a mixture of DNA, and then physically separated from the mixture. Once the desired sequences have hybridized to the targeting oligonucleotides, the effect of physically removing the targeting oligonucleotides is to also remove the targeted sequences. Once the hybridized oligos are removed, they can be heated to above their melting temperature and they can be amplified. Some ways to physically remove the targeting oligonucleotides is by covalently bonding the targeting oligos to a solid support, for example a magnetic bead, or a chip. Another way to physically remove the targeting oligonucleotides is by covalently bonding them to a molecular moiety with a strong affinity for another molecular moiety. An example of such a molecular pair is biotin and streptavidin, such as is used in SURE SELECT. Thus that targeted sequences could be covalently attached to a biotin molecule, and after hybridization, a solid support with streptavidin affixed can be used to pull down the biotinylated oligonucleotides, to which are hybridized to the targeted sequences.

Hybrid capture involves hybridizing probes that are complementary to the targets of interest to the target molecules. Hybrid capture probes were originally developed to target and enrich large fractions of the genome with relative uniformity between targets. In that application, it was important that all targets be amplified with enough uniformity that all regions could be detected by sequencing, however, no regard was paid to retaining the proportion of alleles in original sample. Following capture, the alleles present in the sample can be determined by direct sequencing of the captured molecules. These sequencing reads can be analyzed and counted according the allele type. However, using the current technology, the measured allele distributions the captured sequences are typically not representative of the original allele distributions.

In an embodiment, detection of the alleles is performed by sequencing. In order to capture the allele identity at the polymorphic site, it is essential that the sequencing read span the allele in question in order to evaluate the allelic composition of that captured molecule. Since the capture molecules are often of variable lengths upon sequencing cannot be guaranteed to overlap the variant positions unless the entire molecule is sequenced. However, cost considerations as well as technical limitations as to the maximum possible length and accuracy of sequencing reads make sequencing the entire molecule unfeasible. In an embodiment, the read length can be increased from about 30 to about 50 or about 70 bases can greatly increase the number of reads that overlap the variant positions within the targeted sequences.

Another way to increase the number of reads that interrogate the position of interest is to decrease the length of the probe, as long as it does not result in bias in the underlying enriched alleles. The length of the synthesized probe should be long enough such that two probes designed to hybridize to two different alleles found at one locus will hybridize with near equal affinity to the various alleles in the original sample. Currently, methods known in the art describe probes that are typically longer than 120 bases. In a current embodiment, if the allele is one or a few bases then the capture probes may be less than about 110 bases, less than about 100 bases, less than about 90 bases, less than about 80 bases, less than about 70 bases, less than about 60 bases, less than about 50 bases, less than about 40 bases, less than about 30 bases, and less than about 25 bases, and this is sufficient to ensure equal enrichment from all alleles. When the mixture of DNA that is to be enriched using the hybrid capture technology is a mixture comprising free floating DNA isolated from blood, for example maternal blood, the average length of DNA is quite short, typically less than 200 bases. The use of shorter probes results in a greater chance that the hybrid capture probes will capture desired DNA fragments. Larger variations may require longer probes. In an embodiment, the variations of interest are one (a SNP) to a few bases in length. In an embodiment, targeted regions in the genome can be preferentially enriched using hybrid capture probes wherein the hybrid capture probes are of a length below 90 bases, and can be less than 80 bases, less than 70 bases, less than 60 bases, less than 50 bases, less than 40 bases, less than 30 bases, or less than 25 bases. In an embodiment, to increase the chance that the desired allele is sequenced, the length of the probe that is designed to hybridize to the regions flanking the polymorphic allele location can be decreased from above 90 bases, to about 80 bases, or to about 70 bases, or to about 60 bases, or to about 50 bases, or to about 40 bases, or to about 30 bases, or to about 25 bases.

There is a minimum overlap between the synthesized probe and the target molecule in order to enable capture. This synthesized probe can be made as short as possible while still being larger than this minimum required overlap. The effect of using a shorter probe length to target a polymorphic region is that there will be more molecules that overlap the target allele region. The state of fragmentation of the original DNA molecules also affects the number of reads that will overlap the targeted alleles. Some DNA samples such as plasma samples are already fragmented due to biological processes that take place in vivo. However, samples with longer fragments by benefit from fragmentation prior to sequencing library preparation and enrichment. When both probes and fragments are short (~60-80 bp) maximum specificity may be achieved relatively few sequence reads failing to overlap the critical region of interest.

In an embodiment, the hybridization conditions can be adjusted to maximize uniformity in the capture of different alleles present in the original sample. In an embodiment, hybridization temperatures are decreased to minimize differences in hybridization bias between alleles. Methods known in the art avoid using lower temperatures for hybridization because lowering the temperature has the effect of increasing hybridization of probes to unintended targets. However, when the goal is to preserve allele ratios with maximum fidelity, the approach of using lower hybridization temperatures provides optimally accurate allele ratios, despite the fact that the current art teaches away from this approach. Hybridization temperature can also be increased to require greater overlap between the target and the synthesized probe so that only targets with substantial overlap of the targeted region are captured. In some embodiments of the present disclosure, the hybridization temperature is lowered from the normal hybridization temperature to about 40° C., to about 45° C., to about 50° C., to about 55° C., to about 60° C., to about 65, or to about 70° C.

In an embodiment, the hybrid capture probes can be designed such that the region of the capture probe with DNA that is complementary to the DNA found in regions flanking the polymorphic allele is not immediately adjacent to the polymorphic site. Instead, the capture probe can be designed such that the region of the capture probe that is designed to hybridize to the DNA flanking the polymorphic site of the target is separated from the portion of the capture probe that will be in van der Waals contact with the polymorphic site by a small distance that is equivalent in length to one or a small number of bases. In an embodiment, the hybrid capture probe is designed to hybridize to a region that is flanking the polymorphic allele but does not cross it; this may be termed a flanking capture probe. The length of the flanking capture probe may be less than about 120 bases, less than about 110 bases, less than about 100 bases, less than about 90 bases, and can be less than about 80 bases, less than about 70 bases, less than about 60 bases, less than about 50 bases, less than about 40 bases, less than about 30 bases, or less than about 25 bases. The region of the genome that is targeted by the flanking capture probe may be separated by the polymorphic locus by 1, 2, 3, 4, 5, 6, 7, 8, 9, 10, 11-20, or more than 20 base pairs.

Description of a targeted capture based disease screening test using targeted sequence capture. Custom targeted sequence capture, like those currently offered by AGILENT (SURE SELECT), ROCHE-NIMBLEGEN, or ILLUMINA. Capture probes could be custom designed to ensure capture of various types of mutations. For point mutations, one or more probes that overlap the point mutation should be sufficient to capture and sequence the mutation.

For small insertions or deletions, one or more probes that overlap the mutation may be sufficient to capture and sequence fragments comprising the mutation. Hybridization may be less efficient between the probe-limiting capture efficiency, typically designed to the reference genome sequence. To ensure capture of fragments comprising the mutation one could design two probes, one matching the normal allele and one matching the mutant allele. A longer probe may enhance hybridization. Multiple overlapping probes may enhance capture. Finally, placing a probe immediately adjacent to, but not overlapping, the mutation may permit relatively similar capture efficiency of the normal and mutant alleles.

For Simple Tandem Repeats (STRs), a probe overlapping these highly variable sites is unlikely to capture the fragment well. To enhance capture a probe could be placed adjacent to, but not overlapping the variable site. The fragment could then be sequenced as normal to reveal the length and composition of the STR.

For large deletions, a series of overlapping probes, a common approach currently used in exon capture systems may work. However, with this approach it may be difficult to determine whether or not an individual is heterozygous. Targeting and evaluating SNPs within the captured region could potentially reveal loss of heterozygosity across the region indicating that an individual is a carrier. In an embodiment, it is possible to place non-overlapping or singleton probes across the potentially deleted region and use the number of fragments captured as a measure of heterozygosity. In the case where an individual caries a large deletion, one-half the number of fragments are expected to be available for capture relative to a non-deleted (diploid) reference locus. Consequently, the number of reads obtained from the deleted regions should be roughly half that obtained from a normal diploid locus. Aggregating and averaging the sequencing read depth from multiple singleton probes across the potentially deleted region may enhance the signal and improve confidence of the diagnosis. The two approaches, targeting SNPs to identify loss of heterozygosity and using multiple singleton probes to obtain a quantitative measure of the quantity of underlying fragments from that locus can also be combined. Either or both of these strategies may be combined with other strategies to better obtain the same end.

If during testing cfDNA detection of a male fetus, as indicated by the presence of the Y-chromosome fragments, captured and sequenced in the same test, and either an X-linked dominant mutation where mother and father are unaffected, or a dominant mutation where mother is not affected would indicated heighted risk to the fetus. Detection of two mutant recessive alleles within the same gene in an unaffected mother would imply the fetus had inherited a mutant allele from father and potentially a second mutant allele from mother. In all cases, follow-up testing by amniocentesis or chorionic villus sampling may be indicated.

A targeted capture based disease screening test could be combined with a targeted capture based non-invasive prenatal diagnostic test for aneuploidy.

There are a number of ways to decrease depth of read (DOR) variability: for example, one could increase primer concentrations, one could use longer targeted amplification probes, or one could run more STA cycles (such as more than 25, more than 30, more than 35, or even more than 40) Exemplary Methods of Determining the Number of DNA Molecules in a Sample.

A method is described herein to determine the number of DNA molecules in a sample by generating a uniquely identified molecule for each original DNA molecules in the sample during the first round of DNA amplification. Described here is a procedure to accomplish the above end followed by a single molecule or clonal sequencing method.

The approach entails targeting one or more specific loci and generating a tagged copy of the original molecules such manner that most or all of the tagged molecules from each targeted locus will have a unique tag and can be distinguished from one another upon sequencing of this barcode using clonal or single molecule sequencing. Each unique sequenced barcode represents a unique molecule in the original sample. Simultaneously, sequencing data is used to ascertain the locus from which the molecule originates. Using this information one can determine the number of unique molecules in the original sample for each locus.

This method can be used for any application in which quantitative evaluation of the number of molecules in an original sample is required. Furthermore, the number of unique molecules of one or more targets can be related to the number of unique molecules to one or more other targets to determine the relative copy number, allele distribution, or allele ratio. Alternatively, the number of copies detected from various targets can be modeled by a distribution in order to identify the mostly likely number of copies of the original targets. Applications include but are not limited to detection of insertions and deletions such as those found in carriers of Duchenne Muscular Dystrophy; quantitation of deletions or duplications segments of chromosomes such as those observed in copy number variants; chromosome copy number of samples from born individuals; chromosome copy number of samples from unborn individuals such as embryos or fetuses.

The method can be combined with simultaneous evaluation of variations contained in the targeted by sequence. This can be used to determine the number of molecules representing each allele in the original sample. This copy number method can be combined with the evaluation of SNPs or other sequence variations to determine the chromosome copy number of born and unborn individuals; the discrimination and quantification of copies from loci which have short sequence variations, but in which PCR may amplifies from multiple target regions such as in carrier detection of Spinal Muscle Atrophy; determination of copy number of different sources of molecules from samples consisting of mixtures of different individual such as in detection of fetal aneuploidy from free floating DNA obtained from maternal plasma.

In an embodiment, the method as it pertains to a single target locus may comprise one or more of the following steps: (1) Designing a standard pair of oligomers for PCR amplification of a specific locus. (2) Adding, during synthesis, a sequence of specified bases with no or minimal complimentarity to the target locus or genome to the 5' end of the one of the target specific oligomer. This sequence, termed the tail, is a known sequence, to be used for subsequent amplification, followed by a sequence of random nucleotides. These random nucleotides comprise the random region. The random region comprises a randomly generated sequence of nucleic acids that probabilistically differ between each probe molecule. Consequently, following synthesis, the tailed oligomer pool will consist of a collection of oligomers beginning with a known sequence followed by unknown sequence that differs between molecules, followed by the target specific sequence. (3) Performing one round of amplification (denaturation, annealing, extension) using only the tailed oligomer. (4) adding exonuclease to the reaction, effectively stopping the PCR reaction, and incubating the reaction at the appropriate temperature to remove forward single stranded oligos that did not anneal to temple and extend to form a double stranded product. (5) Incubating the reaction at a high temperature to denature the exonuclease and eliminate its activity. (6) Adding to the reaction a new oligonucleotide that is complementary to tail of the oligomer used in the first reaction along with the other target specific oligomer to enable PCR amplification of the product generated in the first round of PCR. (7) Continuing amplification to generate enough product for downstream clonal sequencing. (8) Measuring the amplified PCR product by a multitude of methods, for example, clonal sequencing, to a sufficient number of bases to span the sequence.

In an embodiment, a method of the present disclosure involves targeting multiple loci in parallel or otherwise. Primers to different target loci can be generated independently and mixed to create multiplex PCR pools. In an embodiment, original samples can be divided into subpools and different loci can be targeted in each sub-pool before being recombined and sequenced. In an embodiment, the tagging step and a number of amplification cycles may be performed before the pool is subdivided to ensure efficient targeting of all targets before splitting, and improving subsequent amplification by continuing amplification using smaller sets of primers in subdivided pools.

One example of an application where this technology would be particularly useful is non-invasive prenatal aneuploidy diagnosis where the ratio of alleles at a given locus or a distribution of alleles at a number of loci can be used to help determine the number of copies of a chromosome present in a fetus. In this context, it is desirable to amplify the DNA present in the initial sample while maintaining the relative amounts of the various alleles. In some circumstances, especially in cases where there is a very small amount of DNA, for example, fewer than 5,000 copies of the genome, fewer than 1,000 copies of the genome, fewer than 500 copies of the genome, and fewer than 100 copies of the genome, one can encounter a phenomenon called bottlenecking. This is where there are a small number of copies of any given allele in the initial sample, and amplification biases can result in the amplified pool of DNA having significantly different ratios of those alleles than are in the initial mixture of DNA. By applying a unique or nearly unique set of barcodes to each strand of DNA before standard PCR amplification, it is possible to exclude n-1 copies of DNA from a set of n identical molecules of sequenced DNA that originated from the same original molecule.

For example, imagine a heterozygous SNP in the genome of an individual, and a mixture of DNA from the individual where ten molecules of each allele are present in the original sample of DNA. After amplification there may be 100,000 molecules of DNA corresponding to that locus. Due to stochastic processes, the ratio of DNA could be anywhere from 1:2 to 2:1, however, since each of the original molecules was tagged with a unique tag, it would be possible to determine that the DNA in the amplified pool originated from exactly 10 molecules of DNA from each allele. This method would therefore give a more accurate measure of the relative amounts of each allele than a method not using this approach. For methods where it is desirable for the relative amount of allele bias to be minimized, this method will provide more accurate data.

Association of the sequenced fragment to the target locus can be achieved in a number of ways. In an embodiment, a sequence of sufficient length is obtained from the targeted fragment to span the molecule barcode as well a sufficient number of unique bases corresponding to the target sequence to allow unambiguous identification of the target locus. In another embodiment, the molecular bar-coding primer that contains the randomly generated molecular barcode can also contain a locus specific barcode (locus barcode) that identifies the target to which it is to be associated. This locus barcode would be identical among all molecular bar-coding primers for each individual target and hence all resulting amplicons, but different from all other targets. In an embodiment, the tagging method described herein may be combined with a one-sided nesting protocol.

In an embodiment, the design and generation of molecular barcoding primers may be reduced to practice as follows: the molecular barcoding primers may consist of a sequence that is not complementary to the target sequence followed by random molecular barcode region followed by a target specific sequence. The sequence 5' of molecular barcode may be used for subsequence PCR amplification and may comprise sequences useful in the conversion of the amplicon to a library for sequencing. The random molecular barcode sequence could be generated in a multitude of ways. The preferred method synthesizes the molecule tagging primer in such a way as to include all four bases to the reaction during synthesis of the barcode region. All or various combinations of bases may be specified using the IUPAC DNA ambiguity codes. In this manner the synthesized collection of molecules will contain a random mixture of sequences in the molecular barcode region. The length of the barcode region will determine how many primers will contain unique barcodes. The number of unique sequences is related to the length of the barcode region as $N^L$ where N is the number of bases, typically 4, and L is the length of the barcode. A barcode of five bases can yield up to 1024 unique sequences; a barcode of eight bases can yield 65536 unique barcodes. In an embodiment, the DNA can be measured by a sequencing method, where the sequence data represents the sequence of a single molecule. This can include methods in which single molecules are sequenced directly or methods in which single molecules are amplified to form clones detectable by the sequence instrument, but that still represent single molecules, herein called clonal sequencing.

Exemplary Methods and Reagents for Quantification of Amplification Products

Quantitation of specific nucleic acid sequences of interest is typically done by quantitative real-time PCR techniques such as TAQMAN (LIFE TECHNOLOGIES), INVADER probes (THIRD WAVE TECHNOLOGIES), and the like. Such techniques suffer from numerous shortcomings such as limited ability to achieve the simultaneous analysis of multiple sequences in parallel (multiplexation) and the ability to provide accurate quantitative data for only a narrow range of possible amplification cycles (e.g., when the logarithm of PCR amplification production quantity versus the number of cycles is in the linear range). DNA sequencing techniques, particularly high throughput next-generation sequencing techniques (often referred to as massively parallel sequencing techniques) such as those employed in MYSEQ (ILLUMINA), HISEQ (ILLUMINA), ION TORRENT (LIFE TECHNOLOGIES), GENOME ANALYZER ILX (ILLUMINA), GS FLEX+ (ROCHE 454) etc., can be used for by quantitative measurements of the number of copies of sequence of interest present in sample, thereby providing quantitative information about the starting materials, e.g., copy number or transcription levels. High throughput genetic sequencers are amenable to the use of bar coding (i.e., sample tagging with distinctive nucleic acid sequences) so as to identify specific samples from individuals thereby permitting the simultaneous analysis of multiple samples in a single run of the DNA sequencer. The number of times a given region of the genome in a library preparation (or other nucleic preparation of interest) is sequenced (number of reads) will be proportional to the number of copies of that sequence in the genome of interest (or expression level in the case of cDNA containing preparations). However, the preparation and sequencing of genetic libraries (and similar genome derived preparations) can introduce numerous biases that interfere with obtaining an accurate quantitative reading for the nucleic acid sequence of interest. For example, different nucleic acid sequences can amplify with different efficiencies during nucleic amplification steps that take place during the genetic library preparation or sample preparation.

The problem with differential amplification efficiencies can be mitigated by using certain embodiments of the subject invention. The subject invention includes various methods and compositions that relate to the use of standards for inclusion in amplification processes that can be used to improve the accuracy of quantitation. The invention is of use in, among other areas, the detection of aneuploidy in a fetus by analyzing free floating fetal DNA in maternal blood, as described herein and as described, among other places, U.S. Pat. Nos. 8,008,018; 7,332,277; PCT Published Application WO 2012/078792A2; and PCT Published Application WO 2011/146632 A1, which are each herein incorporated by reference in its entirety Embodiments of the invention are also of use in the detection of aneuploidy in an in vitro generated embryos. Commercially significant aneuploidies that may be detected include aneuploidy of the human chromosomes 13, 18, 21, X and Y.

Embodiments of the invention may be used with either human or non-human nucleic acids, and may be applied to both animal and plant derived nucleic acids. Embodiments of the invention may also be used to detect and/or quantitate alleles for other genetic disorders characterized by deletions or insertions. The deletion containing alleles can be detected in suspected carriers of the allele of interest.

One embodiment of the subject invention includes standards that are present in a known quantity (relative or absolute). For example, consider a genetic library made from a genetic source that is diploid for chromosome 8 (containing locus A) and triploid for chromosome 21 (containing locus B). A genetic library can be produced from this sample that will contain sequences in quantities that are a function of the number of chromosomes present in the sample, e.g., 200 copies of locus A and 300 copies of locus B. However, if locus A amplifies much more efficiently than locus B, after PCR there may be 60,000 copies of the A amplicon and 30,000 copies of the B amplicon, thus obscuring the true chromosomal copy number of the initial genomic sample when analysis by high throughput DNA sequencing (or other quantitative nucleic acid detection techniques). To mitigate this problem a standard sequence for locus A is employed, wherein the standard sequence amplifies with essentially the same efficiency as locus A. Similarly, a standard sequence for locus B is created, wherein the standard sequence amplifies with the essentially the same efficiency as locus B. A standard sequence of locus A and a standard sequence for locus B are added to the mixture prior to PCR (or other amplification techniques). These standard sequences are present in known quantities, either relative quantities or absolute quantities. Thus if a 1:1 mixture of standard sequence A and standard sequence B were added (prior to amplification) to the mixture in the previous example, 3000 copies of the standard A amplicon would be produced and 1000 copies of the standard B amplicon would be produced, showing that locus A is amplified 3 times more efficiently than locus B, under the same set of conditions.

In various embodiments one or more selected regions of a genome containing a SNP (or other polymorphism) of interest can be specifically amplified and subsequently sequenced. This target specific amplification can take place during the formation of a genetic library for sequencing. The library can contain numerous targeted regions for amplification. In some embodiments at least 10; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 regions of interest. Examples of such libraries are described herein and can be found in U.S. Patent Application No. 2012/0270212, filed Nov. 18, 2011, which is herein incorporated by reference in its entirety.

Many high throughput DNA sequencing techniques require the modification of the genetic starting material, e.g., the litigation of universal priming sites and/or barcodes, so as to form libraries to facilitate the clonal amplification of small nucleic acid fragments prior to performing subsequent sequencing reactions. In some embodiments, one or more standard sequences are added during genetic library formation or added to a precursor component of a genetic library prior to amplification of the library. The standard sequences can be selected so as to mimic (yet be distinguishable based on nucleotide base sequence) target genomic fragments to be prepared for sequencing by a high throughput genetic sequencing technique. In one embodiment, the standard sequence can be identical to the target genomic fragment excepting one, two, three, four to ten, or eleven to twenty nucleotides. In some embodiments, when the target genetic sequence contains a SNP, the standard sequence can be identical to the SNP excepting the nucleotide at the polymorphic base, which may be chosen to be one of the four nucleotides that is not observed at that location in nature. The standard sequences can be used in a highly multiplexed analysis of multiple target loci (such as polymorphic loci). Standard sequences can be added during the process of library formation (prior to amplification) in known quantities (relative or absolute) so as to provide a standard metric for greater accuracy in determining the amount of target sequence of interest in the sample of analysis. The combination of knowledge of the known quantities of the standard sequences used in conjunction with the knowledge of the ploidy level formation of library for sequencing formed from a genome of previously characterized ploidy level, e.g., known to be diploid for all autosomal chromosomes, can be used to calibrate the amplification properties of each standard sequence with respect to its corresponding target sequence and account for variations between batches of mixtures comprising multiple standard sequences. Given that it is often necessary to simultaneously analyze a large number of loci, it is useful to produce a mixture comprising a large set standard sequences. Embodiments of the invention include mixtures comprising multiple standard sequences. Ideally the amount of each standard sequence in the mixture is known with high precision. However, it is extremely difficult to achieve this ideal because as a practical matter there is a significant amount of variation in the quantity of each standard sequence in the mixture, particularly for mixtures comprising a large number of different synthetic oligonucleotides. This variation has numerous sources, e.g., variations in in vitro oligonucleotide synthesis reaction efficiencies between batch, inaccuracies in volume measurement, variations in pipetting. Furthermore, this variation can occur between different batches of that theoretically contain the exact same set of standard sequences in the exact same amounts. Accordingly, it is of interest to calibrate each batch of standard sequences independently. Batches of standard sequences can be calibrated against reference genomes of known chromosomal composition. Batched of standard sequences can be calibrated by sequencing the batch of standard sequences with minimal or no amplifications steps included in the sequencing protocol. Embodiments of the invention include calibrated mixtures of different standard sequences. Other embodiments of the invention include methods of calibrating mixtures of different standard sequences and calibrated mixtures of different standard sequences made by the subject methods.

Various embodiments of the subject mixtures of standard sequences and methods for using them can comprise at least 10; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 or more standards sequences, as well as various intermediate amounts. The number of the standard sequences can be the same as the number of target sequences selected for analysis during the generation of a targeted library for DNA sequencing. However, in some embodiments, it may be advantageous to use a lower number of standard sequences than the number of targeted regions in the library being constructed. It may be advantageous to use the lower number so as avoid coming up against the limits of the sequencing capacity of the high throughput DNA sequencer being employed. The number of standard sequences can be 50% or less than the number of targeted regions, 40% or less than the number of targeted regions, be 30% or less than the number of targeted regions, 20% or less than the number of targeted regions, be 10% or less than the number of targeted regions, 5% or less than the number of targeted regions, 1% or less than the number of targeted regions, as well as various intermediate values. For example, if a genetic library is created using 15,000 pairs of primers targeted to specific SNP containing loci, a suitable a mixture containing 1500 standard sequences corresponding to 1500 of the 15,000 targeted loci can be added prior to the amplification step of library constructions.

The amount of standard sequences added during library construction can vary considerably among different embodiments. In some embodiments, the amount of each standard sequence can be approximately the same as the predicted amount of the target sequence present in the genomic material sample used for library preparation. In other embodiments, the amount of each standard sequence can be greater or less than the predicted amount of the target sequence present in the genomic material sample used for library preparation. While the initial relative amounts of the target sequence and the standard sequence are not critical for the function of the invention, it is preferable that the amount be within the range 100 times greater to 100 times less than the amount of the target sequence present in the genomic material sample used for library preparation. Excessive amounts of standard may use too much sequencing capacity of the DNA sequencer in a given run of the instrument. Using too low an amount of standard sequences will produce insufficient data to aid in the analysis of variation in amplification efficiency.

The standard sequences may be selected to be very similar in nucleotide base sequence to the amplified regions of interest; preferably the standard sequence has the exact same primer-binding sites as the analyzed genomic region, i.e., the "target sequence." The standard sequence must be distinguishable from the corresponding target sequence at a given locus. For the sake of convenience, this distinguishable region of the standard sequence will be referred to as a "marker sequence." In some embodiments, the marker sequence region of the target sequences contains the polymorphic region, e.g., a SNP, and can be flanked on both sides by primer binding regions. The standard sequence may be selected to closely match the GC content of the corresponding target sequence. In some embodiments, the primer binding regions of the standard sequence are flanked by universal priming sites. These universal priming sites are selected to match universal priming sites used in a genomic library for analysis. In other embodiments, the standard sequences do not have universal priming sites and the universal priming sites are added during the creation of a library. Standard sequences are typically provided in single stranded form. A standard sequence is defined with respect to a corresponding target sequence and the sequence specific reagents used to amplify the target sequence. In some embodiments, the target sequence contains the polymorphism of interest, e.g., a SNP, a deletion, or insertion, present in the nucleic acid sample for analysis. The standard sequence is a synthetic polynucleotide that is similar in nucleotide base sequence to the target sequence, but is nonetheless distinguishable from the target sequence by virtue of at least one nucleotide base difference, thereby providing a mechanism for distinguishing amplicon sequences derived from the standard sequence form amplicon sequences derived from the target sequence. Standard sequences are selected so as to have essentially the same amplification properties as the corresponding target sequence when amplified with the same set of amplification reagents, e.g., PCR primers. In some embodiments, the standard sequences can have the same primer sequence binding sites than the corresponding target sequences. In other embodiments, the standard sequences can have a different primer sequence binding sites than the corresponding target sequences. In some embodiments, the standard sequences can be selected to produce amplicons that have the same length as the length of amplicons produced from the corresponding target sequences. In other embodiments, the standard sequences can be selected to produce amplicons that have the slightly different lengths than the length of amplicons produced from the corresponding target sequences.

After the amplification reactions have been completed, the library is sequenced on a high throughput DNA sequencer where individual molecule are clonally amplified and sequenced. The number of sequence reads for each allele of the target sequence is counted, also counted are the number of sequence reads for the standard sequence corresponding to the target sequence. The process is also carried out for at least one other pair of target sequences and corresponding standard sequences. Consider for example, locus A, $X_{A1}$ reads for allele 1 of locus A are produced; $X_{A2}$ reads for allele 2 of locus A are produced, and $X_{AC}$ reads for standard sequence A are produced. The ratio of ($X_{A1}$ plus $X_{A2}$) to $X_{AC}$ is determined for each locus of interest. As discussed earlier, the process can be performed on a reference genome, e.g., a genome that is known to be diploid for all chromosomes. The process can be repeated many times in order to provide a large number of read values so as to determine a mean number of reads and the standard deviation in the number of reads. The process is performed with a mixture comprising a large number of different standard sequences corresponding to different loci. By assuming that (1) $X_{A1}$ plus $X_{A2}$ corresponds to the known number of chromosome, e.g., 2 for the normal human female genome and (2) the standard sequences have similar amplification (and detectability) properties as their corresponding natural loci, the relative amounts of the different standard sequences in the multiplex standard mixture can be determined. The calibrated multiplex standard sequence mixture can then be used to adjust for the variability in amplification efficiency between the different loci in a multiplex amplification reaction.

Other embodiments of the invention include methods and compositions for measuring the copy number of specific genes of interest, including duplications and mutant genes characterized by large deletions that would interfere with quantitation by sequencing. Sequencing would have problems detecting alleles having such deletions. Standard sequences included the amplification process can be used to reduce this problem.

In one embodiment of the invention the target sequence for analysis is a gene having a wild type (i.e. functional) form and a mutant form characterized by a deletion. Exemplary of such genes is SMN1, an allele having deletion being responsible for the genetic disease spinal muscular atrophy (SMA). It is of interest to detect an individual carrying the mutant form of the gene by means of high throughput genetic sequencing techniques. The application of such techniques to the detection of deletion mutations can be problematic because, among other reasons, the lack of sequences observed in sequencing (as opposed to detecting a simple point mutation or SNP). Such embodiments employ (1) a pair of amplification primers specific for the gene of interest, where in the amplification primers will amplify the gene of interest (or a portion thereof) and will not significantly amplify the mutant allele, (2) a standard sequence corresponding to the wild type allele of the gene of interest (i.e., a target sequence), but differing by at least one detectable nucleotide base, (3) a pair of amplification primers specific for a second target sequence that serves as a reference sequence, and (4) a standard sequence corresponding to the reference sequence.

In one embodiment of the invention is provided a method for measuring the number of copies of the gene of interest, where in the gene of interest has one meaning allele that comprises a deletion. The method can employ amplification reagent specific for the gene of interest, e.g., PCR primers, that are specific for the gene of interest by amplifying at least a portion of the gene of interest, or the entire gene of interest, or a region adjacent to the gene of interest, while not amplifying the deletion comprising allele of the gene of interest. Additionally, the subject method employs a standard sequence corresponding to the gene of interest, wherein the standard sequence differs by at least one nucleotide base from the gene of interest (so that the sequence of the standard sequence can be readily distinguished from the naturally occurring gene of interest). Typically, the standard sequence will contain the same primer binding sites as the gene of interest so as to minimize any amplification discrimination between the gene of interest and the standard sequence corresponding to the gene of interest. The reaction will also comprises amplification reagents specific for a reference sequence. The reference sequence is a sequence of known (or at least assumed to be known) copy number in the genome to be analyzed. The reaction further comprises a standard sequence corresponding to the reference sequence. Typically, the standard sequence corresponding to the reference sequence will contain the same primer binding sites as the reference sequence so as to minimize any amplification discrimination between the reference sequence and the standard sequence corresponding to the reference sequence.

Exemplary PCR Conditions

If desired, any of the PCR conditions disclosed herein or any standard PCR conditions can be used to test a primer library to determine, e.g., the percent of primer dimers, percent of target amplicons, and percent of target loci that are amplified. If desired, standard methods can be used to optimize the reaction conditions to improve the performance of a primer library. Any of these PCR conditions may also be used in any of the methods of the invention to amplify target loci. It was determined that high ionic strength solutions can surprisingly be used for multiplex PCR. In some embodiments, monovalent cations are used to increase the ionic strength to, e.g., help the primers bind the template.

In some embodiments, the reaction volume includes ethylenediaminetetraacetic acid (EDTA), magnesium, tetramethyl ammonium chloride (TMAC), or any combination thereof. In some embodiments, the concentration of TMAC is between 20 and 80 mM, such as between 25 and 70 mM, 30 and 60 mM, 30 and 40 mM, 40 and 50 mM, 50 and 60 mM, or 60 and 70 mM, inclusive. While not meant to be bound to any particular theory, it is believed that TMAC binds to DNA, stabilizes duplexes, increases primer specificity, and/or equalizes the melting temperatures of different primers. In some embodiments, TMAC increases the uniformity in the amount of amplified products for the different targets. In some embodiments, the concentration of magnesium (such as magnesium from magnesium chloride) is between 1 and 10 mM, such as between 1 and 8 mM, 1 and 5 mM, 1 and 3 mM, 3 and 5 mM, 3 and 6 mM, or 5 and 8 mM, inclusive.

In some embodiments, the concentration of available magnesium (the concentration of magnesium that is assumed to be available for binding the polymerase and not bound to molecules other than the polymerase), such as the magnesium that is not bound by phosphate groups on dNTPs, primers, or nucleic acid templates, or carboxylic acid groups on magnetic or other beads, if present) is between 0.5 to 10 mM, such as between 1 and 8 mM, 1 and 5 mM, 1 and 3 mM, 3 and 5 mM, 3 and 6 mM, 4 and 6 mM, or 5 and 8 mM, inclusive. The large number of primers used for multiplex PCR of a large number of targets may chelate a lot of the magnesium (2 phosphates in the primers chelate 1 magnesium). For example, if enough primers are used such that the concentration of phosphate from the primers is ~9 mM, then the primers may reduce the effective magnesium concentration by ~4.5 mM. In some embodiments, EDTA is used to decrease the amount of magnesium available as a cofactor for the polymerase since high concentrations of magnesium can result in PCR errors, such as amplification of non-target loci. In some embodiments, the concentration of EDTA reduces the amount of available magnesium to between 1 and 5 mM (such as between 3 and 5 mM).

In some embodiments, the pH is between 7.5 and 8.5, such as between 7.5 and 8, 8 and 8.3, or 8.3 and 8.5, inclusive. In some embodiments, Tris is used at, for example, a concentration of between 10 and 100 mM, such as between 10 and 25 mM, 25 and 50 mM, 50 and 75 mM, or 25 and 75 mM, inclusive. In some embodiments, any of these concentrations of Tris are used at a pH between 7.5 and 8.5. In some embodiments, a combination of KCl and $(NH_4)_2SO_4$ is used, such as between 50 and 150 mM KCl and between 10 and 90 mM $(NH_4)_2SO_4$, inclusive. In some embodiments, the concentration of KCl is between 0 and 30 mM, between 50 and 100 mM, or between 100 and 150 mM, inclusive. In some embodiments, the concentration of $(NH_4)_2 SO_4$ is between 10 and 50 mM, 50 and 90 mM, 10 and 20 mM, 20 and 40 mM, 40 mM and 60, or 60 mM and 80 mM $(NH_4)_2SO_4$, inclusive. In some embodiments, the ammonium $[NH_4^+]$ concentration is between 0 and 160 mM, such as between 0 to 50, 50 to 100, or 100 to 160 mM, inclusive. In some embodiments, the sum of the potassium and ammonium concentration ($[K^+]+[NH_4]$) is between 0 and 160 mM, such as between 0 to 25, 25 to 50, 50 to 150, 50 to 75, 75 to 100, 100 to 125, or 125 to 160 mM, inclusive. An exemplary buffer with $[K^+]+[NH_4^+]$=120 mM is 20 mM KCl and 50 mM $(NH_4)_2SO_4$. In some embodiments, the buffer includes 25 to 75 mM Tris, pH 7.2 to 8, 0 to 50 mM KCl, 10 to 80 mM ammonium sulfate, and 3 to 6 mM magnesium, inclusive. In some embodiments, the buffer includes 25 to 75 mM Tris pH 7 to 8.5, 3 to 6 mM $MgCl_2$, 10 to 50 mM KCl, and 20 to 80 mM $(NH_4)_2SO_4$, inclusive. In some embodiments, 100 to 200 Units/mL of polymerase are used. In some embodiments, 100 mM KCl, 50 mM $(NH_4)_2SO_4$, 3 mM $MgCl_2$, 7.5 nM of each primer in the library, 50 mM TMAC, and 7 ul DNA template in a 20 ul final volume at pH 8.1 is used.

In some embodiments, a crowding agent is used, such as polyethylene glycol (PEG, such as PEG 8,000) or glycerol. In some embodiments, the amount of PEG (such as PEG 8,000) is between 0.1 to 20%, such as between 0.5 to 15%, 1 to 10%, 2 to 8%, or 4 to 8%, inclusive. In some embodiments, the amount of glycerol is between 0.1 to 20%, such as between 0.5 to 15%, 1 to 10%, 2 to 8%, or 4 to 8%, inclusive. In some embodiments, a crowding agent allows either a low polymerase concentration and/or a shorter annealing time to be used. In some embodiments, a crowding agent improves the uniformity of the DOR and/or reduces dropouts (undetected alleles). For example, at 8% PEG, and 50 U/mL polymerase, the uniformity was as good as 150 U/mL polymerase and no PEG. If the error rate increases when PEG is included, a higher magnesium chloride concentration (such greater than or about 4, 5, 6, 7, 8, 9, or 10 $MgCl_2$) can be used to reduce or prevent the increase in error rate. Inclusion of 8% PEG 8,000 allowed successful multiplexing with an annealing time of only 1 minute at an annealing temperature of 63° C.

In some embodiments, a polymerase with proof-reading activity, a polymerase without (or with negligible) proof-reading activity, or a mixture of a polymerase with proof-reading activity and a polymerase without (or with negligible) proof-reading activity is used. In some embodiments, a hot start polymerase, a non-hot start polymerase, or a mixture of a hot start polymerase and a non-hot start polymerase is used. In some embodiments, a HotStarTaq DNA polymerase is used (see, for example, QIAGEN catalog No. 203203, see, e.g., information available at the world wide web at qiagen.com/us/products/catalog/assay-technologies/end-point-pcr-and-rt-pcr-reagents/hotstartaq-dna-polymerase/, which is hereby incorporated by reference in its entirety). In some embodiments, AmpliTaq Gold® DNA Polymerase is used; it is a chemically modified form of AmpliTaq® DNA Polymerase requiring thermal activation (see, for example, Applied Biosystems catalog No. N8080241 see, e.g., information available at the world wide web at lifetechnologies.com/order/catalog/product/N8080241, which is hereby incorporated by reference in its entirety). In some embodiments, KAPA Taq DNA Polymerase or KAPA Taq HotStart DNA Polymerase is used; they are based on the single-subunit, wild-type Taq DNA polymerase of the thermophilic bacterium *Thermus aquaticus*. KAPA Taq and KAPA Taq HotStart DNA Polymerase have 5'-3' polymerase and 5'-3' exonuclease activities, but no 3' to 5' exonuclease (proofreading) activity (see, for example, KAPA BIOSYSTEMS catalog No. BK1000 see, e.g., information available at the world wide web at kapabiosystems.com/product-applications/products/pcr-2/kapa-taq-pcr-kits/, which is hereby incorporated by reference in its entirety). In some embodiments, Pfu DNA polymerase is used; it is a highly thermostable DNA polymerase from the hyperthermophilic archaeum *Pyrococcus furiosus*. The enzyme catalyzes the template-dependent polymerization of nucleotides into duplex DNA in the 5'→3' direction. Pfu DNA Polymerase also exhibits 3'→5' exonuclease (proofreading) activity that enables the polymerase to correct nucleotide incorporation errors. It has no 5'→3' exonuclease activity (see, for example, Thermo Scientific catalog No._EP0501 see, e.g., information available at the world wide web at thermoscientificbio.com/pcr-enzymes-master-mixes-and-reagents/pfu-dna-polymerase/, which is hereby incorporated by reference in its entirety). In some embodiments Klentaq1 is used; it is a Klenow-fragment analog of Taq DNA polymerase, it has no exonuclease or endonuclease activity (see, for example, DNA POLYMERASE TECHNOLOGY, Inc, St. Louis, Mo., catalog No._100 see, e.g., information available at the world wide web at klentaq.com/products/klentaq, which is hereby incorporated by reference in its entirety). In some embodiments, the polymerase is a PUSHION DNA polymerase, such as PHUSION High Fidelity DNA polymerase (M0530S, New England BioLabs, Inc.) or PHUSION Hot Start Flex DNA polymerase (M0535S, New England BioLabs, Inc.; Frey and Suppman BioChemica. 2:34-35, 1995; Chester and Marshak Analytical Biochemistry. 209:284-290, 1993, which are each hereby incorporated by reference in its entirety). In some embodiments, the polymerase is a Q5® DNA Polymerase, such as Q5® High-Fidelity DNA Polymerase (M0491S, New England BioLabs, Inc.) or Q5® Hot Start High-Fidelity DNA Polymerase (M0493S, New England BioLabs, Inc.). In some embodiments, the polymerase is a T4 DNA polymerase (M0203S, New England BioLabs, Inc.; Tabor and Struh. (1989). "DNA-Dependent DNA Polymerases," In Ausebel et al. (Ed.), *Current Protocols in Molecular Biology.* 3.5.10-3.5.12. New York: John Wiley & Sons, Inc., 1989; Sambrook et al. *Molecular Cloning: A Laboratory Manual.* (2nd ed.), 5.44-5.47. Cold Spring Harbor: Cold Spring Harbor Laboratory Press, 1989, which are each hereby incorporated by reference in its entirety).

In some embodiment, between 5 and 600 Units/mL (Units per 1 mL of reaction volume) of polymerase is used, such as between 5 to 100, 100 to 200, 200 to 300, 300 to 400, 400 to 500, or 500 to 600 Units/mL, inclusive. One unit is commonly defined as the amount of enzyme that will incorporate 15 nmol of dNTP into acid-insoluble material in 30 minutes at 75° C. Exemplary assay conditions for measuring unit activity include 1× THERMOPOL Reaction Buffer, 200 µM dNTPs including [$^3$H]-dTTP and 200 µg/ml activated Calf Thymus DNA (see, e.g., information available at the world wide web at neb.com/products/m0267-taq-dna-polymerase-with-thermopol-buffer, which is hereby incorporated by reference in its entirety). 1× THERMOPOL® Reaction Buffer contains 20 mM Tris-HCl, 10 mM $(NH_4)_2SO_4$, 10 mM KCl, 2 mM $MgSO_4$, and 0.1% TRITON® X-100, pH 8.8.

In some embodiments, hot-start PCR is used to reduce or prevent polymerization prior to PCR thermocycling. Exemplary hot-start PCR methods include initial inhibition of the DNA polymerase, or physical separation of reaction components reaction until the reaction mixture reaches the higher temperatures. In some embodiments, the enzyme is spatially separated from the reaction mixture by wax that melts when the reaction reaches high temperature. In some embodiments, slow release of magnesium is used. DNA polymerase requires magnesium ions for activity, so the magnesium is chemically separated from the reaction by binding to a chemical compound, and is released into the solution only at high temperature. In some embodiments, non-covalent binding of an inhibitor is used. In this method a peptide, antibody, or aptamer are non-covalently bound to the enzyme at low temperature and inhibit its activity. After incubation at elevated temperature, the inhibitor is released and the reaction starts. In some embodiments, a cold-sensitive Taq polymerase is used, such as a modified DNA polymerase with almost no activity at low temperature. In some embodiments, chemical modification is used. In this method, a molecule is covalently bound to the side chain of an amino acid in the active site of the DNA polymerase. The molecule is released from the enzyme by incubation of the reaction mixture at elevated temperature. Once the molecule is released, the enzyme is activated.

In some embodiments, the amount to template nucleic acids (such as an RNA or DNA sample) is between 20 and 5,000 ng, such as between 20 to 200, 200 to 400, 400 to 600, 600 to 1,000; 1,000 to 1,500; or 2,000 to 3,000 ng, inclusive.

In some embodiments QIAGEN Multiplex PCR Kit is used (QIAGEN catalog No. 206143; see, e.g., information available at the world wide web at qiagen.com/products/catalog/as say-technologies/end-point-per-and-rt-per-reagents/qiagen-multiplex-per-kit, which is hereby incorporated by reference in its entirety). For 100×50 µl multiplex PCR reactions, the kit includes 2× QIAGEN Multiplex PCR Master Mix (providing a final concentration of 3 mM $MgCl_2$, 3×0.85 ml), 5×Q-Solution (1×2.0 ml), and RNase-Free Water (2×1.7 ml). The QIAGEN Multiplex PCR Master Mix (MM) contains a combination of KCl and $(NH_4)_2SO_4$ as well as the PCR additive, Factor MP, which increases the local concentration of primers at the template. Factor MP stabilizes specifically bound primers, allowing efficient primer extension by HotStarTaq DNA Polymerase. HotStarTaq DNA Polymerase is a modified form of Taq DNA polymerase and has no polymerase activity at ambient temperatures. In some embodiments, HotStarTaq DNA Polymerase is activated by a 15-minute incubation at 95° C. which can be incorporated into any existing thermal-cycler program.

In some embodiments, 1× QIAGEN MM final concentration (the recommended concentration), 7.5 nM of each primer in the library, 50 mM TMAC, and 7 ul DNA template in a 20 ul final volume is used. In some embodiments, the PCR thermocycling conditions include 95° C. for 10 minutes (hot start); 20 cycles of 96° C. for 30 seconds; 65° C. for 15 minutes; and 72° C. for 30 seconds; followed by 72° C. for 2 minutes (final extension); and then a 4° C. hold.

In some embodiments, 2× QIAGEN MM final concentration (twice the recommended concentration), 2 nM of each primer in the library, 70 mM TMAC, and 7 ul DNA template in a 20 ul total volume is used. In some embodiments, up to 4 mM EDTA is also included. In some embodiments, the PCR thermocycling conditions include 95° C. for 10 minutes (hot start); 25 cycles of 96° C. for 30 seconds; 65° C. for 20 minutes; and 72° C. for 30 seconds); followed by 72° C. for 2 minutes (final extension); and then a 4° C. hold.

Another exemplary set of PCR thermocyling conditions includes 95° C. for 10 minutes, 15 cycles of 95° C. for 30 seconds, 65° C. for 1 minute, 60° C. for 5 minutes, 65° C. for 5 minutes and 72° C. for 30 seconds; and then 72° C. for 2 minutes. In some embodiments, this set of PCR thermocyling conditions is used with the following reaction conditions: 100 mM KCl, 50 mM $(NH_4)_2SO_4$, 3 mM $MgCl_2$, 7.5 nM of each primer in the library, 50 mM TMAC, and 7 ul DNA template in a 20 ul final volume at pH 8.1.

Another exemplary set of conditions includes a semi-nested PCR approach. The first PCR reaction uses 20 ul a reaction volume with 2× QIAGEN MM final concentration, 1.875 nM of each primer in the library (outer forward and reverse primers), and DNA template. Thermocycling parameters include 95° C. for 10 minutes; 25 cycles of 96° C. for 30 seconds, 65° C. for 1 minute, 58° C. for 6 minutes, 60° C. for 8 minutes, 65° C. for 4 minutes, and 72° C. for 30 seconds; and then 72° C. for 2 minutes, and then a 4° C. hold. Next, 2 ul of the resulting product, diluted 1:200, is as input in a second PCR reaction. This reaction uses a 10 ul reaction volume with 1× QIAGEN MM final concentration, 20 nM of each inner forward primer, and 1 uM of reverse primer tag. Thermocycling parameters include 95° C. for 10 minutes; 15 cycles of 95° C. for 30 seconds, 65° C. for 1 minute, 60° C. for 5 minutes, 65° C. for 5 minutes, and 72° C. for 30 seconds; and then 72° C. for 2 minutes, and then a 4° C. hold.

Any of the methods disclosed herein or any standard methods can be used to test a primer library to determine, e.g., the percent of primer dimers, percent of target amplicons, and percent of target loci that are amplified. In some embodiments, the PCR products are sequenced as described in Experiment 15 or using standard sequencing methods. In some embodiments, the percentage of primer dimers can be determined by measuring the number of sequencing reads from primer dimers, the percentage of amplified products that are target amplicons can be determined by measuring the number of sequencing reads that map to target loci; the percent of target loci that are amplified can be determined by measuring the number of target loci for which there are sequencing reads that map to the target loci; the number of copies of a particular amplified target loci can be determined based on the number of sequencing reads that map to that target loci (such as by comparing the number of sequencing reads compared to the sequences reads from a standard of known concentration or amount).

Figure 49:
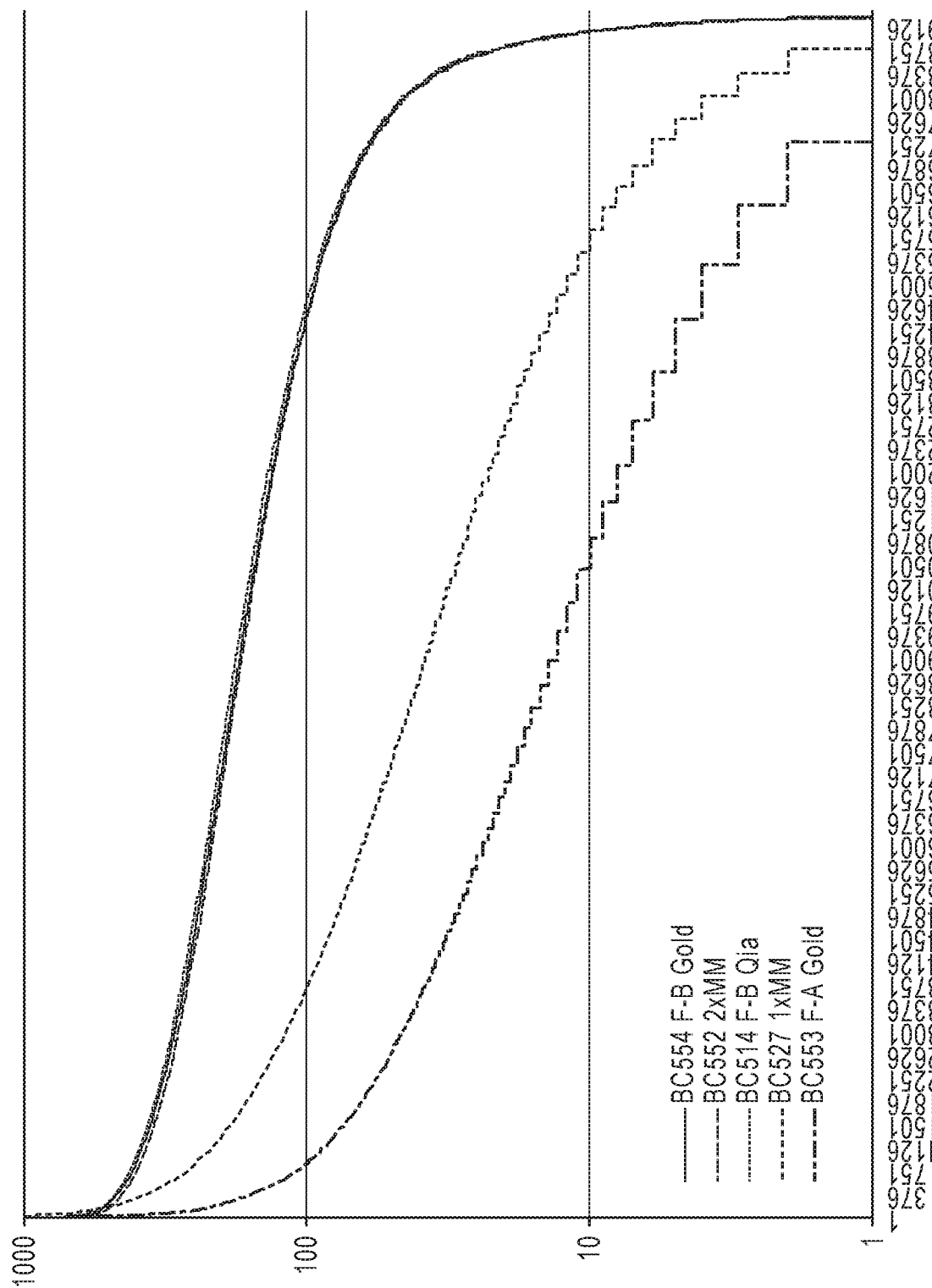
FIG. 49 is a graph illustrating the uniformity in DOR for multiplex PCR with buffers from FIG. 48.
Figure 50:
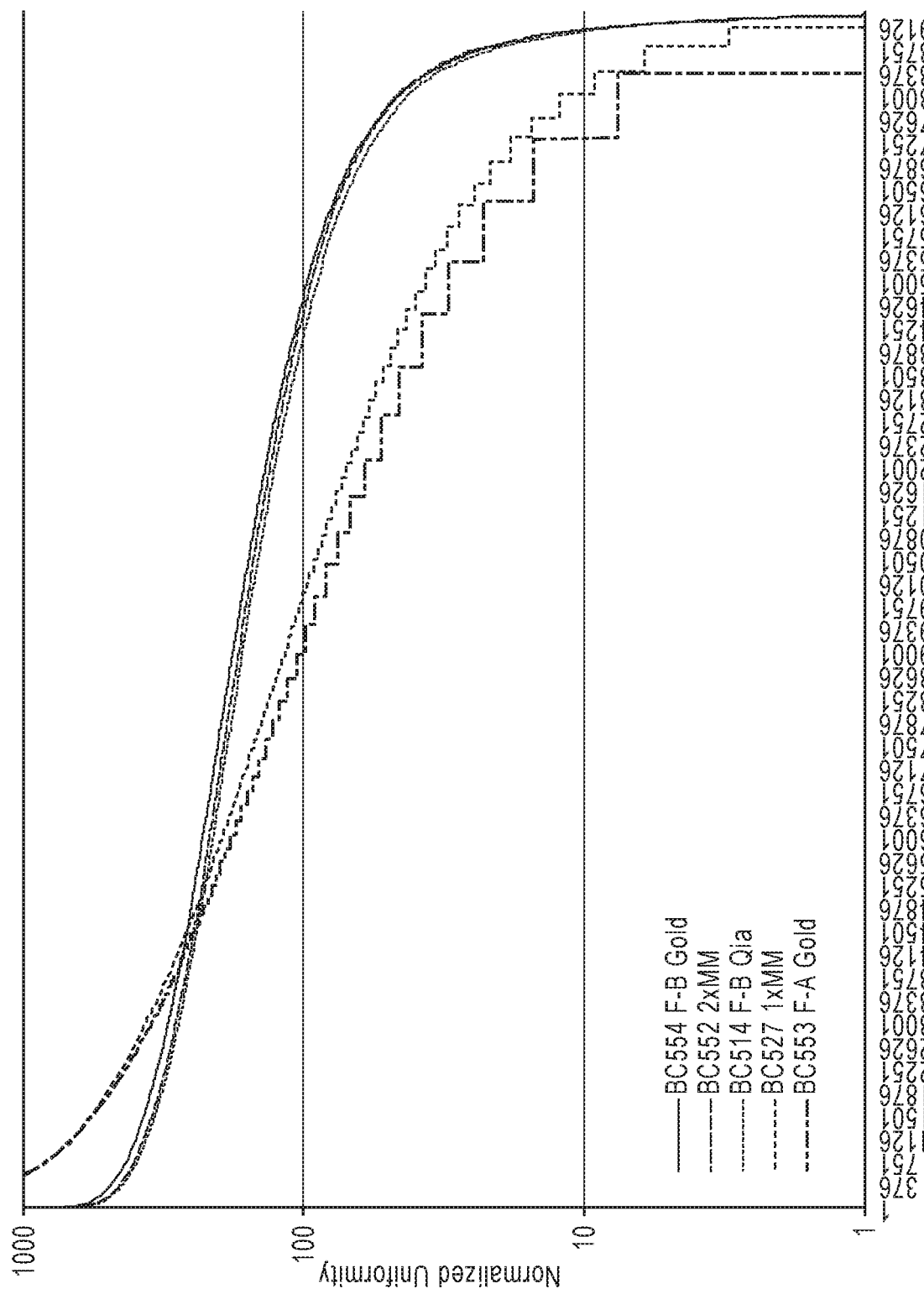
FIG. 50 is a graph illustrating the normalized depth of read (DOR) for multiplex PCR with buffers from FIG. 48 with the DOR normalized to that of buffer 2×MM.

FIG. 48 contains data (such as percent mapped reads and error rate) from multiplex PCR with various buffers. In this figure, "1×MM" denotes 1× QIAGEN Master Mix (the recommended concentration) discussed above, and "2×MM" denotes 2× QIAGEN Master Mix (twice the recommended concentration). FIG. 48 also lists the components of buffer F-A (also called F-A Gold), F-B (also called F-B Gold), F-D, and F-J (also called F-B Qiagen or F-B Qia) as well as the amount and type of polymerase used to generate the data. FIG. 49 is a graph illustrating the uniformity in DOR for multiplex PCR with buffers from FIG. 48. FIG. 50 is a graph illustrating the normalized depth of read (DOR) for multiplex PCR with buffers from FIG. 48 with the DOR normalized to that of buffer 2×MM.

Limit of Detection

In some embodiments, a limit of detection of a mutation (such as an SNV or CNV) of a method of the invention is less than or equal to 10, 5, 2, 1, 0.5, 0.1, 0.05, 0.01, or 0.005%. In some embodiments, a limit of detection of a mutation (such as an SNV or CNV) of a method of the invention is between 15 to 0.005%, such as between 10 to 0.005%, 10 to 0.01%, 10 to 0.1%, 5 to 0.005%, 5 to 0.01%, 5 to 0.1%, 1 to 0.005%, 1 to 0.01%, 1 to 0.1%, 0.5 to 0.005%, 0.5 to 0.01%, 0.5 to 0.1%, or 0.1 to 0.01%, inclusive.

In some embodiments, a limit of detection is such that a mutation (such as an SNV or CNV) that is present in less than or equal to 10, 5, 2, 1, 0.5, 0.1, 0.05, 0.01, or 0.005% of the DNA or RNA molecules with that locus in a sample (such as a sample that has undergone PCR amplification with any of the methods of the invention, such as a sample of PCR-amplified cfDNA or cfRNA) is detected (or is capable of being detected). For example, the mutation can be detected even if less than or equal to 10, 5, 2, 1, 0.5, 0.1, 0.05, 0.01, or 0.005% of the DNA or RNA molecules that have that locus have that mutation in the locus (instead of, for example, a wild-type or non-mutated version of the locus or a different mutation at that locus). In some embodiments, a limit of detection is such that a mutation (such as an SNV or CNV) that is present in less than or equal to 10, 5, 2, 1, 0.5, 0.1, 0.05, 0.01, or 0.005% of the DNA or RNA molecules in a sample (such as a sample that has undergone PCR amplification with any of the methods of the invention, such as a sample of PCR-amplified cfDNA or cfRNA) is detected (or is capable of being detected). In some embodiments in which the CNV is a deletion, the deletion can be detected even if it is only present in less than or equal to 10, 5, 2, 1, 0.5, 0.1, 0.05, 0.01, or 0.005% of the DNA or RNA molecules that have a region of interest that may or may not contain the deletion in a sample. In some embodiments in which the CNV is a deletion, the deletion can be detected even if it is only present in less than or equal to 10, 5, 2, 1, 0.5, 0.1, 0.05, 0.01, or 0.005% of the DNA or RNA molecules in a sample. In some embodiments in which the CNV is a duplication, the duplication can be detected even if the extra duplicated DNA or RNA that is present is less than or equal to 10, 5, 2, 1, 0.5, 0.1, 0.05, 0.01, or 0.005% of the DNA or RNA molecules that have a region of interest that may or may not be duplicated in a sample (such as a sample that has undergone PCR amplification, such as a sample of PCR-amplified cfDNA or cfRNA from, e.g., a blood sample). In some embodiments in which the CNV is a duplication, the duplication can be detected even if the extra duplicated DNA or RNA that is present is less than or equal to 10, 5, 2, 1, 0.5, 0.1, 0.05, 0.01, or 0.005% of the DNA or RNA molecules in a sample (such as a sample that has undergone PCR amplification, such as a sample of PCR-amplified cfDNA or cfRNA from, e.g., a blood sample) is detected (or is capable of being detected). In some embodiments, a mutation (such as an SNV or CNV) that is present in less than 1,000, 500, 100, 50, 20, 10, 5, 4, 3, or 2 DNA or RNA molecules after PCR amplification with any of the methods of the invention in a sample (such as a sample that has undergone PCR amplification, such as a sample of PCR-amplified cfDNA or cfRNA from, e.g., a blood sample) is detected (or is capable of being detected). In some embodiments, a mutation (such as an SNV or CNV) that is present in less than 1,000, 500, 100, 50, 20, 10, 5, 4, 3, or 2 original DNA or RNA molecules (before amplification) in a sample (such as a sample of cfDNA or cfRNA from, e.g., a blood sample) is detected (or is capable of being detected). In some embodiments, a mutation (such as an SNV or CNV) that is present in only 1 original DNA or RNA molecule (before amplification) in a sample (such as a sample of cfDNA or cfRNA from, e.g., a blood sample) is detected (or is capable of being detected). Experiment 23 provides exemplary methods for calculating the limit of detection. In some embodiments, the "LOD-zs5.0-mr5" method of Experiment 23 is used.

Exemplary Nucleic Acid Samples

In some embodiments, the genetic sample may be prepared and/or purified. There are a number of standard procedures known in the art to accomplish such an end. In some embodiments, the sample may be centrifuged to separate various layers. In some embodiments, the DNA may be isolated using filtration. In some embodiments, the preparation of the DNA may involve amplification, separation, purification by chromatography, liquid liquid separation, isolation, preferential enrichment, preferential amplification, targeted amplification, or any of a number of other techniques either known in the art or described herein.

In some embodiments, a method disclosed herein could be used in situations where there is a very small amount of DNA present, such as in in vitro fertilization, or in forensic situations, where one or a few cells are available (typically less than ten cells, less than twenty cells or less than 40 cells.) In these embodiments, a method disclosed herein serves to make ploidy calls from a small amount of DNA that is not contaminated by other DNA, but where the ploidy calling very difficult the small amount of DNA. In some embodiments, a method disclosed herein could be used in situations where the target DNA is contaminated with DNA of another individual, for example in maternal blood in the context of prenatal diagnosis, paternity testing, or products of conception testing. Some other situations where these methods would be particularly advantageous would be in the case of cancer testing where only one or a small number of cells were present among a larger amount of normal cells. The genetic measurements used as part of these methods could be made on any sample comprising DNA or RNA, for example but not limited to: blood, plasma, body fluids, urine, hair, tears, saliva, tissue, skin, fingernails, blastomeres, embryos, fetal cells, amniotic fluid, chorionic villus samples, feces, bile, lymph, cervical mucus, semen, or other cells or materials comprising nucleic acids. In an embodiment, a method disclosed herein could be run with nucleic acid detection methods such as sequencing, microarrays, qPCR, digital PCR, or other methods used to measure nucleic acids. If for some reason it were found to be desirable, the ratios of the allele count probabilities at a locus could be calculated, and the allele ratios could be used to determine ploidy state in combination with some of the methods described herein, provided the methods are compatible. In some embodiments, a method disclosed herein involves calculating, on a computer, allele ratios at the plurality of polymorphic loci from the DNA measurements made on the processed samples. In some embodiments, a method disclosed herein involves calculating, on a computer, allele ratios at the plurality of polymorphic loci from the DNA measurements made on the processed samples along with any combination of other improvements described in this disclosure. Exemplary methods for isolating fetal cells, such as a single fetal cell are disclosed in U.S. Ser. No. 61/978,648, filed Apr. 11, 2014 and U.S. Ser. No. 61/984,546, filed Apr. 25, 2014. Fetal cells or fetal nucleic acids can be isolated from a pregnant mother using invasive (such as CVS or amniocentesis) or noninvasive methods (such as from a maternal blood sample).

In some embodiments, this method may be used to genotype a single cell, a small number of cells, two to five cells, six to ten cells, ten to twenty cells, twenty to fifty cells, fifty to one hundred cells, one hundred to one thousand cells, or a small amount of extracellular DNA, for example from one to ten picograms, from ten to one hundred pictograms, from one hundred pictograms to one nanogram, from one to ten nanograms, from ten to one hundred nanograms, from 30 to 500 nanograms, or from one hundred nanograms to one microgram. In some embodiments, nucleic acids (such as DNA and/or RNA) from less than 100, 75, 50, 40, 30, 20, 10, 8, 6, 4, 2, or 1 cell is amplified with any of the methods of the invention. In some embodiments, the nucleic acid sample includes less than 80, 60, 40, 20, or 10% of the nucleic acids (such as DNA and/or RNA) from a single cell. In some embodiments, in which a small number of cells (such as one cell) or a small amount of nucleic acids is used, nested PCR such as hemi-nested or semi-nested PCR is used and/or the number of PCR cycles is increased compare to that used for samples with a larger amount of cells or nucleic acids. In some embodiments, a large amount of cells or nucleic acids are used (such as in cases in which a larger amount is desired to improve performance of any of the methods of the invention. In some embodiments, a sample with at least 2, 5, 10, 15, 20, 30, 50, 100, or more cells (or DNA or RNA from such cells) is used in any of the methods of the invention. In some embodiments, at least 0.5, 1, 10, 25, 50, 100, 500, 1,000; or 5,000 ng of DNA or RNA is used.

In some embodiments, the cells in the sample are lysed prior to PCR. In some embodiments, the Arcturus PicoPure DNA extraction kit from Applied Biosystems is used. (Applied Biosystems cat. No. KIT0103, see, e.g., information available at the world wide web at lifetechnologies.com/order/catalog/product/KIT0103?ICID=search-product, which is hereby incorporated by reference in its entirety). This kit contains Arcturus reconstitution buffer and Protease K. In some embodiments, the following cell lysis thermocycling protocol is used: 56° C. for 1 hour, 95° C. for 10 minutes, 25° C. for 15 minutes, and then a 4° C. hold.

In some embodiments, the nucleic acids are processed using the consecutive steps of end-repairing, dA-tailing, and adaptor ligating the nucleic acids. The consecutive steps exclude purifying the end-repaired products prior to the dA-tailing step and exclude purifying the dA-tailing products prior to the adaptor ligating step. The resulting products are amplified in any of the multiplex PCR methods of the invention. In some embodiments, the amplified products are then sequenced.

Exemplary Nucleic Acid Studies

The multiplex PCR methods of the invention can be used to increase the number of target loci that can be evaluated to measure the amount of one or more specific nucleic acid molecules of interest or of one or more types of nucleic acids. In some embodiments, there is a change in the total amount or concentration of one or more types of DNA (such as cfDNA cf mDNA, cf nDNA, cellular DNA, or mitochondrial DNA) or RNA (cfRNA, cellular RNA, cytoplasmic RNA, coding cytoplasmic RNA, non-coding cytoplasmic RNA, mRNA, miRNA, mitochondrial RNA, rRNA, or tRNA). In some embodiments, there is a change in the amount or concentration of one or more specific DNA (such as cfDNA cf mDNA, cf nDNA, cellular DNA, or mitochondrial DNA) or RNA (cfRNA, cellular RNA, cytoplasmic RNA, coding cytoplasmic RNA, non-coding cytoplasmic RNA, mRNA, miRNA, mitochondrial RNA, rRNA, or tRNA) molecules. In some embodiments, one allele is expressed more than another allele of a locus of interest. Exemplary miRNAs are short 20-22 nucleotide RNA molecules that regulate the expression of a gene. In some embodiments, there is a change in the transcriptome, such as a change in the identity or amount of one or more RNA molecules.

In some embodiments, an increase in the total amount or concentration of cfDNA or cfRNA is associated with a disease such as cancer, or an increased risk for a disease such as cancer. In some embodiments, the total concentration of a type of DNA (such as cfDNA cf mDNA, cf nDNA, cellular DNA, or mitochondrial DNA) or RNA (cfRNA, cellular RNA, cytoplasmic RNA, coding cytoplasmic RNA, non-coding cytoplasmic RNA, mRNA, miRNA, mitochondrial RNA, rRNA, or tRNA) increases by at least 2, 3, 4, 5, 6, 7, 8, 9, 10-fold, or more compared to the total concentration of that type of DNA or RNA in healthy (such as non-cancerous) subjects. In some embodiments, a total concentration of cfDNA between 75 to 100 ng/mL, 100 to 150 ng/mL, 150 to 200 ng/mL, 200 to 300 ng/mL, 300 to 400 ng/mgL, 400 to 600 ng/mL, 600 to 800 ng/mL, 800 to 1,000 ng/mL, inclusive, or a total concentration of cfDNA of more than 100 ng, mL, such as more than 200, 300, 400, 500, 600, 700, 800, 900, or 1,000 ng/mL is indicative of cancer, an increased risk for cancer, an increased risk of a tumor being malignant rather than benign, a decreased probably of the cancer going into remission, or a worse prognosis for the cancer. In some embodiments, the amount of a type of DNA (such as cfDNA cf mDNA, cf nDNA, cellular DNA, or mitochondrial DNA) or RNA (cfRNA, cellular RNA, cytoplasmic RNA, coding cytoplasmic RNA, non-coding cytoplasmic RNA, mRNA, miRNA, mitochondrial RNA, rRNA, or tRNA) having one or more polymorphisms/mutations (such as deletions or duplications) associated with a disease such as cancer or an increased risk for a disease such as cancer is at least 2, 3, 4, 5, 6, 7, 8, 9, 10, 11, 12, 14, 16, 18, 20, or 25% of the total amount of that type of DNA or RNA. In some embodiments, at least 2, 3, 4, 5, 6, 7, 8, 9, 10, 11, 12, 14, 16, 18, 20, or 25% of the total amount of a type of DNA (such as cfDNA cf mDNA, cf nDNA, cellular DNA, or mitochondrial DNA) or RNA (cfRNA, cellular RNA, cytoplasmic RNA, coding cytoplasmic RNA, non-coding cytoplasmic RNA, mRNA, miRNA, mitochondrial RNA, rRNA, or tRNA) has a particular polymorphism or mutation (such as a deletion or duplication) associated with a disease such as cancer or an increased risk for a disease such as cancer.

Exemplary RNA Expression Studies

The multiplex PCR methods of the invention can be used to increase the number of target loci that can be evaluated during gene expression profiling experiments. For example, the expression levels of thousands of genes can be simultaneously monitored to determine whether a person has a sequence (such as a polymorphism or other mutation) associated with a disease (such as cancer) or an increased risk of a disease. These methods can be used to identify sequences (such as polymorphisms or other mutations) associated with an increased or decreased risk for a disease such as cancer by comparing gene expression (such as the expression of particular mRNA alleles) in samples from patients with and without the disease. Additionally, the effect of particular treatments, diseases, or developmental stages on gene expression can be determined. Similarly, these methods can be used to identify genes whose expression is changed in response to pathogens or other organisms by comparing gene expression in infected and uninfected cells or tissues. In these methods the number of sequencing reads can be adjusted based on the frequency of the polymorphisms that are being analyzed such that sufficient reads are performed for the polymorphisms to be detected if they are present. In some embodiments, the polymorphisms or mutation is present at a higher frequency in subjects with a disease or disorder (such as cancer) than subjects without the disease or disorder (such as cancer). In some embodiments, the polymorphisms or mutation is indicative of cancer, such as a causative mutation.

In some embodiments, a sample containing RNA (such as mRNA) is amplified using a reverse transcriptase (RT) and the resulting DNA (such as cDNA) is then amplified using a DNA polymerase (PCR). The RT and PCR steps may be carried out sequentially in the same reaction volume or separately. Any of the primer libraries of the invention can be used in this reverse transcription polymerase chain reaction (RT-PCR) method. In various embodiments, the reverse transcription is performed using oligo-dT, random primers, a mixture of oligo-dT and random primers, or primers specific to the target loci. To avoid amplification of contaminating genomic DNA, primers for RT-PCR can be designed so that part of one primer hybridizes to the 3' end of one exon and the other part of the primer hybridizes to the 5' end of the adjacent exon. Such primers anneal to cDNA synthesized from spliced mRNAs, but not to genomic DNA. To detect amplification of contaminating DNA, RT-PCR primer pairs may be designed to flank a region that contains at least one intron. Products amplified from cDNA (no introns) are smaller than those amplified from genomic DNA (containing introns). Size difference in products is used to detect the presence of contaminating DNA. In some embodiments when only the mRNA sequence is known, primer annealing sites are chosen that are at least 300-400 base pairs apart since it is likely that fragments of this size from eukaryotic DNA contain splice junctions. Alternatively, the sample can be treated with DNase to degrade contaminating DNA.

Exemplary Methods for Paternity Testing

The multiplex PCR methods of the invention can be used to improve the accuracy of paternity testing since so many target loci can be analyzed at once (see, e.g., U.S. Publication No. 2012/0122701, filed Dec. 22, 2011, is which is hereby incorporated by reference in its entirety). For example, the multiplex PCR method can allow thousands of polymorphic loci (such as SNPs) to be analyzed for use in the PARENTAL SUPPORT algorithm described herein to determine whether an alleged father in is the biological father of a fetus. In some embodiments the method involves (i) simultaneously amplifying a plurality of polymorphic loci that includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci on genetic material from the alleged father to produce a first set of amplified products; (ii) simultaneously amplifying the corresponding plurality of polymorphic loci on a mixed sample of DNA originating from a blood sample from the pregnant mother to produce a second set of amplified products; wherein the mixed sample of DNA comprises fetal DNA and maternal DNA; (iii) determining on a computer the probability that the alleged father is the biological father of the fetus using genotypic measurements based on the first and second sets of amplified products; and (iv) establishing whether the alleged father is the biological father of the fetus using the determined probability that the alleged father is the biological father of the fetus. In various embodiments, the method further includes simultaneously amplifying the corresponding plurality of polymorphic loci on genetic material from the mother to produce a third set of amplified products; wherein the probability that the alleged father is the biological father of the fetus is determined using genotypic measurements based on the first, second, and third sets of amplified products.

Exemplary Methods for Embryo Characterization and Selection

The multiplex PCR methods of the invention can be used to improve the selection of embryos for in vitro fertilization by allowing thousands of target loci to be analyzed at once (see, e.g., U.S. Pub. No. 2011/0092763, filed May 27, 2008, filed Dec. 22, 2011, is which is hereby incorporated by reference in its entirety). For example, the multiplex PCR method can allow thousands of polymorphic loci (such as SNPs) to be analyzed for use in the PARENTAL SUPPORT algorithm described herein to select an embryo out of a set of embryos for in vitro fertilization In some embodiments, the invention provides methods of estimating relative likelihoods that each embryo from a set of embryos will develop as desired. In some embodiments, the method involves contacting a sample from each embryo with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci to produce a reaction mixture for each embryo, wherein the samples are each derived from one or more cells from an embryo. In some embodiments, each reaction mixture is subjected to primer extension reaction conditions to produce amplified products. In some embodiments, the method includes determining on a computer one or more characteristics of at least one cell from each embryo based on the amplified products; and estimating on a computer the relative likelihoods that each embryo will develop as desired, based on the one or more characteristics of the at least one cell for each embryo. In some embodiments, the method includes using an informatics based method to determine the at least one characteristic, such as the PARENTAL SUPPORT algorithm described herein. In some embodiments, the characteristic includes a ploidy state. In some embodiments, the characteristic is selected from the group consisting of aneuploid, euploid, mosaic, nullsomy, monosomy, uniparental disomy, trisomy, tetrasomy, a type of aneuploidy, unmatched copy error trisomy, matched copy error trisomy, maternal origin of aneuploidy, paternal origin of aneuploidy, a presence or absence of a disease-linked gene, a chromosomal identity of any aneuploid chromosome, an abnormal genetic condition, a deletion or duplication, a likelihood of a characteristic, and combinations thereof. The characteristic may be associated with a chromosome taken from the group consisting of chromosome one, chromosome two, chromosome three, chromosome four, chromosome five, chromosome six, chromosome seven, chromosome eight, chromosome nine, chromosome ten, chromosome eleven, chromosome twelve, chromosome thirteen, chromosome fourteen, chromosome fifteen, chromosome sixteen, chromosome seventeen, chromosome eighteen, chromosome nineteen, chromosome twenty, chromosome twenty-one, chromosome twenty-two, X chromosome or Y chromosome, and combinations thereof.

Exemplary Prenatal Diagnostic Methods

The multiplex PCR methods of the present invention can be used to improve prenatal diagnostic methods, such as the determination of the ploidy status of fetal chromosomes. Given that the large number of target loci that can be simultaneously amplified, more accurate determinations can be made.

In an embodiment, the present disclosure provides ex vivo methods for determining the ploidy status of a chromosome in a gestating fetus from genotypic data measured from a mixed sample of DNA (i.e., DNA from the mother of the fetus, and DNA from the fetus) and optionally from genotypic data measured from a sample of genetic material from the mother and possibly also from the father, wherein the determining is done by using a joint distribution model to create a set of expected allele distributions for different possible fetal ploidy states given the parental genotypic data, and comparing the expected allelic distributions to the actual allelic distributions measured in the mixed sample, and choosing the ploidy state whose expected allelic distribution pattern most closely matches the observed allelic distribution pattern. In an embodiment, the mixed sample is derived from maternal blood, or maternal serum or plasma. In an embodiment, the mixed sample of DNA may be preferentially enriched at a target loci (e.g., plurality of polymorphic loci). In an embodiment, the preferential enrichment is done in a way that minimizes the allelic bias. In an embodiment, the present disclosure relates to a composition of DNA that has been preferentially enriched at a plurality of loci such that the allelic bias is low. In an embodiment, the allelic distribution(s) are measured by sequencing the DNA from the mixed sample. In an embodiment, the joint distribution model assumes that the alleles will be distributed in a binomial fashion. In an embodiment, the set of expected joint allele distributions are created for genetically linked loci while considering the extant recombination frequencies from various sources, for example, using data from the International HapMap Consortium.

In an embodiment, the present disclosure provides methods for non-invasive prenatal diagnosis (NPD), specifically, determining the aneuploidy status of a fetus by observing allele measurements at a plurality of polymorphic loci in genotypic data measured on DNA mixtures, where certain allele measurements are indicative of an aneuploid fetus, while other allele measurements are indicative of a euploid fetus. In an embodiment, the genotypic data is measured by sequencing DNA mixtures that were derived from maternal plasma. In an embodiment, the DNA sample may be preferentially enriched in molecules of DNA that correspond to the plurality of loci whose allele distributions are being calculated. In an embodiment a sample of DNA comprising only or almost only genetic material from the mother and possibly also a sample of DNA comprising only or almost only genetic material from the father are measured. In an embodiment, the genetic measurements of one or both parents along with the estimated fetal fraction are used to create a plurality of expected allele distributions corresponding to different possible underlying genetic states of the fetus; the expected allele distributions may be termed hypotheses. In an embodiment, the maternal genetic data is not determined by measuring genetic material that is exclusively or almost exclusively maternal in nature, rather, it is estimated from the genetic measurements made on maternal plasma that comprises a mixture of maternal and fetal DNA. In some embodiments the hypotheses may comprise the ploidy of the fetus at one or more chromosomes, which segments of which chromosomes in the fetus were inherited from which parents, and combinations thereof. In some embodiments, the ploidy state of the fetus is determined by comparing the observed allele measurements to the different hypotheses where at least some of the hypotheses correspond to different ploidy states, and selecting the ploidy state that corresponds to the hypothesis that is most likely to be true given the observed allele measurements. In an embodiment, this method involves using allele measurement data from some or all measured SNPs, regardless of whether the loci are homozygous or heterozygous, and therefore does not involve using alleles at loci that are only heterozygous. This method may not be appropriate for situations where the genetic data pertains to only one polymorphic locus. This method is particularly advantageous when the genetic data comprises data for more than ten polymorphic loci for a target chromosome or more than twenty polymorphic loci. This method is especially advantageous when the genetic data comprises data for more than 50 polymorphic loci for a target chromosome, more than 100 polymorphic loci or more than 200 polymorphic loci for a target chromosome. In some embodiments, the genetic data may comprise data for more than 500 polymorphic loci for a target chromosome, more than 1,000 polymorphic loci, more than 2,000 polymorphic loci, or more than 5,000 polymorphic loci for a target chromosome.

In an embodiment, a method disclosed herein yields a quantitative measure of the number of independent observations of each allele at a polymorphic locus. This is unlike most methods such as microarrays or qualitative PCR which provide information about the ratio of two alleles but do not quantify the number of independent observations of either allele. With methods that provide quantitative information regarding the number of independent observations, only the ratio is utilized in ploidy calculations, while the quantitative information by itself is not useful. To illustrate the importance of retaining information about the number of independent observations consider the sample locus with two alleles, A and B. In a first experiment twenty A alleles and twenty B alleles are observed, in a second experiment 200 A alleles and 200 B alleles are observed. In both experiments the ratio (A/(A+B)) is equal to 0.5, however the second experiment conveys more information than the first about the certainty of the frequency of the A or B allele. Some methods by others involve averaging or summing allele ratios (channel ratios) (i.e. $x_i/y_i$) from individual allele and analyzes this ratio, either comparing it to a reference chromosome or using a rule pertaining to how this ratio is expected to behave in particular situations. No allele weighting is implied in such methods, where it is assumed that one can ensure about the same amount of PCR product for each allele and that all the alleles should behave the same way. Such a method has a number of disadvantages, and more importantly, precludes the use a number of improvements that are described elsewhere in this disclosure.

In an embodiment, a method disclosed herein explicitly models the allele frequency distributions expected in disomy as well as a plurality of allele frequency distributions that may be expected in cases of trisomy resulting from nondisjunction during meiosis I, nondisjunction during meiosis II, and/or nondisjunction during mitosis early in fetal development. To illustrate why this is important, imagine a case where there were no crossovers: nondisjunction during meiosis I would result a trisomy in which two different homologs were inherited from one parent; in contrast, nondisjunction during meiosis II or during mitosis early in fetal development would result in two copies of the same homolog from one parent. Each scenario would result in different expected allele frequencies at each polymorphic locus and also at all loci considered jointly, due to genetic linkage. Crossovers, which result in the exchange of genetic material between homologs, make the inheritance pattern more complex; in an embodiment, the instant method accommodates for this by using recombination rate information in addition to the physical distance between loci. In an embodiment, to enable improved distinction between meiosis I nondisjunction and meiosis II or mitotic nondisjunction the instant method incorporate into the model an increasing probability of crossover as the distance from the centromere increases. Meiosis II and mitotic nondisjunction can be distinguished by the fact that mitotic nondisjunction typically results in identical or nearly identical copies of one homolog while the two homologs present following a meiosis II nondisjunction event often differ due to one or more crossovers during gametogenesis.

In some embodiments, a method disclosed herein involves comparing the observed allele measurements to theoretical hypotheses corresponding to possible fetal genetic aneuploidy, and does not involve a step of quantitating a ratio of alleles at a heterozygous locus. Where the number of loci is lower than about 20, the ploidy determination made using a method comprising quantitating a ratio of alleles at a heterozygous locus and a ploidy determination made using a method comprising comparing the observed allele measurements to theoretical allele distribution hypotheses corresponding to possible fetal genetic states may give a similar result. However, where the number of loci is above 50 these two methods is likely to give significantly different results; where the number of loci is above 400, above, 1,000 or above 2,000 these two methods are very likely to give results that are increasingly significantly different. These differences are due to the fact that a method that comprises quantitating a ratio of alleles at a heterozygous locus without measuring the magnitude of each allele independently and aggregating or averaging the ratios precludes the use of techniques including using a joint distribution model, performing a linkage analysis, using a binomial distribution model, and/or other advanced statistical techniques, whereas using a method comprising comparing the observed allele measurements to theoretical allele distribution hypotheses corresponding to possible fetal genetic states may use these techniques which can substantially increase the accuracy of the determination.

In an embodiment, a method disclosed herein involves determining whether the distribution of observed allele measurements is indicative of a euploid or an aneuploid fetus using a joint distribution model. The use of a joint distribution model is a different from and a significant improvement over methods that determine heterozygosity rates by treating polymorphic loci independently in that the resultant determinations are of significantly higher accuracy. Without being bound by any particular theory, it is believed that one reason they are of higher accuracy is that the joint distribution model takes into account the linkage between SNPs, and likelihood of crossovers having occurred during the meiosis that gave rise to the gametes that formed the embryo that grew into the fetus. The purpose of using the concept of linkage when creating the expected distribution of allele measurements for one or more hypotheses is that it allows the creation of expected allele measurements distributions that correspond to reality considerably better than when linkage is not used. For example, imagine that there are two SNPs, 1 and 2 located nearby one another, and the mother is A at SNP 1 and A at SNP 2 on one homolog, and B at SNP 1 and B at SNP 2 on homolog two. If the father is A for both SNPs on both homologs, and a B is measured for the fetus SNP 1, this indicates that homolog two has been inherited by the fetus, and therefore that there is a much higher likelihood of a B being present on the fetus at SNP 2. A model that takes into account linkage would predict this, while a model that does not take linkage into account would not. Alternately, if a mother was AB at SNP 1 and AB at nearby SNP 2, then two hypotheses corresponding to maternal trisomy at that location could be used—one involving a matching copy error (nondisjunction in meiosis II or mitosis in early fetal development), and one involving an unmatching copy error (nondisjunction in meiosis I). In the case of a matching copy error trisomy, if the fetus inherited an AA from the mother at SNP 1, then the fetus is much more likely to inherit either an AA or BB from the mother at SNP 2, but not AB. In the case of an unmatching copy error, the fetus would inherit an AB from the mother at both SNPs. The allele distribution hypotheses made by a ploidy calling method that takes into account linkage would make these predictions, and therefore correspond to the actual allele measurements to a considerably greater extent than a ploidy calling method that did not take into account linkage. Note that a linkage approach is not possible when using a method that relies on calculating allele ratios and aggregating those allele ratios.

One reason that it is believed that ploidy determinations that use a method that comprises comparing the observed allele measurements to theoretical hypotheses corresponding to possible fetal genetic states are of higher accuracy is that when sequencing is used to measure the alleles, this method can glean more information from data from alleles where the total number of reads is low than other methods; for example, a method that relies on calculating and aggregating allele ratios would produce disproportionately weighted stochastic noise. For example, imagine a case that involved measuring the alleles using sequencing, and where there was a set of loci where only five sequence reads were detected for each locus. In an embodiment, for each of the alleles, the data may be compared to the hypothesized allele distribution, and weighted according to the number of sequence reads; therefore the data from these measurements would be appropriately weighted and incorporated into the overall determination. This is in contrast to a method that involved quantitating a ratio of alleles at a heterozygous locus, as this method could only calculate ratios of 0%, 20%, 40%, 60%, 80% or 100% as the possible allele ratios; none of these may be close to expected allele ratios. In this latter case, the calculated allele rations would either have to be discarded due to insufficient reads or else would have disproportionate weighting and introduce stochastic noise into the determination, thereby decreasing the accuracy of the determination. In an embodiment, the individual allele measurements may be treated as independent measurements, where the relationship between measurements made on alleles at the same locus is no different from the relationship between measurements made on alleles at different loci.

In an embodiment, a method disclosed herein involves determining whether the distribution of observed allele measurements is indicative of a euploid or an aneuploid fetus without comparing any metrics to observed allele measurements on a reference chromosome that is expected to be disomic (termed the RC method). This is a significant improvement over methods, such as methods using shotgun sequencing which detect aneuploidy by evaluating the proportion of randomly sequenced fragments from a suspect chromosomes relative to one or more presumed disomic reference chromosome. This RC method yields incorrect results if the presumed disomic reference chromosome is not actually disomic. This can occur in cases where aneuploidy is more substantial than trisomy of a single chromosome or where the fetus is triploid and all autosomes are trisomic. In the case of a female triploid (69, XXX) fetus there are in fact no disomic chromosomes at all. The method described herein does not require a reference chromosome and would be able to correctly identify trisomic chromosomes in a female triploid fetus. For each chromosome, hypothesis, child fraction and noise level, a joint distribution model may be fit, without any of: reference chromosome data, an overall child fraction estimate, or a fixed reference hypothesis.

In an embodiment, a method disclosed herein demonstrates how observing allele distributions at polymorphic loci can be used to determine the ploidy state of a fetus with greater accuracy than methods in the prior art. In an embodiment, the method uses the targeted sequencing to obtain mixed maternal-fetal genotypes and optionally mother and/or father genotypes at a plurality of SNPs to first establish the various expected allele frequency distributions under the different hypotheses, and then observing the quantitative allele information obtained on the maternal-fetal mixture and evaluating which hypothesis fits the data best, where the genetic state corresponding to the hypothesis with the best fit to the data is called as the correct genetic state. In an embodiment, a method disclosed herein also uses the degree of fit to generate a confidence that the called genetic state is the correct genetic state. In an embodiment, a method disclosed herein involves using algorithms that analyze the distribution of alleles found for loci that have different parental contexts, and comparing the observed allele distributions to the expected allele distributions for different ploidy states for the different parental contexts (different parental genotypic patterns). This is different from and an improvement over methods that do not use methods that enable the estimation of the number of independent instances of each allele at each locus in a mixed maternal-fetal sample. In an embodiment, a method disclosed herein involves determining whether the distribution of observed allele measurements is indicative of a euploid or an aneuploid fetus using observed allelic distributions measured at loci where the mother is heterozygous. This is different from and an improvement over methods that do not use observed allelic distributions at loci where the mother is heterozygous because, in cases where the DNA is not preferentially enriched or is preferentially enriched for loci that are not known to be highly informative for that particular target individual, it allows the use of about twice as much genetic measurement data from a set of sequence data in the ploidy determination, resulting in a more accurate determination.

In an embodiment, a method disclosed herein uses a joint distribution model that assumes that the allele frequencies at each locus are multinomial (and thus binomial when SNPs are biallelic) in nature. In some embodiments the joint distribution model uses beta-binomial distributions. When using a measuring technique, such as sequencing, provides a quantitative measure for each allele present at each locus, binomial model can be applied to each locus and the degree underlying allele frequencies and the confidence in that frequency can be ascertained. With methods known in the art that generate ploidy calls from allele ratios, or methods in which quantitative allele information is discarded, the certainty in the observed ratio cannot be ascertained. The instant method is different from and an improvement over methods that calculate allele ratios and aggregate those ratios to make a ploidy call, since any method that involves calculating an allele ratio at a particular locus, and then aggregating those ratios, necessarily assumes that the measured intensities or counts that are indicative of the amount of DNA from any given allele or locus will be distributed in a Gaussian fashion. The method disclosed herein does not involve calculating allele ratios. In some embodiments, a method disclosed herein may involve incorporating the number of observations of each allele at a plurality of loci into a model. In some embodiments, a method disclosed herein may involve calculating the expected distributions themselves, allowing the use of a joint binomial distribution model which may be more accurate than any model that assumes a Gaussian distribution of allele measurements. The likelihood that the binomial distribution model is significantly more accurate than the Gaussian distribution increases as the number of loci increases. For example, when fewer than 20 loci are interrogated, the likelihood that the binomial distribution model is significantly better is low. However, when more than 100, or especially more than 400, or especially more than 1,000, or especially more than 2,000 loci are used, the binomial distribution model will have a very high likelihood of being significantly more accurate than the Gaussian distribution model, thereby resulting in a more accurate ploidy determination. The likelihood that the binomial distribution model is significantly more accurate than the Gaussian distribution also increases as the number of observations at each locus increases. For example, when fewer than 10 distinct sequences are observed at each locus are observed, the likelihood that the binomial distribution model is significantly better is low. However, when more than 50 sequence reads, or especially more than 100 sequence reads, or especially more than 200 sequence reads, or especially more than 300 sequence reads are used for each locus, the binomial distribution model will have a very high likelihood of being significantly more accurate than the Gaussian distribution model, thereby resulting in a more accurate ploidy determination.

In an embodiment, a method disclosed herein uses sequencing to measure the number of instances of each allele at each locus in a DNA sample. Each sequencing read may be mapped to a specific locus and treated as a binary sequence read; alternately, the probability of the identity of the read and/or the mapping may be incorporated as part of the sequence read, resulting in a probabilistic sequence read, that is, the probable whole or fractional number of sequence reads that map to a given loci. Using the binary counts or probability of counts it is possible to use a binomial distribution for each set of measurements, allowing a confidence interval to be calculated around the number of counts. This ability to use the binomial distribution allows for more accurate ploidy estimations and more precise confidence intervals to be calculated. This is different from and an improvement over methods that use intensities to measure the amount of an allele present, for example methods that use microarrays, or methods that make measurements using fluorescence readers to measure the intensity of fluorescently tagged DNA in electrophoretic bands.

In an embodiment, a method disclosed herein uses aspects of the present set of data to determine parameters for the estimated allele frequency distribution for that set of data. This is an improvement over methods that utilize training set of data or prior sets of data to set parameters for the present expected allele frequency distributions, or possibly expected allele ratios. This is because there are different sets of conditions involved in the collection and measurement of every genetic sample, and thus a method that uses data from the instant set of data to determine the parameters for the joint distribution model that is to be used in the ploidy determination for that sample will tend to be more accurate.

In an embodiment, a method disclosed herein involves determining whether the distribution of observed allele measurements is indicative of a euploid or an aneuploid fetus using a maximum likelihood technique. The use of a maximum likelihood technique is different from and a significant improvement over methods that use single hypothesis rejection technique in that the resultant determinations will be made with significantly higher accuracy. One reason is that single hypothesis rejection techniques set cut off thresholds based on only one measurement distribution rather than two, meaning that the thresholds are usually not optimal. Another reason is that the maximum likelihood technique allows the optimization of the cut off threshold for each individual sample instead of determining a cut off threshold to be used for all samples regardless of the particular characteristics of each individual sample. Another reason is that the use of a maximum likelihood technique allows the calculation of a confidence for each ploidy call. The ability to make a confidence calculation for each call allows a practitioner to know which calls are accurate, and which are more likely to be wrong. In some embodiments, a wide variety of methods may be combined with a maximum likelihood estimation technique to enhance the accuracy of the ploidy calls. In an embodiment, the maximum likelihood technique may be used in combination with the method described in U.S. Pat. No. 7,888,017. In an embodiment, the maximum likelihood technique may be used in combination with the method of using targeted PCR amplification to amplify the DNA in the mixed sample followed by sequencing and analysis using a read counting method such as used by TANDEM DIAGNOSTICS, as presented at the International Congress of Human Genetics 2011, in Montreal in October 2011. In an embodiment, a method disclosed herein involves estimating the fetal fraction of DNA in the mixed sample and using that estimation to calculate both the ploidy call and the confidence of the ploidy call. Note that this is both different and distinct from methods that use estimated fetal fraction as a screen for sufficient fetal fraction, followed by a ploidy call made using a single hypothesis rejection technique that does not take into account the fetal fraction nor does it produce a confidence calculation for the call.

In an embodiment, a method disclosed herein takes into account the tendency for the data to be noisy and contain errors by attaching a probability to each measurement. The use of maximum likelihood techniques to choose the correct hypothesis from the set of hypotheses that were made using the measurement data with attached probabilistic estimates makes it more likely that the incorrect measurements will be discounted, and the correct measurements will be used in the calculations that lead to the ploidy call. To be more precise, this method systematically reduces the influence of data that is incorrectly measured on the ploidy determination. This is an improvement over methods where all data is assumed to be equally correct or methods where outlying data is arbitrarily excluded from calculations leading to a ploidy call. Existing methods using channel ratio measurements claim to extend the method to multiple SNPs by averaging individual SNP channel ratios. Not weighting individual SNPs by expected measurement variance based on the SNP quality and observed depth of read reduces the accuracy of the resulting statistic, resulting in a reduction of the accuracy of the ploidy call significantly, especially in borderline cases.

In an embodiment, a method disclosed herein does not presuppose the knowledge of which SNPs or other polymorphic loci are heterozygous on the fetus. This method allows a ploidy call to be made in cases where paternal genotypic information is not available. This is an improvement over methods where the knowledge of which SNPs are heterozygous must be known ahead of time in order to appropriately select loci to target, or to interpret the genetic measurements made on the mixed fetal/maternal DNA sample.

The methods described herein are particularly advantageous when used on samples where a small amount of DNA is available, or where the percent of fetal DNA is low. This is due to the correspondingly higher allele dropout rate that occurs when only a small amount of DNA is available and/or the correspondingly higher fetal allele dropout rate when the percent of fetal DNA is low in a mixed sample of fetal and maternal DNA. A high allele dropout rate, meaning that a large percentage of the alleles were not measured for the target individual, results in poorly accurate fetal fractions calculations, and poorly accurate ploidy determinations. Since methods disclosed herein may use a joint distribution model that takes into account the linkage in inheritance patterns between SNPs, significantly more accurate ploidy determinations may be made. The methods described herein allow for an accurate ploidy determination to be made when the percent of molecules of DNA that are fetal in the mixture is less than 40%, less than 30%, less than 20%, less than 10%, less than 8%, and even less than 6%.

In an embodiment, it is possible to determine the ploidy state of an individual based on measurements when that individual's DNA is mixed with DNA of a related individual. In an embodiment, the mixture of DNA is the free floating DNA found in maternal plasma, which may include DNA from the mother, with known karyotype and known genotype, and which may be mixed with DNA of the fetus, with unknown karyotype and unknown genotype. It is possible to use the known genotypic information from one or both parents to predict a plurality of potential genetic states of the DNA in the mixed sample for different ploidy states, different chromosome contributions from each parent to the fetus, and optionally, different fetal DNA fractions in the mixture. Each potential composition may be referred to as a hypothesis. The ploidy state of the fetus can then be determined by looking at the actual measurements, and determining which potential compositions are most likely given the observed data.

Further discussion of the points above may be found elsewhere in this document.

Non-Invasive Prenatal Diagnosis (NPD)

The process of non-invasive prenatal diagnosis involves a number of steps. Some of the steps may include: (1) obtaining the genetic material from the fetus; (2) enriching the genetic material of the fetus that may be in a mixed sample, ex vivo; (3) amplifying the genetic material, ex vivo; (4) preferentially enriching specific loci in the genetic material, ex vivo; (5) measuring the genetic material, ex vivo; and (6) analyzing the genotypic data, on a computer, and ex vivo. Methods to reduce to practice these six and other relevant steps are described herein. At least some of the method steps are not directly applied on the body. In an embodiment, the present disclosure relates to methods of treatment and diagnosis applied to tissue and other biological materials isolated and separated from the body. At least some of the method steps are executed on a computer.

Some embodiments of the present disclosure allow a clinician to determine the genetic state of a fetus that is gestating in a mother in a non-invasive manner such that the health of the baby is not put at risk by the collection of the genetic material of the fetus, and that the mother is not required to undergo an invasive procedure. Moreover, in certain aspects, the present disclosure allows the fetal genetic state to be determined with high accuracy, significantly greater accuracy than, for example, the non-invasive maternal serum analyte based screens, such as the triple test, that are in wide use in prenatal care.

The high accuracy of the methods disclosed herein is a result of an informatics approach to analysis of the genotype data, as described herein. Modern technological advances have resulted in the ability to measure large amounts of genetic information from a genetic sample using such methods as high throughput sequencing and genotyping arrays. The methods disclosed herein allow a clinician to take greater advantage of the large amounts of data available, and make a more accurate diagnosis of the fetal genetic state. The details of a number of embodiments are given below. Different embodiments may involve different combinations of the aforementioned steps. Various combinations of the different embodiments of the different steps may be used interchangeably.

In an embodiment, a blood sample is taken from a pregnant mother, and the free floating DNA in the plasma of the mother's blood, which contains a mixture of both DNA of maternal origin, and DNA of fetal origin, is isolated and used to determine the ploidy status of the fetus. In an embodiment, a method disclosed herein involves preferential enrichment of those DNA sequences in a mixture of DNA that correspond to polymorphic alleles in a way that the allele ratios and/or allele distributions remain mostly consistent upon enrichment. In an embodiment, a method disclosed herein involves the highly efficient targeted PCR based amplification such that a very high percentage of the resulting molecules correspond to targeted loci. In an embodiment, a method disclosed herein involves sequencing a mixture of DNA that contains both DNA of maternal origin, and DNA of fetal origin. In an embodiment, a method disclosed herein involves using measured allele distributions to determine the ploidy state of a fetus that is gestating in a mother. In an embodiment, a method disclosed herein involves reporting the determined ploidy state to a clinician. In an embodiment, a method disclosed herein involves taking a clinical action, for example, performing follow up invasive testing such as chorionic villus sampling or amniocentesis, preparing for the birth of a trisomic individual or an elective termination of a trisomic fetus.

This application makes reference to U.S. Utility application Ser. No. 11/603,406, filed Nov. 28, 2006 (US Publication No.: 20070184467); U.S. Utility application Ser. No. 12/076,348, filed Mar. 17, 2008 (US Publication No.: 20080243398); PCT Application Ser. No. PCT/US09/52730, filed Aug. 4, 2009 (PCT Publication No.: WO/2010/017214); PCT Application Ser. No. PCT/US10/050824, filed Sep. 30, 2010 (PCT Publication No.: WO/2011/041485), U.S. Utility application Ser. No. 13/110,685, filed May 18, 2011, and PCT Application Ser. No. PCT/12/58578, filed Oct. 3, 2012, which are each herein incorporated by reference in its entirety. Some of the vocabulary used in this filing may have its antecedents in these references. Some of the concepts described herein may be better understood in light of the concepts found in these references.

Screening Maternal Blood Comprising Free Floating Fetal DNA

The methods described herein may be used to help determine the genotype of a child, fetus, or other target individual where the genetic material of the target is found in the presence of a quantity of other genetic material. In some embodiments the genotype may refer to the ploidy state of one or a plurality of chromosomes, it may refer to one or a plurality of disease linked alleles, or some combination thereof. In this disclosure, the discussion focuses on determining the genetic state of a fetus where the fetal DNA is found in maternal blood, but this example is not meant to limit to possible contexts that this method may be applied to. In addition, the method may be applicable in cases where the amount of target DNA is in any proportion with the non-target DNA; for example, the target DNA could make up anywhere between 0.000001 and 99.999999% of the DNA present. In addition, the non-target DNA does not necessarily need to be from one individual, or even from a related individual, as long as genetic data from some or all of the relevant non-target individual(s) is known. In an embodiment, a method disclosed herein can be used to determine genotypic data of a fetus from maternal blood that contains fetal DNA. It may also be used in a case where there are multiple fetuses in the uterus of a pregnant woman, or where other contaminating DNA may be present in the sample, for example from other already born siblings.

This technique may make use of the phenomenon of fetal blood cells gaining access to maternal circulation through the placental villi. Ordinarily, only a very small number of fetal cells enter the maternal circulation in this fashion (not enough to produce a positive Kleihauer-Betke test for fetal-maternal hemorrhage). The fetal cells can be sorted out and analyzed by a variety of techniques to look for particular DNA sequences, but without the risks that invasive procedures inherently have. This technique may also make use of the phenomenon of free floating fetal DNA gaining access to maternal circulation by DNA release following apoptosis of placental tissue where the placental tissue in question contains DNA of the same genotype as the fetus. The free floating DNA found in maternal plasma has been shown to contain fetal DNA in proportions as high as 30-40% fetal DNA.

In an embodiment, blood may be drawn from a pregnant woman. Research has shown that maternal blood may contain a small amount of free floating DNA from the fetus, in addition to free floating DNA of maternal origin. In addition, there also may be enucleated fetal blood cells comprising DNA of fetal origin, in addition to many blood cells of maternal origin, which typically do not contain nuclear DNA. There are many methods know in the art to isolate fetal DNA, or create fractions enriched in fetal DNA. For example, chromatography has been show to create certain fractions that are enriched in fetal DNA.

Once the sample of maternal blood, plasma, or other fluid, drawn in a relatively non-invasive manner, and that contains an amount of fetal DNA, either cellular or free floating, either enriched in its proportion to the maternal DNA, or in its original ratio, is in hand, one may genotype the DNA found in said sample. In some embodiments, the blood may be drawn using a needle to withdraw blood from a vein, for example, the basilica vein. The method described herein can be used to determine genotypic data of the fetus. For example, it can be used to determine the ploidy state at one or more chromosomes, it can be used to determine the identity of one or a set of SNPs, including insertions, deletions, and translocations. It can be used to determine one or more haplotypes, including the parent of origin of one or more genotypic features.

Note that this method will work with any nucleic acids that can be used for any genotyping and/or sequencing methods, such as the ILLUMINA INFINIUM ARRAY platform, AFFYMETRIX GENECHIP, ILLUMINA GENOME ANALYZER, or LIFE TECHNOLGIES' SOLID SYSTEM. This includes extracted free-floating DNA from plasma or amplifications (e.g. whole genome amplification, PCR) of the same; genomic DNA from other cell types (e.g. human lymphocytes from whole blood) or amplifications of the same. For preparation of the DNA, any extraction or purification method that generates genomic DNA suitable for the one of these platforms will work as well. This method could work equally well with samples of RNA. In an embodiment, storage of the samples may be done in a way that will minimize degradation (e.g. below freezing, at about −20 C, or at a lower temperature).

Parental Support Some embodiments may be used in combination with the PARENTAL SUPPORT™ (PS) method, embodiments of which are described in U.S. application Ser. No. 11/603,406 (US Publication No.: 20070184467), U.S. application Ser. No. 12/076,348 (US Publication No.: 20080243398), U.S. application Ser. No. 13/110,685, PCT Application PCT/US09/52730 (PCT Publication No.: WO/2010/017214), and PCT Application No. PCT/US10/050824 (PCT Publication No.: WO/2011/041485) which are incorporated herein by reference in their entirety. PARENTAL SUPPORT™ is an informatics based approach that can be used to analyze genetic data. In some embodiments, the methods disclosed herein may be considered as part of the PARENTAL SUPPORT™ method. In some embodiments, The PARENTAL SUPPORT™ method is a collection of methods that may be used to determine the genetic data of a target individual, with high accuracy, of one or a small number of cells from that individual, or of a mixture of DNA consisting of DNA from the target individual and DNA from one or a plurality of other individuals, specifically to determine disease-related alleles, other alleles of interest, and/or the ploidy state of one or a plurality of chromosomes in the target individual. PARENTAL SUPPORT™ may refer to any of these methods. PARENTAL SUPPORT™ is an example of an informatics based method. Exemplary embodiments of the PARENTAL SUPPORT™ method are illustrated in FIGS. 29-31G and described in Experiment 19.

The PARENTAL SUPPORT™ method makes use of known parental genetic data, i.e. haplotypic and/or diploid genetic data of the mother and/or the father, together with the knowledge of the mechanism of meiosis and the imperfect measurement of the target DNA, and possibly of one or more related individuals, along with population based crossover frequencies, in order to reconstruct, in silico, the genotype at a plurality of alleles, and/or the ploidy state of an embryo or of any target cell(s), and the target DNA at the location of key loci with a high degree of confidence. The PARENTAL SUPPORT™ method can reconstruct not only single nucleotide polymorphisms (SNPs) that were measured poorly, but also insertions and deletions, and SNPs or whole regions of DNA that were not measured at all. Furthermore, the PARENTAL SUPPORT™ method can both measure multiple disease-linked loci as well as screen for aneuploidy, from a single cell. In some embodiments, the PARENTAL SUPPORT™ method may be used to characterize one or more cells from embryos biopsied during an IVF cycle to determine the genetic condition of the one or more cells.

The PARENTAL SUPPORT™ method allows the cleaning of noisy genetic data. This may be done by inferring the correct genetic alleles in the target genome (embryo) using the genotype of related individuals (parents) as a reference. PARENTAL SUPPORT™ may be particularly relevant where only a small quantity of genetic material is available (e.g. PGD) and where direct measurements of the genotypes are inherently noisy due to the limited amounts of genetic material. PARENTAL SUPPORT™ may be particularly relevant where only a small fraction of the genetic material available is from the target individual (e.g. NPD) and where direct measurements of the genotypes are inherently noisy due to the contaminating DNA signal from another individual. The PARENTAL SUPPORT™ method is able to reconstruct highly accurate ordered diploid allele sequences on the embryo, together with copy number of chromosomes segments, even though the conventional, unordered diploid measurements may be characterized by high rates of allele dropouts, drop-ins, variable amplification biases and other errors. The method may employ both an underlying genetic model and an underlying model of measurement error. The genetic model may determine both allele probabilities at each SNP and crossover probabilities between SNPs. Allele probabilities may be modeled at each SNP based on data obtained from the parents and model crossover probabilities between SNPs based on data obtained from the HapMap database, as developed by the International HapMap Project. Given the proper underlying genetic model and measurement error model, maximum a posteriori (MAP) estimation may be used, with modifications for computationally efficiency, to estimate the correct, ordered allele values at each SNP in the embryo.

The techniques outlined above, in some cases, are able to determine the genotype of an individual given a very small amount of DNA originating from that individual. This could be the DNA from one or a small number of cells, or it could be from the small amount of fetal DNA found in maternal blood.

Hypotheses

In the context of this disclosure, a hypothesis refers to a possible genetic state. It may refer to a possible ploidy state. It may refer to a possible allelic state. A set of hypotheses may refer to a set of possible genetic states, a set of possible allelic states, a set of possible ploidy states, or combinations thereof. In some embodiments, a set of hypotheses may be designed such that one hypothesis from the set will correspond to the actual genetic state of any given individual. In some embodiments, a set of hypotheses may be designed such that every possible genetic state may be described by at least one hypothesis from the set. In some embodiments of the present disclosure, one aspect of a method is to determine which hypothesis corresponds to the actual genetic state of the individual in question.

In another embodiment of the present disclosure, one step involves creating a hypothesis. In some embodiments it may be a copy number hypothesis. In some embodiments it may involve a hypothesis concerning which segments of a chromosome from each of the related individuals correspond genetically to which segments, if any, of the other related individuals. Creating a hypothesis may refer to the act of setting the limits of the variables such that the entire set of possible genetic states that are under consideration are encompassed by those variables.

A "copy number hypothesis," also called a "ploidy hypothesis," or a "ploidy state hypothesis," may refer to a hypothesis concerning a possible ploidy state for a given chromosome copy, chromosome type, or section of a chromosome, in the target individual. It may also refer to the ploidy state at more than one of the chromosome types in the individual. A set of copy number hypotheses may refer to a set of hypotheses where each hypothesis corresponds to a different possible ploidy state in an individual. A set of hypotheses may concern a set of possible ploidy states, a set of possible parental haplotypes contributions, a set of possible fetal DNA percentages in the mixed sample, or combinations thereof. In some embodiments, the copy number hypotheses include all fetuses in a multiple pregnancy being euploid, all fetuses in a multiple pregnancy being aneuploid (such as any of the aneuploidies disclosed herein), and/or one or more fetuses in a multiple pregnancy being euploid and one or more fetuses in a multiple pregnancy being aneuploidy. In some embodiments, the copy number hypotheses include identical twins (also referred to as monozygotic twins) or fraternal twins (also referred to as dizygotic twins). In some embodiments, the copy number hypotheses include a molar pregnancy, such as a complete or partial molar pregnancy.

A normal individual contains one of each chromosome type from each parent. However, due to errors in meiosis and mitosis, it is possible for an individual to have 0, 1, 2, or more of a given chromosome type from each parent. In practice, it is rare to see more than two of a given chromosome from a parent. In this disclosure, some embodiments only consider the possible hypotheses where 0, 1, or 2 copies of a given chromosome come from a parent; it is a trivial extension to consider more or less possible copies originating from a parent. In some embodiments, for a given chromosome, there are nine possible hypotheses: the three possible hypothesis concerning 0, 1, or 2 chromosomes of maternal origin, multiplied by the three possible hypotheses concerning 0, 1, or 2 chromosomes of paternal origin. Let (m,f) refer to the hypothesis where m is the number of a given chromosome inherited from the mother, and f is the number of a given chromosome inherited from the father. Therefore, the nine hypotheses are (0,0), (0,1), (0,2), (1,0), (1,1), (1,2), (2,0), (2,1), and (2,2). These may also be written as H00, $H_{01}$, $H_{02}$, $H_{10}$, $H_{12}$, $H_{20}$, $H_{21}$, and $H_{22}$. The different hypotheses correspond to different ploidy states. For example, (1,1) refers to a normal disomic chromosome; (2,1) refers to a maternal trisomy, and (0,1) refers to a paternal monosomy. In some embodiments, the case where two chromosomes are inherited from one parent and one chromosome is inherited from the other parent may be further differentiated into two cases: one where the two chromosomes are identical (matched copy error), and one where the two chromosomes are homologous but not identical (unmatched copy error). In these embodiments, there are sixteen possible hypotheses. It should be understood that it is possible to use other sets of hypotheses, and a different number of hypotheses.

In some embodiments of the present disclosure, the ploidy hypothesis refers to a hypothesis concerning which chromosome from other related individuals correspond to a chromosome found in the target individual's genome. In some embodiments, a key to the method is the fact that related individuals can be expected to share haplotype blocks, and using measured genetic data from related individuals, along with a knowledge of which haplotype blocks match between the target individual and the related individual, it is possible to infer the correct genetic data for a target individual with higher confidence than using the target individual's genetic measurements alone. As such, in some embodiments, the ploidy hypothesis may concern not only the number of chromosomes, but also which chromosomes in related individuals are identical, or nearly identical, with one or more chromosomes in the target individual.

Once the set of hypotheses have been defined, when the algorithms operate on the input genetic data, they may output a determined statistical probability for each of the hypotheses under consideration. The probabilities of the various hypotheses may be determined by mathematically calculating, for each of the various hypotheses, the value that the probability equals, as stated by one or more of the expert techniques, algorithms, and/or methods described elsewhere in this disclosure, using the relevant genetic data as input.

Once the probabilities of the different hypotheses are estimated, as determined by a plurality of techniques, they may be combined. This may entail, for each hypothesis, multiplying the probabilities as determined by each technique. The product of the probabilities of the hypotheses may be normalized. Note that one ploidy hypothesis refers to one possible ploidy state for a chromosome.

The process of "combining probabilities," also called "combining hypotheses," or combining the results of expert techniques, is a concept that should be familiar to one skilled in the art of linear algebra. One possible way to combine probabilities is as follows: When an expert technique is used to evaluate a set of hypotheses given a set of genetic data, the output of the method is a set of probabilities that are associated, in a one-to-one fashion, with each hypothesis in the set of hypotheses. When a set of probabilities that were determined by a first expert technique, each of which are associated with one of the hypotheses in the set, are combined with a set of probabilities that were determined by a second expert technique, each of which are associated with the same set of hypotheses, then the two sets of probabilities are multiplied. This means that, for each hypothesis in the set, the two probabilities that are associated with that hypothesis, as determined by the two expert methods, are multiplied together, and the corresponding product is the output probability. This process may be expanded to any number of expert techniques. If only one expert technique is used, then the output probabilities are the same as the input probabilities. If more than two expert techniques are used, then the relevant probabilities may be multiplied at the same time. The products may be normalized so that the probabilities of the hypotheses in the set of hypotheses sum to 100%.

In some embodiments, if the combined probabilities for a given hypothesis are greater than the combined probabilities for any of the other hypotheses, then it may be considered that that hypothesis is determined to be the most likely. In some embodiments, a hypothesis may be determined to be the most likely, and the ploidy state, or other genetic state, may be called if the normalized probability is greater than a threshold. In an embodiment, this may mean that the number and identity of the chromosomes that are associated with that hypothesis may be called as the ploidy state. In an embodiment, this may mean that the identity of the alleles that are associated with that hypothesis may be called as the allelic state. In some embodiments, the threshold may be between about 50% and about 80%. In some embodiments the threshold may be between about 80% and about 90%. In some embodiments the threshold may be between about 90% and about 95%. In some embodiments the threshold may be between about 95% and about 99%. In some embodiments the threshold may be between about 99% and about 99.9%. In some embodiments the threshold may be above about 99.9%.

Parental Contexts

The parental context refers to the genetic state of a given allele, on each of the two relevant chromosomes for one or both of the two parents of the target. Note that in an embodiment, the parental context does not refer to the allelic state of the target, rather, it refers to the allelic state of the parents. The parental context for a given SNP may consist of four base pairs, two paternal and two maternal; they may be the same or different from one another. It is typically written as "$m_1 m_2 | f_1 f_2$," where $m_1$ and $m_2$ are the genetic state of the given SNP on the two maternal chromosomes, and $f_1$ and $f_2$ are the genetic state of the given SNP on the two paternal chromosomes. In some embodiments, the parental context may be written as "$f_1 f_2 | m_1 m_2$" Note that subscripts "1" and "2" refer to the genotype, at the given allele, of the first and second chromosome; also note that the choice of which chromosome is labeled "1" and which is labeled "2" is arbitrary.

Note that in this disclosure, A and B are often used to generically represent base pair identities; A or B could equally well represent C (cytosine), G (guanine), A (adenine) or T (thymine). For example, if, at a given SNP based allele, the mother's genotype was T at that SNP on one chromosome, and G at that SNP on the homologous chromosome, and the father's genotype at that allele is G at that SNP on both of the homologous chromosomes, one may say that the target individual's allele has the parental context of AB|BB; it could also be said that the allele has the parental context of AB|AA. Note that, in theory, any of the four possible nucleotides could occur at a given allele, and thus it is possible, for example, for the mother to have a genotype of AT, and the father to have a genotype of GC at a given allele. However, empirical data indicate that in most cases only two of the four possible base pairs are observed at a given allele. It is possible, for example when using single tandem repeats, to have more than two parental, more than four and even more than ten contexts. In this disclosure the discussion assumes that only two possible base pairs will be observed at a given allele, although the embodiments disclosed herein could be modified to take into account the cases where this assumption does not hold.

A "parental context" may refer to a set or subset of target SNPs that have the same parental context. For example, if one were to measure 1000 alleles on a given chromosome on a target individual, then the context AA|BB could refer to the set of all alleles in the group of 1,000 alleles where the genotype of the mother of the target was homozygous, and the genotype of the father of the target is homozygous, but where the maternal genotype and the paternal genotype are dissimilar at that locus. If the parental data is not phased, and thus AB=BA, then there are nine possible parental contexts: AA|AA, AA|AB, AA|BB, AB|AA, AB|AB, AB|BB, BB|AA, BB|AB, and BB|BB. If the parental data is phased, and thus AB≠BA, then there are sixteen different possible parental contexts: AA|AA, AA|AB, AA|BA, AA|BB, AB|AA, AB|AB, AB|BA, AB|BB, BA|AA, BA|AB, BA|BA, BA|BB, BB|AA, BB|AB, BB|BA, and BB|BB. Every SNP allele on a chromosome, excluding some SNPs on the sex chromosomes, has one of these parental contexts. The set of SNPs wherein the parental context for one parent is heterozygous may be referred to as the heterozygous context.

Use of Parental Contexts in NPD

Non-invasive prenatal diagnosis is an important technique that can be used to determine the genetic state of a fetus from genetic material that is obtained in a non-invasive manner, for example from a blood draw on the pregnant mother. The blood could be separated and the plasma isolated, followed by isolation of the plasma DNA. Size selection could be used to isolate the DNA of the appropriate length. The DNA may be preferentially enriched at a set of loci. This DNA can then be measured by a number of means, such as by hybridizing to a genotyping array and measuring the fluorescence, or by sequencing on a high throughput sequencer.

When sequencing is used for ploidy calling of a fetus in the context of non-invasive prenatal diagnosis, there are a number of ways to use the sequence data. The most common way one could use the sequence data is to simply count the number of reads that map to a given chromosome. For example, imagine if you are trying to determine the ploidy state of chromosome 21 on the fetus. Further imagine that the DNA in the sample is comprised of 10% DNA of fetal origin, and 90% DNA of maternal origin. In this case, you could look at the average number of reads on a chromosome which can be expected to be disomic, for example chromosome 3, and compare that to the number of read on chromosome 21, where the reads are adjusted for the number of base pairs on that chromosome that are part of a unique sequence. If the fetus were euploid, one would expect the amount of DNA per unit of genome to be about equal at all locations (subject to stochastic variations). On the other hand, if the fetus were trisomic at chromosome 21, then one would expect there to be more slightly more DNA per genetic unit from chromosome 21 than the other locations on the genome. Specifically one would expect there to be about 5% more DNA from chromosome 21 in the mixture. When sequencing is used to measure the DNA, one would expect about 5% more uniquely mappable reads from chromosome 21 per unique segment than from the other chromosomes. One could use the observation of an amount of DNA from a particular chromosome that is higher than a certain threshold, when adjusted for the number of sequences that are uniquely mappable to that chromosome, as the basis for an aneuploidy diagnosis. Another method that may be used to detect aneuploidy is similar to that above, except that parental contexts could be taken into account.

When considering which alleles to target, one may consider the likelihood that some parental contexts are likely to be more informative than others. For example, AA|BB and the symmetric context BB|AA are the most informative contexts, because the fetus is known to carry an allele that is different from the mother. For reasons of symmetry, both AA|BB and BB|AA contexts may be referred to as AA|BB. Another set of informative parental contexts are AA|AB and BB|AB, because in these cases the fetus has a 50% chance of carrying an allele that the mother does not have. For reasons of symmetry, both AA|AB and BB|AB contexts may be referred to as AA|AB. A third set of informative parental contexts are AB|AA and AB|BB, because in these cases the fetus is carrying a known paternal allele, and that allele is also present in the maternal genome. For reasons of symmetry, both AB|AA and AB|BB contexts may be referred to as AB|AA. A fourth parental context is AB|AB where the fetus has an unknown allelic state, and whatever the allelic state, it is one in which the mother has the same alleles. The fifth parental context is AA|AA, where the mother and father are heterozygous.

Different Implementations of the Presently Disclosed Embodiments

Methods are disclosed herein for determining the ploidy state of a target individual. The target individual may be a blastomere, an embryo, or a fetus. In some embodiments of the present disclosure, a method for determining the ploidy state of one or more chromosome in a target individual may include any of the steps described in this document, and combinations thereof:

In some embodiments the source of the genetic material to be used in determining the genetic state of the fetus may be fetal cells, such as nucleated fetal red blood cells, isolated from the maternal blood. The method may involve obtaining a blood sample from the pregnant mother. The method may involve isolating a fetal red blood cell using visual techniques, based on the idea that a certain combination of colors are uniquely associated with nucleated red blood cells, and a similar combination of colors is not associated with any other present cell in the maternal blood. The combination of colors associated with the nucleated red blood cells may include the red color of the hemoglobin around the nucleus, which color may be made more distinct by staining, and the color of the nuclear material which can be stained, for example, blue. By isolating the cells from maternal blood and spreading them over a slide, and then identifying those points at which one sees both red (from the Hemoglobin) and blue (from the nuclear material) one may be able to identify the location of nucleated red blood cells. One may then extract those nucleated red blood cells using a micromanipulator, use genotyping and/or sequencing techniques to measure aspects of the genotype of the genetic material in those cells.

In an embodiment, one may stain the nucleated red blood cell with a die that only fluoresces in the presence of fetal hemoglobin and not maternal hemoglobin, and so remove the ambiguity between whether a nucleated red blood cell is derived from the mother or the fetus. Some embodiments of the present disclosure may involve staining or otherwise marking nuclear material. Some embodiments of the present disclosure may involve specifically marking fetal nuclear material using fetal cell specific antibodies.

There are many other ways to isolate fetal cells from maternal blood, or fetal DNA from maternal blood, or to enrich samples of fetal genetic material in the presence of maternal genetic material. Some of these methods are listed here, but this is not intended to be an exhaustive list. Some appropriate techniques are listed here for convenience: using fluorescently or otherwise tagged antibodies, size exclusion chromatography, magnetically or otherwise labeled affinity tags, epigenetic differences, such as differential methylation between the maternal and fetal cells at specific alleles, density gradient centrifugation succeeded by CD45/14 depletion and CD71-positive selection from CD45/14 negative-cells, single or double Percoll gradients with different osmolalities, or galactose specific lectin method.

In an embodiment of the present disclosure, the target individual is a fetus, and the different genotype measurements are made on a plurality of DNA samples from the fetus. In some embodiments of the present disclosure, the fetal DNA samples are from isolated fetal cells where the fetal cells may be mixed with maternal cells. In some embodiments of the present disclosure, the fetal DNA samples are from free floating fetal DNA, where the fetal DNA may be mixed with free floating maternal DNA. In some embodiments, the fetal DNA samples may be derived from maternal plasma or maternal blood that contains a mixture of maternal DNA and fetal DNA. In some embodiments, the fetal DNA may be mixed with maternal DNA in maternal:fetal ratios ranging from 99.9:0.1% to 99:1%; 99:1% to 90:10%; 90:10% to 80:20%; 80:20% to 70:30%; 70:30% to 50:50%; 50:50% to 10:90%; or 10:90% to 1:99%; 1:99% to 0.1:99.9%.

The genetic data of the target individual and/or of the related individual can be transformed from a molecular state to an electronic state by measuring the appropriate genetic material using tools and or techniques taken from a group including, but not limited to: genotyping microarrays, and high throughput sequencing. Some high throughput sequencing methods include Sanger DNA sequencing, pyrosequencing, the ILLUMINA SOLEXA platform, ILLUMINA's GENOME ANALYZER, or APPLIED BIOSYSTEM's 454 sequencing platform, HELICOS's TRUE SINGLE MOLECULE SEQUENCING platform, HALCYON MOLECULAR's electron microscope sequencing method, or any other sequencing method. All of these methods physically transform the genetic data stored in a sample of DNA into a set of genetic data that is typically stored in a memory device in route to being processed.

A relevant individual's genetic data may be measured by analyzing substances taken from a group including, but not limited to: the individual's bulk diploid tissue, one or more diploid cells from the individual, one or more haploid cells from the individual, one or more blastomeres from the target individual, extra-cellular genetic material found on the individual, extra-cellular genetic material from the individual found in maternal blood, cells from the individual found in maternal blood, one or more embryos created from (a) gamete(s) from the related individual, one or more blastomeres taken from such an embryo, extra-cellular genetic material found on the related individual, genetic material known to have originated from the related individual, and combinations thereof.

In some embodiments, a set of at least one ploidy state hypothesis may be created for each of the chromosomes types of interest of the target individual. Each of the ploidy state hypotheses may refer to one possible ploidy state of the chromosome or chromosome segment of the target individual. The set of hypotheses may include some or all of the possible ploidy states that the chromosome of the target individual may be expected to have. Some of the possible ploidy states may include nullsomy, monosomy, disomy, uniparental disomy, euploidy, trisomy, matching trisomy, unmatching trisomy, maternal trisomy, paternal trisomy, tetrasomy, balanced (2:2) tetrasomy, unbalanced (3:1) tetrasomy, pentasomy, hexasomy, other aneuploidy, and combinations thereof. Any of these aneuploidy states may be mixed or partial aneuploidy such as unbalanced translocations, balanced translocations, Robertsonian translocations, recombinations, deletions, insertions, crossovers, and combinations thereof.

In some embodiments, the knowledge of the determined ploidy state may be used to make a clinical decision. This knowledge, typically stored as a physical arrangement of matter in a memory device, may then be transformed into a report. The report may then be acted upon. For example, the clinical decision may be to terminate the pregnancy; alternately, the clinical decision may be to continue the pregnancy. In some embodiments the clinical decision may involve an intervention designed to decrease the severity of the phenotypic presentation of a genetic disorder, or a decision to take relevant steps to prepare for a special needs child.

In an embodiment of the present disclosure, any of the methods described herein may be modified to allow for multiple targets to come from same target individual, for example, multiple blood draws from the same pregnant mother. This may improve the accuracy of the model, as multiple genetic measurements may provide more data with which the target genotype may be determined. In an embodiment, one set of target genetic data served as the primary data which was reported, and the other served as data to double-check the primary target genetic data. In an embodiment, a plurality of sets of genetic data, each measured from genetic material taken from the target individual, are considered in parallel, and thus both sets of target genetic data serve to help determine which sections of parental genetic data, measured with high accuracy, composes the fetal genome.

In an embodiment, the method may be used for the purpose of paternity testing. For example, given the SNP-based genotypic information from the mother, and from a man who may or may not be the genetic father, and the measured genotypic information from the mixed sample, it is possible to determine if the genotypic information of the male indeed represents that actual genetic father of the gestating fetus. A simple way to do this is to simply look at the contexts where the mother is AA, and the possible father is AB or BB. In these cases, one may expect to see the father contribution half (AA|AB) or all (AA|BB) of the time, respectively. Taking into account the expected ADO, it is straightforward to determine whether or not the fetal SNPs that are observed are correlated with those of the possible father.

One embodiment of the present disclosure could be as follows: a pregnant woman wants to know if her fetus is afflicted with Down Syndrome, and/or if it will suffer from Cystic Fibrosis, and she does not wish to bear a child that is afflicted with either of these conditions. A doctor takes her blood, and stains the hemoglobin with one marker so that it appears clearly red, and stains nuclear material with another marker so that it appears clearly blue. Knowing that maternal red blood cells are typically anuclear, while a high proportion of fetal cells contain a nucleus, the doctor is able to visually isolate a number of nucleated red blood cells by identifying those cells that show both a red and blue color. The doctor picks up these cells off the slide with a micromanipulator and sends them to a lab which amplifies and genotypes ten individual cells. By using the genetic measurements, the PARENTAL SUPPORT™ method is able to determine that six of the ten cells are maternal blood cells, and four of the ten cells are fetal cells. If a child has already been born to a pregnant mother, PARENTAL SUPPORT™ can also be used to determine that the fetal cells are distinct from the cells of the born child by making reliable allele calls on the fetal cells and showing that they are dissimilar to those of the born child. Note that this method is similar in concept to the paternal testing embodiment of the present disclosure. The genetic data measured from the fetal cells may be of very poor quality, comprising many allele drop outs, due to the difficulty of genotyping single cells. The clinician is able to use the measured fetal DNA along with the reliable DNA measurements of the parents to infer aspects of the genome of the fetus with high accuracy using PARENTAL SUPPORT™, thereby transforming the genetic data contained on genetic material from the fetus into the predicted genetic state of the fetus, stored on a computer. The clinician is able to determine both the ploidy state of the fetus, and the presence or absence of a plurality of disease-linked genes of interest. It turns out that the fetus is euploid, and is not a carrier for cystic fibrosis, and the mother decides to continue the pregnancy.

In an embodiment of the present disclosure, a pregnant mother would like to determine if her fetus is afflicted with any whole chromosomal abnormalities. She goes to her doctor, and gives a sample of her blood, and she and her husband gives samples of their own DNA from cheek swabs. A laboratory researcher genotypes the parental DNA using the MDA protocol to amplify the parental DNA, and ILLUMINA INFINIUM arrays to measure the genetic data of the parents at a large number of SNPs. The researcher then spins down the blood, takes the plasma, and isolates a sample of free-floating DNA using size exclusion chromatography. Alternately, the researcher uses one or more fluorescent antibodies, such as one that is specific to fetal hemoglobin to isolate a nucleated fetal red blood cell. The researcher then takes the isolated or enriched fetal genetic material and amplifies it using a library of 70-mer oligonucleotides appropriately designed such that two ends of each oligonucleotide corresponded to the flanking sequences on either side of a target allele. Upon addition of a polymerase, ligase, and the appropriate reagents, the oligonucleotides underwent gap-filling circularization, capturing the desired allele. An exonuclease was added, heat-inactivated, and the products were used directly as a template for PCR amplification. The PCR products were sequenced on an ILLUMINA GENOME ANALYZER. The sequence reads were used as input for the PARENTAL SUPPORT™ method, which then predicted the ploidy state of the fetus.

In another embodiment, a couple—where the mother, who is pregnant, and is of advanced maternal age—wants to know whether the gestating fetus has Down syndrome, Turner Syndrome, Prader Willi syndrome, or some other whole chromosomal abnormality. The obstetrician takes a blood draw from the mother and father. The blood is sent to a laboratory, where a technician centrifuges the maternal sample to isolate the plasma and the buffy coat. The DNA in the buffy coat and the paternal blood sample are transformed through amplification and the genetic data encoded in the amplified genetic material is further transformed from molecularly stored genetic data into electronically stored genetic data by running the genetic material on a high throughput sequencer to measure the parental genotypes. The plasma sample is preferentially enriched at a set of loci using a 5,000-plex hemi-nested targeted PCR method. The mixture of DNA fragments is prepared into a DNA library suitable for sequencing. The DNA is then sequenced using a high throughput sequencing method, for example, the ILLUMINA GAIIx GENOME ANALYZER. The sequencing transforms the information that is encoded molecularly in the DNA into information that is encoded electronically in computer hardware. An informatics based technique that includes the presently disclosed embodiments, such as PARENTAL SUPPORT™, may be used to determine the ploidy state of the fetus. This may involve calculating, on a computer, allele count probabilities at the plurality of polymorphic loci from the DNA measurements made on the prepared sample; creating, on a computer, a plurality of ploidy hypotheses each pertaining to a different possible ploidy state of the chromosome; building, on a computer, a joint distribution model for the expected allele counts at the plurality of polymorphic loci on the chromosome for each ploidy hypothesis; determining, on a computer, a relative probability of each of the ploidy hypotheses using the joint distribution model and the allele counts measured on the prepared sample; and calling the ploidy state of the fetus by selecting the ploidy state corresponding to the hypothesis with the greatest probability. It is determined that the fetus has Down syndrome. A report is printed out, or sent electronically to the pregnant woman's obstetrician, who transmits the diagnosis to the woman. The woman, her husband, and the doctor sit down and discuss their options. The couple decides to terminate the pregnancy based on the knowledge that the fetus is afflicted with a trisomic condition.

In an embodiment, a company may decide to offer a diagnostic technology designed to detect aneuploidy in a gestating fetus from a maternal blood draw. Their product may involve a mother presenting to her obstetrician, who may draw her blood. The obstetrician may also collect a genetic sample from the father of the fetus. A clinician may isolate the plasma from the maternal blood, and purify the DNA from the plasma. A clinician may also isolate the buffy coat layer from the maternal blood, and prepare the DNA from the buffy coat. A clinician may also prepare the DNA from the paternal genetic sample. The clinician may use molecular biology techniques described in this disclosure to append universal amplification tags to the DNA in the DNA derived from the plasma sample. The clinician may amplify the universally tagged DNA. The clinician may preferentially enrich the DNA by a number of techniques including capture by hybridization and targeted PCR. The targeted PCR may involve nesting, hemi-nesting or semi-nesting, or any other approach to result in efficient enrichment of the plasma derived DNA. The targeted PCR may be massively multiplexed, for example with 10,000 primers in one reaction volume, where the primers target SNPs on chromosomes 13, 18, 21, X and those loci that are common to both X and Y, and optionally other chromosomes as well. The selective enrichment and/or amplification may involve tagging each individual molecule with different tags, molecular barcodes, tags for amplification, and/or tags for sequencing. The clinician may then sequence the plasma sample, and also possibly also the prepared maternal and/or paternal DNA. The molecular biology steps may be executed either wholly or partly by a diagnostic box. The sequence data may be fed into a single computer, or to another type of computing platform such as may be found in 'the cloud'. The computing platform may calculate allele counts at the targeted polymorphic loci from the measurements made by the sequencer. The computing platform may create a plurality of ploidy hypotheses pertaining to nullsomy, monosomy, disomy, matched trisomy, and unmatched trisomy for each of chromosomes 13, 18, 21, X and Y. The computing platform may build a joint distribution model for the expected allele counts at the targeted loci on the chromosome for each ploidy hypothesis for each of the five chromosomes being interrogated. The computing platform may determine a probability that each of the ploidy hypotheses is true using the joint distribution model and the allele counts measured on the preferentially enriched DNA derived from the plasma sample. The computing platform may call the ploidy state of the fetus, for each of chromosome 13, 18, 21, X and Y by selecting the ploidy state corresponding to the germane hypothesis with the greatest probability. A report may be generated comprising the called ploidy states, and it may be sent to the obstetrician electronically, displayed on an output device, or a printed hard copy of the report may be delivered to the obstetrician. The obstetrician may inform the patient and optionally the father of the fetus, and they may decide which clinical options are open to them, and which is most desirable.

In another embodiment, a pregnant woman, hereafter referred to as "the mother" may decide that she wants to know whether or not her fetus(es) are carrying any genetic abnormalities or other conditions. She may want to ensure that there are not any gross abnormalities before she is confident to continue the pregnancy. She may go to her obstetrician, who may take a sample of her blood. He may also take a genetic sample, such as a buccal swab, from her cheek. He may also take a genetic sample from the father of the fetus, such as a buccal swab, a sperm sample, or a blood sample. He may send the samples to a clinician. The clinician may enrich the fraction of free floating fetal DNA in the maternal blood sample. The clinician may enrich the fraction of enucleated fetal blood cells in the maternal blood sample. The clinician may use various aspects of the methods described herein to determine genetic data of the fetus. That genetic data may include the ploidy state of the fetus, and/or the identity of one or a number of disease linked alleles in the fetus. A report may be generated summarizing the results of the prenatal diagnosis. The report may be transmitted or mailed to the doctor, who may tell the mother the genetic state of the fetus. The mother may decide to discontinue the pregnancy based on the fact that the fetus has one or more chromosomal, or genetic abnormalities, or undesirable conditions. She may also decide to continue the pregnancy based on the fact that the fetus does not have any gross chromosomal or genetic abnormalities, or any genetic conditions of interest.

Another example may involve a pregnant woman who has been artificially inseminated by a sperm donor, and is pregnant. She wants to minimize the risk that the fetus she is carrying has a genetic disease. She has blood drawn at a phlebotomist, and techniques described in this disclosure are used to isolate three nucleated fetal red blood cells, and a tissue sample is also collected from the mother and genetic father. The genetic material from the fetus and from the mother and father are amplified as appropriate and genotyped using the ILLUMINA INFINIUM BEADARRAY, and the methods described herein clean and phase the parental and fetal genotype with high accuracy, as well as to make ploidy calls for the fetus. The fetus is found to be euploid, and phenotypic susceptibilities are predicted from the reconstructed fetal genotype, and a report is generated and sent to the mother's physician so that they can decide what clinical decisions may be best.

In an embodiment, the raw genetic material of the mother and the father is transformed by way of amplification to an amount of DNA that is similar in sequence, but larger in quantity. Then, by way of a genotyping method, the genotypic data that is encoded by nucleic acids is transformed into genetic measurements that may be stored physically and/or electronically on a memory device, such as those described above. The relevant algorithms that makeup the PARENTAL SUPPORT™ algorithm, relevant parts of which are discussed in detail herein, are translated into a computer program, using a programming language. Then, through the execution of the computer program on the computer hardware, instead of being physically encoded bits and bytes, arranged in a pattern that represents raw measurement data, they become transformed into a pattern that represents a high confidence determination of the ploidy state of the fetus. The details of this transformation will rely on the data itself and the computer language and hardware system used to execute the method described herein. Then, the data that is physically configured to represent a high quality ploidy determination of the fetus is transformed into a report which may be sent to a health care practitioner. This transformation may be carried out using a printer or a computer display. The report may be a printed copy, on paper or other suitable medium, or else it may be electronic. In the case of an electronic report, it may be transmitted, it may be physically stored on a memory device at a location on the computer accessible by the health care practitioner; it also may be displayed on a screen so that it may be read. In the case of a screen display, the data may be transformed to a readable format by causing the physical transformation of pixels on the display device. The transformation may be accomplished by way of physically firing electrons at a phosphorescent screen, by way of altering an electric charge that physically changes the transparency of a specific set of pixels on a screen that may lie in front of a substrate that emits or absorbs photons. This transformation may be accomplished by way of changing the nanoscale orientation of the molecules in a liquid crystal, for example, from nematic to cholesteric or smectic phase, at a specific set of pixels. This transformation may be accomplished by way of an electric current causing photons to be emitted from a specific set of pixels made from a plurality of light emitting diodes arranged in a meaningful pattern. This transformation may be accomplished by any other way used to display information, such as a computer screen, or some other output device or way of transmitting information. The health care practitioner may then act on the report, such that the data in the report is transformed into an action. The action may be to continue or discontinue the pregnancy, in which case a gestating fetus with a genetic abnormality is transformed into non-living fetus. The transformations listed herein may be aggregated, such that, for example, one may transform the genetic material of a pregnant mother and the father, through a number of steps outlined in this disclosure, into a medical decision consisting of aborting a fetus with genetic abnormalities, or consisting of continuing the pregnancy. Alternately, one may transform a set of genotypic measurements into a report that helps a physician treat his pregnant patient.

In an embodiment of the present disclosure, the method described herein can be used to determine the ploidy state of a fetus even when the host mother, i.e. the woman who is pregnant, is not the biological mother of the fetus she is carrying. In an embodiment of the present disclosure, the method described herein can be used to determine the ploidy state of a fetus using only the maternal blood sample, and without the need for a paternal genetic sample.

Some of the math in the presently disclosed embodiments makes hypotheses concerning a limited number of states of aneuploidy. In some cases, for example, only zero, one or two chromosomes are expected to originate from each parent. In some embodiments of the present disclosure, the mathematical derivations can be expanded to take into account other forms of aneuploidy, such as quadrosomy, where three chromosomes originate from one parent, pentasomy, hexasomy etc., without changing the fundamental concepts of the present disclosure. At the same time, it is possible to focus on a smaller number of ploidy states, for example, only trisomy and disomy. Note that ploidy determinations that indicate a non-whole number of chromosomes may indicate mosaicism in a sample of genetic material.

In some embodiments, the genetic abnormality is a type of aneuploidy, such as Down syndrome (or trisomy 21), Edwards syndrome (trisomy 18), Patau syndrome (trisomy 13), Turner Syndrome (45X), Klinefelter's syndrome (a male with 2× chromosomes), Prader-Willi syndrome, and DiGeorge syndrome (UPD 15). Congenital disorders, such as those listed in the prior sentence, are commonly undesirable, and the knowledge that a fetus is afflicted with one or more phenotypic abnormalities may provide the basis for a decision to terminate the pregnancy, to take necessary precautions to prepare for the birth of a special needs child, or to take some therapeutic approach meant to lessen the severity of a chromosomal abnormality.

In some embodiments, the methods described herein can be used at a very early gestational age, for example as early as four weeks, as early as five weeks, as early as six weeks, as early as seven weeks, as early as eight weeks, as early as nine weeks, as early as ten weeks, as early as eleven weeks, and as early as twelve weeks.

In some embodiments, a method disclosed herein is used in the context of pre-implantation genetic diagnosis (PGD) for embryo selection during in vitro fertilization, where the target individual is an embryo, and the parental genotypic data can be used to make ploidy determinations about the embryo from sequencing data from a single or two cell biopsy from a day 3 embryo or a trophectoderm biopsy from a day 5 or day 6 embryo. In a PGD setting, only the child DNA is measured, and only a small number of cells are tested, generally one to five but as many as ten, twenty or fifty. The total number of starting copies of the A and B alleles (at a SNP) are then trivially determined by the child genotype and the number of cells. In NPD, the number of starting copies is very high and so the allele ratio after PCR is expected to accurately reflect the starting ratio. However, the small number of starting copies in PGD means that contamination and imperfect PCR efficiency have a non-trivial effect on the allele ratio following PCR. This effect may be more important than depth of read in predicting the variance in the allele ratio measured after sequencing. The distribution of measured allele ratio given a known child genotype may be created by Monte Carlo simulation of the PCR process based on the PCR probe efficiency and probability of contamination. Given an allele ratio distribution for each possible child genotype, the likelihoods of various hypotheses can be calculated as described for NIPD.

Maximum Likelihood Estimates

Most methods known in the art for detecting the presence or absence of biological phenomenon or medical condition involve the use of a single hypothesis rejection test, where a metric that is correlated with the condition is measured, and if the metric is on one side of a given threshold, the condition is present, while of the metric falls on the other side of the threshold, the condition is absent. A single-hypothesis rejection test only looks at the null distribution when deciding between the null and alternate hypotheses. Without taking into account the alternate distribution, one cannot estimate the likelihood of each hypothesis given the observed data and therefore cannot calculate a confidence on the call. Hence with a single-hypothesis rejection test, one gets a yes or no answer without a feeling for the confidence associated with the specific case.

In some embodiments, the method disclosed herein is able to detect the presence or absence of biological phenomenon or medical condition using a maximum likelihood method. This is a substantial improvement over a method using a single hypothesis rejection technique as the threshold for calling absence or presence of the condition can be adjusted as appropriate for each case. This is particularly relevant for diagnostic techniques that aim to determine the presence or absence of aneuploidy in a gestating fetus from genetic data available from the mixture of fetal and maternal DNA present in the free floating DNA found in maternal plasma. This is because as the fraction of fetal DNA in the plasma derived fraction changes, the optimal threshold for calling aneuploidy vs. euploidy changes. As the fetal fraction drops, the distribution of data that is associated with an aneuploidy becomes increasingly similar to the distribution of data that is associated with a euploidy.

The maximum likelihood estimation method uses the distributions associated with each hypothesis to estimate the likelihood of the data conditioned on each hypothesis. These conditional probabilities can then be converted to a hypothesis call and confidence. Similarly, maximum a posteriori estimation method uses the same conditional probabilities as the maximum likelihood estimate, but also incorporates population priors when choosing the best hypothesis and determining confidence.

Therefore, the use of a maximum likelihood estimate (MLE) technique, or the closely related maximum a posteriori (MAP) technique give two advantages, first it increases the chance of a correct call, and it also allows a confidence to be calculated for each call. In an embodiment, selecting the ploidy state corresponding to the hypothesis with the greatest probability is carried out using maximum likelihood estimates or maximum a posteriori estimates. In an embodiment, a method is disclosed for determining the ploidy state of a gestating fetus that involves taking any method currently known in the art that uses a single hypothesis rejection technique and reformulating it such that it uses a MLE or MAP technique. Some examples of methods that can be significantly improved by applying these techniques can be found in U.S. Pat. Nos. 8,008,018, 7,888,017, or 7,332,277.

In an embodiment, a method is described for determining presence or absence of fetal aneuploidy in a maternal plasma sample comprising fetal and maternal genomic DNA, the method comprising: obtaining a maternal plasma sample; measuring the DNA fragments found in the plasma sample with a high throughput sequencer; mapping the sequences to the chromosome and determining the number of sequence reads that map to each chromosome; calculating the fraction of fetal DNA in the plasma sample; calculating an expected distribution of the amount of a target chromosome that would be expected to be present if that if the second target chromosome were euploid and one or a plurality of expected distributions that would be expected if that chromosome were aneuploid, using the fetal fraction and the number of sequence reads that map to one or a plurality of reference chromosomes expected to be euploid; and using a MLE or MAP determine which of the distributions is most likely to be correct, thereby indicating the presence or absence of a fetal aneuploidy. In an embodiment, the measuring the DNA from the plasma may involve conducting massively parallel shotgun sequencing. In an embodiment, the measuring the DNA from the plasma sample may involve sequencing DNA that has been preferentially enriched, for example through targeted amplification, at a plurality of polymorphic or non-polymorphic loci. The plurality of loci may be designed to target one or a small number of suspected aneuploid chromosomes and one or a small number of reference chromosomes. The purpose of the preferential enrichment is to increase the number of sequence reads that are informative for the ploidy determination.

Ploidy Calling Informatics Methods

Described herein is a method for determining the ploidy state of a fetus given sequence data. In some embodiments, this sequence data may be measured on a high throughput sequencer. In some embodiments, the sequence data may be measured on DNA that originated from free floating DNA isolated from maternal blood, wherein the free floating DNA comprises some DNA of maternal origin, and some DNA of fetal/placental origin. This section will describe one embodiment of the present disclosure in which the ploidy state of the fetus is determined assuming that fraction of fetal DNA in the mixture that has been analyzed is not known and will be estimated from the data. It will also describe an embodiment in which the fraction of fetal DNA ("fetal fraction") or the percentage of fetal DNA in the mixture can be measured by another method, and is assumed to be known in determining the ploidy state of the fetus. In some embodiments the fetal fraction can be calculated using only the genotyping measurements made on the maternal blood sample itself, which is a mixture of fetal and maternal DNA. In some embodiments the fraction may be calculated also using the measured or otherwise known genotype of the mother and/or the measured or otherwise known genotype of the father. In another embodiment ploidy state of the fetus can be determined solely based on the calculated fraction of fetal DNA for the chromosome in question compared to the calculated fraction of fetal DNA for the reference chromosome assumed disomic.

In the preferred embodiment, suppose that, for a particular chromosome, we observe and analyze N SNPs, for which we have:

Set of NR free floating DNA sequence measurements $S=(s_1, \ldots, s_{NR})$. Since this method utilizes the SNP measurements, all sequence data that corresponds to non-polymorphic loci can be disregarded. In a simplified version, where we have (A,B) counts on each SNP, where A and B correspond to the two alleles present at a given locus, S can be written as $S=((a_1, b_1), \ldots, (a_N, b_N))$, where $a_i$ is the A count on SNP i, $b_i$ is the B count on SNP i, and $\Sigma_{i=1:N}(a_i+b_i)=NR$ Parent data consisting of
genotypes from a SNP microarray or other intensity based genotyping platform: mother $M=(m_1, \ldots, m_N)$, father $F=(f_1, \ldots, f_N)$, where $m_i, f_i \in$(AA, AB, BB).

AND/OR sequence data measurements: NRM mother measurements $SM=(sm_1, \ldots, sm_{nrm})$, NRF father measurements $SF=(sf_1, \ldots, sf_{nrf})$. Similar to the above simplification, if we have (A,B) counts on each SNP $SM=((am_1,bm_1), \ldots, (am_N, bm_N))$, $SF=((af_1,bf_1), \ldots, (af_N, bf_N))$ Collectively, the mother, father child data are denoted as $D=(M,F,SM,SF,S)$. Note that the parent data is desired and increases the accuracy of the algorithm, but is NOT necessary, especially the father data. This means that even in the absence of mother and/or father data, it is possible to get very accurate copy number results.

It is possible to derive the best copy number estimate (H*) by maximizing the data log likelihood LIK(D|H) over all hypotheses (H) considered. In particular, it is possible to determine the relative probability of each of the ploidy hypotheses using the joint distribution model and the allele counts measured on the prepared sample, and using those relative probabilities to determine the hypothesis most likely to be correct as follows:

$$H^* = \underset{H}{\operatorname{argmax}} \, LIK(D|H)$$

Similarly the a posteriori hypothesis likelihood given the data may be written as:

$$H^* = \underset{H}{\arg\max}\, LIK(D|H) * priorprob(H)$$

Where priorprob(H) is the prior probability assigned to each hypothesis H, based on model design and prior knowledge. It is also possible to use priors to find the maximum a posteriori estimate:

$$H_{MA} = \underset{H}{\arg\max}\, LIK(D|H)$$

In an embodiment, the copy number hypotheses that may be considered are:
Monosomy:
  maternal H10 (one copy from mother)
  paternal H01 (one copy from father)
Disomy: H11 (one copy each mother and father)
Simple trisomy, no crossovers considered:
  Maternal: H21_matched (two identical copies from mother, one copy from father), H21_unmatched (BOTH copies from mother, one copy from father)
  Paternal: H12_matched (one copy from mother, two identical copies from father), H12_unmatched (one copy from mother, both copies from father)
Composite trisomy, allowing for crossovers (using a joint distribution model):
  maternal H21 (two copies from mother, one from father),
  paternal H12 (one copy from mother, two copies from father)
In other embodiments, other ploidy states, such as nullsomy (H00), uniparental disomy (H20 and H02), and tetrasomy (H04, H13, H22, H31 and H40), may be considered.

If there are no crossovers, each trisomy, whether the origin was mitosis, meiosis I, or meiosis II, would be one of the matched or unmatched trisomies. Due to crossovers, true trisomy is usually a combination of the two. First, a method to derive hypothesis likelihoods for simple hypotheses is described. Then a method to derive hypothesis likelihoods for composite hypotheses is described, combining individual SNP likelihood with crossovers.

LIK(D|H) for a Simple Hypothesis

In an embodiment, LIK(D|H) may be determined for simple hypotheses, as follows. For simple hypotheses H, LIK(H), the log likelihood of hypothesis H on a whole chromosome, may be calculated as the sum of log likelihoods of individual SNPs, assuming known or derived child fraction cf. In an embodiment it is possible to derive cf from the data.

$$LIK(D|H) = \sum_i LIK(D|H, cf, i)$$

This hypothesis does not assume any linkage between SNPs, and therefore does not utilize a joint distribution model.

In some embodiments, the Log Likelihood may be determined on a per SNP basis. On a particular SNP i, assuming fetal ploidy hypothesis H and percent fetal DNA cf, log likelihood of observed data D is defined as:

$$LIK(D|H, i) = \log P(D|H, cf, i) =$$

$$\log\left(\sum_{m,f,c} P(D|m, f, c, H, cf, i)P(c|m, f, H)P(m|i)P(f|i)\right)$$

where m are possible true mother genotypes, f are possible true father genotypes, where m,f∈{AA,AB,BB}, and c are possible child genotypes given the hypothesis H. In particular, for monosomy c∈{A, B}, for disomy c∈{AA, AB, BB}, for trisomy c∈{AAA, AAB, ABB, BBB}.

Genotype prior frequency: p(m|i) is the general prior probability of mother genotype m on SNP i, based on the known population frequency at SNP I, denoted $pA_i$. In particular $p(AA|pA_i)=(pA_i)^2, p(AB|pA_i)=2(pA_i)*(1-pA_i), p(BB|pA_i)=(1-pA_i)^2$ Father genotype probability, p(f|i), may be determined in an analogous fashion.

True child probability: p(c|m, f, H) is the probability of getting true child genotype=c, given parents m, f, and assuming hypothesis H, which can be easily calculated. For example, for H11, H21 matched and H21 unmatched, p(c|m, f,H) is given below.

| | | p(c|m, f, H) | | | | | | | | | | |
|---|---|---|---|---|---|---|---|---|---|---|---|---|
| | | H11 | | | H21 matched | | | | H2 unmatched | | | |
| m | f | AA | AB | BB | AAA | AAB | ABB | BBB | AAA | AAB | ABB | BBB |
| AA | AA | 1 | 0 | 0 | 1 | 0 | 0 | 0 | 1 | 0 | 0 | 0 |
| AB | AA | 0.5 | 0.5 | 0 | 0.5 | 0 | 0.5 | 0 | 0 | 1 | 0 | 0 |
| BB | AA | 0 | 1 | 0 | 0 | 0 | 1 | 0 | 0 | 0 | 1 | 0 |
| AA | AB | 0.5 | 0.5 | 0 | 0.5 | 0.5 | 0 | 0 | 0.5 | 0.5 | 0 | 0 |
| AB | AB | 0.25 | 0.5 | 0.25 | 0.25 | 0.25 | 0.25 | 0.25 | 0 | 0.5 | 0.5 | 0 |
| BB | AB | 0 | 0.5 | 0.5 | 0 | 0 | 0.5 | 0.5 | 0 | 0 | 0.5 | 0.5 |
| AA | BB | 0 | 1 | 0 | 0 | 1 | 0 | 0 | 0 | 1 | 0 | 0 |
| AB | BB | 0 | 0.5 | 0.5 | 0 | 0.5 | 0 | 0.5 | 0 | 0 | 1 | 0 |
| BB | BB | 0 | 0 | 1 | 0 | 0 | 0 | 1 | 0 | 0 | 0 | 1 |

Data likelihood: P(D|m, f, c, H, i, cf) is the probability of given data D on SNP i, given true mother genotype m, true father genotype f, true child genotype c, hypothesis H and child fraction cf. It can be broken down into the probability of mother, father and child data as follows:

$P(D|m,f,c,H,cf,i) = P(SM|m,i)P(M|m,i)P(SF|f,i)P(F|f,i)$
$P(S|m,c,H,cf,i)$

Mother SNP array data likelihood: Probability of mother SNP array genotype data $m_i$ at SNP i compared to true genotype m, assuming SNP array genotypes are correct, is simply $$P(M|m, i) = \begin{cases} 1 & m_i = m \\ 0 & m_i \neq m \end{cases}$$

Mother sequence data likelihood: the probability of the mother sequence data at SNP i, in the case of counts $S_i=(am_i,bm_i)$, with no extra noise or bias involved, is the binomial probability defined as $P(SM|m,i)=P_{X|m}(am_i)$ where $X|m \sim \text{Binom}(p_m(A), am_i+bm_i)$ with $p_m(A)$ defined as

| m | AA | AB | BB | A | B | nocall |
|---|----|----|----|---|---|--------|
| p(A) | 1 | 0.5 | 0 | 1 | 0 | 0.5 |

Father data likelihood: a similar equation applies for father data likelihood.

Note that it is possible to determine the child genotype without the parent data, especially father data. For example if no father genotype data F is available, one may just use P(F|f, i)=1. If no father sequence data SF is available, one may just use P(F|f,i)=1.

In some embodiments, the method involves building a joint distribution model for the expected allele counts at a plurality of polymorphic loci on the chromosome for each ploidy hypothesis; one method to accomplish such an end is described here. Free fetal DNA data likelihood: P(S|m, c, H, cf, i) is the probability of free fetal DNA sequence data on SNP i, given true mother genotype m, true child genotype c, child copy number hypothesis H, and assuming child fraction cf. It is in fact the probability of sequence data S on SNP I, given the true probability of A content on SNP i $\mu(m, c, cf, H)$ $$P(S|m,c,H,cf,i)=P(S|\mu(m,c,cf,H),i)$$

For counts, where $S_i=(a_i,b_i)$, with no extra noise or bias in data involved, $$P(S|\mu(m,c,cf,H),i)=P_x(a_i)$$

where $X \sim \text{Binom}(p(A), a_i+b_i)$ with $p(A)=\mu(m, c, cf, H)$. In a more complex case where the exact alignment and (A,B) counts per SNP are not known, $P(S|\mu(m, c, cf, H), i)$ is a combination of integrated binomials.

True A content probability: $\mu(m, c, cf, H)$, the true probability of A content on SNP i in this mother/child mixture, assuming that true mother genotype=m, true child genotype=c, and overall child fraction=cf, is defined as $$\mu(m, c, cf, H) = \frac{\#A(m)*(1-cf) + \#A(c)*cf}{n_m*(1-cf) + n_c*cf}$$

where #A(g)=number of A's in genotype g, $n_m=2$ is somy of mother and $n_c$ is ploidy of the child under hypothesis H (1 for monosomy, 2 for disomy, 3 for trisomy).

Using A Joint Distribution Model: LIK(D|H) for a Composite Hypothesis

In some embodiments, the method involves building a joint distribution model for the expected allele counts at the plurality of polymorphic loci on the chromosome for each ploidy hypothesis; one method to accomplish such an end is described here. In many cases, trisomy is usually not purely matched or unmatched, due to crossovers, so in this section results for composite hypotheses H21 (maternal trisomy) and H12 (paternal trisomy) are derived, which combine matched and unmatched trisomy, accounting for possible crossovers.

In the case of trisomy, if there were no crossovers, trisomy would be simply matched or unmatched trisomy. Matched trisomy is where child inherits two copies of the identical chromosome segment from one parent. Unmatched trisomy is where child inherits one copy of each homologous chromosome segment from the parent. Due to crossovers, some segments of a chromosome may have matched trisomy, and other parts may have unmatched trisomy. Described in this section is how to build a joint distribution model for the heterozygosity rates for a set of alleles; that is, for the expected allele counts at a number of loci for one or more hypotheses.

Suppose that on SNP i, LIK(D|Hm, i) is the fit for matched hypothesis $H_m$, and LIK(D|Hu, i) is the fit for unmatched hypothesis $H_u$, and pc(i)=probability of crossover between SNPs i−1 and i. One may then calculate the full likelihood as:

$$LIK(D|H)=\Sigma_E LIK(D|E,1:N)$$

where LIK(D|E, 1: N) is the likelihood of ending in hypothesis E, for SNPs 1:N. E=hypothesis of the last SNP, E∈(Hm, Hu). Recursively, one may calculate:

$$LIK(D|E,1:i)=LIK(D|E,i)+\log(\exp(LIK(D|E,1:i-1))* (1-pc(i)) +\exp(LIK(D|\sim E,1:i-1))*pc(i))$$

where ~E is the hypothesis other than E (not E), where hypotheses considered are $H_m$ and $H_u$. In particular, one may calculate the likelihood of 1:i SNPs, based on likelihood of 1 to (i−1) SNPs with either the same hypothesis and no crossover, or the opposite hypothesis and a crossover, multiplied by the likelihood of the SNP i For $SNP1, i=1, LIK(D|E,1:1)=LIK(D|E,1)$.

For $SNP2, i=2, LIK(D|E,1:2)=LIK(D|E,2)+\log(\exp (LIK(D|E,1))*(1-pc(2))+\exp(LIK(D|\sim E,1))*pc (2))$, and so on for i=3:N.

In some embodiments, the child fraction may be determined. The child fraction may refer to the proportion of sequences in a mixture of DNA that originate from the child. In the context of non-invasive prenatal diagnosis, the child fraction may refer to the proportion of sequences in the maternal plasma that originate from the fetus or the portion of the placenta with fetal genotype. It may refer to the child fraction in a sample of DNA that has been prepared from the maternal plasma, and may be enriched in fetal DNA. One purpose of determining the child fraction in a sample of DNA is for use in an algorithm that can make ploidy calls on the fetus, therefore, the child fraction could refer to whatever sample of DNA was analyzed by sequencing for the purpose of non-invasive prenatal diagnosis.

Some of the algorithms presented in this disclosure that are part of a method of non-invasive prenatal aneuploidy diagnosis assume a known child fraction, which may not always the case. In an embodiment, it is possible to find the most likely child fraction by maximizing the likelihood for disomy on selected chromosomes, with or without the presence of the parental data In particular, suppose that LIK(D|H11, cf, chr)=log likelihood as described above, for the disomy hypothesis, and for child fraction cf on chromosome chr. For selected chromosomes in Cset (usually 1:16), assumed to be euploid, the full likelihood is:

$$LIK(cf) = \Sum_{chr \in Cset} Lik(D|H11, cf, chr)$$

The most likely child fraction (cf*) is derived as $$cf^* = \underset{cf}{\mathrm{argmax}}\, LIK(cf).$$

It is possible to use any set of chromosomes. It is also possible to derive child fraction without assuming euploidy on the reference chromosomes. Using this method it is possible to determine the child fraction for any of the following situations: (1) one has array data on the parents and shotgun sequencing data on the maternal plasma; (2) one has array data on the parents and targeted sequencing data on the maternal plasma; (3) one has targeted sequencing data on both the parents and maternal plasma; (4) one has targeted sequencing data on both the mother and the maternal plasma fraction; (5) one has targeted sequencing data on the maternal plasma fraction; (6) other combinations of parental and child fraction measurements.

In some embodiments the informatics method may incorporate data dropouts; this may result in ploidy determinations of higher accuracy. Elsewhere in this disclosure it has been assumed that the probability of getting an A is a direct function of the true mother genotype, the true child genotype, the fraction of the child in the mixture, and the child copy number. It is also possible that mother or child alleles can drop out, for example instead of measuring true child AB in the mixture, it may be the case that only sequences mapping to allele A are measured. One may denote the parent dropout rate for genomic illumina data $d_{pg}$, parent dropout rate for sequence data $d_{ps}$ and child dropout rate for sequence data $d_{cs}$. In some embodiments, the mother dropout rate may be assumed to be zero, and child dropout rates are relatively low; in this case, the results are not severely affected by dropouts. In some embodiments the possibility of allele dropouts may be sufficiently large that they result in a significant effect of the predicted ploidy call. For such a case, allele dropouts have been incorporated into the algorithm here:

Parent SNP array data dropouts: For mother genomic data M, suppose that the genotype after the dropout is md, then $$P(M|m, i) = \sum_{m_d} P(M|m_d, i) P(m_d|m)$$

where $$P(M|m_d, i) = \begin{cases} 1 & m_i = m_d \\ 0 & m_i \neq m_d \end{cases}$$

as before, and $P(m_d|m)$ is the likelihood of genotype and after the possible dropout given the true genotype m, defined as below, for dropout rate d

| m | md | | | | | |
|---|---|---|---|---|---|---|
|   | AA | AB | BB | A | B | nocall |
| AA | $(1-d)^2$ | 0 | 0 | $2d(1-d)$ | 0 | $d^2$ |
| AB | 0 | $(1-d)^2$ | 0 | $d(1-d)$ | $d(1-d)$ | $d^2$ |
| BB | 0 | 0 | $(1-d)^2$ | 0 | $2d(1-d)$ | $d^2$ |

A similar equation applies for father SNP array data.

Parent sequence data dropouts: For mother sequence data SM $$P(SM|m, i) = \sum_{m_d} P_{X|m_d}(am_i) P(m_d|m)$$

where $P(m_d|m)$ is defined as in previous section and $P_{X|m_d}(am_i)$ probability from a binomial distribution is defined as before in the parent data likelihood section. A similar equation applies to the paternal sequence data.

Free floating DNA sequence data dropout:

$$P(S|m, c, H, cf, i) = \sum_{m_d, c_d} P(S|\mu(m_d, c_d, cf, H), i) P(m_d|m) P(c_d|c)$$

where $P(S|\mu(m_d, c_d, cf, H), i)$ is as defined in the section on free floating data likelihood.

In an embodiment, $p(m_d|m)$ is the probability of observed mother genotype $m_d$, given true mother genotype m, assuming dropout rate $d_{ps}$, and $p(c_d|c)$ is the probability of observed child genotype $c_d$, given true child genotype c, assuming dropout rate $d_{cs}$. If $nA_T$=number of A alleles in true genotype c, $nA_D$=number of A alleles in observed genotype $c_d$, where $nA_T \geq nA_D$, and similarly $nB_T$=number of B alleles in true genotype c, $nB_D$=number of B alleles in observed genotype $c_d$, where $nB_T \geq nB_D$ and d=dropout rate, then $$p(c_d|c) = \binom{nA_T}{nA_D} * d^{nA_T - nA_D} * (1-d)^{nA_D} * \binom{nB_T}{nB_D} * d^{nB_T - nB_D} * (1-d)^{nB_D}$$

In an embodiment, the informatics method may incorporate random and consistent bias. In an ideal word there is no per SNP consistent sampling bias or random noise (in addition to the binomial distribution variation) in the number of sequence counts. In particular, on SNP i, for mother genotype m, true child genotype c and child fraction cf, and X=the number of A's in the set of (A+B) reads on SNP i, X acts like a X~Binomial (p, A+B), where p=$\mu$(m, c, cf, H) = true probability of A content.

In an embodiment, the informatics method may incorporate random bias. As is often the case, suppose that there is a bias in the measurements, so that the probability of getting an A on this SNP is equal to q, which is a bit different than p as defined above. How much different p is from q depends on the accuracy of the measurement process and number of other factors and can be quantified by standard deviations of q away from p. In an embodiment, it is possible to model q as having a beta distribution, with parameters $\alpha$, $\beta$ depending on the mean of that distribution being centered at p, and some specified standard deviation s. In particular, this gives $X|q \sim \text{Bin}(q, D_i)$, where $q \sim \text{Beta}(\alpha, \beta)$. If we let $E(q)=p$, $V(q)=s^2$, and parameters $\alpha$, $\beta$ can be derived as $\alpha=pN$, $\beta=(1-p)N$, where $$N = \frac{p(1-p)}{s^2} - 1.$$

This is the definition of a beta-binomial distribution, where one is sampling from a binomial distribution with variable parameter q, where q follows a beta distribution with mean p. So, in a setup with no bias, on SNP i, the parent sequence data (SM) probability assuming true mother genotype (m), given mother sequence A count on SNP i ($am_i$) and mother sequence B count on SNP i ($bm_i$) may be calculated as:

$P(SM|m,i) = P_{X|m}(am_i)$ where $X|m \sim \text{Binom}(p_m(A), am_i+bm_i)$

Now, including random bias with standard deviation s, this becomes:

$X|m \sim \text{BetaBinom}(p_m(A), am_i+bm_i, s)$

In the case with no bias, the maternal plasma DNA sequence data (S) probability assuming true mother genotype (m), true child genotype (c), child fraction (cf), assuming child hypothesis H, given free floating DNA sequence A count on SNP i ($a_i$) and free floating sequence B count on SNP i ($b_i$) may be calculated as $P(S|m,c,cf,H,) = P_x(a_i)$ where $X \sim \text{Binom}(p(A), a_i+b_i)$ with $p(A)=\mu(m, c, cf, H)$.

In an embodiment, including random bias with standard deviation s, this becomes $X \sim \text{BetaBinom}(p(A), a_i+b_i, s)$, where the amount of extra variation is specified by the deviation parameter s, or equivalently N. The smaller the value of s (or the larger the value of N) the closer this distribution is to the regular binomial distribution. It is possible to estimate the amount of bias, i.e. estimate N above, from unambiguous contexts AA|AA, BB|BB, AA|BB, BB|AA and use estimated $\hat{N}$ in the above probability. Depending on the behavior of the data, N may be made to be a constant irrespective of the depth of read $a_i+b_i$, or a function of $a_i+b_i$, making bias smaller for larger depths of read.

In an embodiment, the informatics method may incorporate consistent per-SNP bias. Due to artifacts of the sequencing process, some SNPs may have consistently lower or higher counts irrespective of the true amount of A content. Suppose that SNP i consistently adds a bias of $w_i$ percent to the number of A counts. In some embodiments, this bias can be estimated from the set of training data derived under same conditions, and added back in to the parent sequence data estimate as:

$P(SM|m,i) = P_{X|m}(am_i)$ where $X|m \sim \text{BetaBinom}(p_m(A)+w_i, am_i+bm_i, s)$ and with the free floating DNA sequence data probability estimate as:

$P(S|m,c,cf,H,i) = P_x(a_i)$ where $X \sim \text{BetaBinom}(p(A)+w_i, a_i+b_i, s)$, In some embodiments, the method may be written to specifically take into account additional noise, differential sample quality, differential SNP quality, and random sampling bias. An example of this is given here. This method has been shown to be particularly useful in the context of data generated using the massively multiplexed mini-PCR protocol, and was used in Experiments 7 through 13. The method involves several steps that each introduce different kind of noise and/or bias to the final model:

(1) Suppose the first sample that comprises a mixture of maternal and fetal DNA contains an original amount of DNA of size=$N_0$ molecules, usually in the range 1,000-40,000, where p =true % refs (2) In the amplification using the universal ligation adaptors, assume that $N_1$ molecules are sampled; usually $N_1 \sim N_0/2$ molecules and random sampling bias is introduced due to sampling. The amplified sample may contain a number of molecules $N_2$ where $N_2 \gg N_1$. Let $X_1$ represent the amount of reference loci (on per SNP basis) out of $N_1$ sampled molecules, with a variation in $p_1=X_1/N_1$ that introduces random sampling bias throughout the rest of protocol. This sampling bias is included in the model by using a Beta-Binomial (BB) distribution instead of using a simple Binomial distribution model. Parameter N of the Beta-Binomial distribution may be estimated later on per sample basis from training data after adjusting for leakage and amplification bias, on SNPs with $0<p<1$. Leakage is the tendency for a SNP to be read incorrectly.

(3) The amplification step will amplify any allelic bias, thus amplification bias introduced due to possible uneven amplification. Suppose that one allele at a locus is amplified f times another allele at that locus is amplified g times, where $f=ge^b$, where b=0 indicates no bias. The bias parameter, b, is centered at 0, and indicates how much more or less the A allele get amplified as opposed to the B allele on a particular SNP. The parameter b may differ from SNP to SNP. Bias parameter b may be estimated on per SNP basis, for example from training data.

(4) The sequencing step involves sequencing a sample of amplified molecules. In this step there may be leakage, where leakage is the situation where a SNP is read incorrectly. Leakage may result from any number of problems, and may result in a SNP being read not as the correct allele A, but as another allele B found at that locus or as an allele C or D not typically found at that locus. Suppose the sequencing measures the sequence data of a number of DNA molecules from an amplified sample of size $N_3$, where $N_3 < N_2$. In some embodiments, $N_3$ may be in the range of 20,000 to 100,000; 100,000 to 500,000; 500,000 to 4,000,000; 4,000,000 to 20,000,000; or 20,000,000 to 100,000,000. Each molecule sampled has a probability $p_g$ of being read correctly, in which case it will show up correctly as allele A. The sample will be incorrectly read as an allele unrelated to the original molecule with probability $1-p_g$, and will look like allele A with probability $p_r$, allele B with probability $p_m$ or allele C or allele D with probability $p_o$, where $p_r+p_m+p_o=1$. Parameters $p_g$, $p_r$, $p_m$, $p_o$ are estimated on per SNP basis from the training data.

Different protocols may involve similar steps with variations in the molecular biology steps resulting in different amounts of random sampling, different levels of amplification and different leakage bias. The following model may be equally well applied to each of these cases. The model for the amount of DNA sampled, on per SNP basis, is given by:

$X_3 \sim \text{BetaBinomial}(L(F(p,b), p_r, p_g), N^*H(p,b))$ where p=the true amount of reference DNA, b=per SNP bias, and as described above, $p_g$ is the probability of a correct read, $p_r$ is the probability of read being read incorrectly but serendipitously looking like the correct allele, in case of a bad read, as described above, and:

$F(p,b) = pe^b/(pe^b+(1-p)), H(p,b) = (e^bp+(1-p))^2/e^b, L(p, p_r, p_g) = p^*p_g + p_r^*(1-p_g)$.

In some embodiments, the method uses a Beta-Binomial distribution instead of a simple binomial distribution; this takes care of the random sampling bias. Parameter N of the Beta-Binomial distribution is estimated on per sample basis on an as needed basis. Using bias correction F(p,b), H(p,b), instead of just p, takes care of the amplification bias. Parameter b of the bias is estimated on per SNP basis from training data ahead of time.

In some embodiments the method uses leakage correction $L(p,p_r,p_g)$, instead of just p; this takes care of the leakage bias, i.e. varying SNP and sample quality. In some embodiments, parameters $p_g$, $p_r$, $p_o$ are estimated on per SNP basis from the training data ahead of time. In some embodiments, the parameters $p_g$, $p_r$, $p_o$ may be updated with the current sample on the go, to account for varying sample quality.

The model described herein is quite general and can account for both differential sample quality and differential SNP quality. Different samples and SNPs are treated differently, as exemplified by the fact that some embodiments use Beta-Binomial distributions whose mean and variance are a function of the original amount of DNA, as well as sample and SNP quality.

Platform Modeling

Consider a single SNP where the expected allele ratio present in the plasma is r (based on the maternal and fetal genotypes). The expected allele ratio is defined as the expected fraction of A alleles in the combined maternal and fetal DNA. For maternal genotype $g_m$ and child genotype $g_c$, the expected allele ratio is given by equation 1, assuming that the genotypes are represented as allele ratios as well.

$$r = f g_c + (1-f) g_m \qquad (1)$$

The observation at the SNP consists of the number of mapped reads with each allele present, $n_a$ and $n_b$, which sum to the depth of read d. Assume that thresholds have already been applied to the mapping probabilities and phred scores such that the mappings and allele observations can be considered correct. A phred score is a numerical measure that relates to the probability that a particular measurement at a particular base is wrong. In an embodiment, where the base has been measured by sequencing, the phred score may be calculated from the ratio of the dye intensity corresponding to the called base to the dye intensity of the other bases. The simplest model for the observation likelihood is a binomial distribution which assumes that each of the d reads is drawn independently from a large pool that has allele ratio r. Equation 2 describes this model.

$$P(n_a, n_b | r) = p_{bino}(n_a; n_a + n_b, r) = \binom{n_a + n_b}{n_a} r^{n_a} (1-r)^{n_b} \qquad (2)$$

The binomial model can be extended in a number of ways. When the maternal and fetal genotypes are either all A or all B, the expected allele ratio in plasma will be 0 or 1, and the binomial probability will not be well-defined. In practice, unexpected alleles are sometimes observed in practice. In an embodiment, it is possible to use a corrected allele ratio $\hat{r} = 1/(n_a + n_b)$ to allow a small number of the unexpected allele. In an embodiment, it is possible to use training data to model the rate of the unexpected allele appearing on each SNP, and use this model to correct the expected allele ratio. When the expected allele ratio is not 0 or 1, the observed allele ratio may not converge with a sufficiently high depth of read to the expected allele ratio due to amplification bias or other phenomena. The allele ratio can then be modeled as a beta distribution centered at the expected allele ratio, leading to a beta-binomial distribution for $P(n_a, n_b | r)$ which has higher variance than the binomial.

The platform model for the response at a single SNP will be defined as $F(a, b, g_c, g_m, f)$ (3), or the probability of observing $n_a = a$ and $n_b = b$ given the maternal and fetal genotypes, which also depends on the fetal fraction through equation 1. The functional form of F may be a binomial distribution, beta-binomial distribution, or similar functions as discussed above.

$$F(a,b,g_c,g_m,f) = P(n_a=a, n_b=b | g_c, g_m, f) = P(n_a=a, n_b=b | r(g_c, g_m, f)) \qquad (3)$$

In an embodiment, the child fraction may be determined as follows. A maximum likelihood estimate of the fetal fraction f for a prenatal test may be derived without the use of paternal information. This may be relevant where the paternal genetic data is not available, for example where the father of record is not actually the genetic father of the fetus. The fetal fraction is estimated from the set of SNPs where the maternal genotype is 0 or 1, resulting in a set of only two possible fetal genotypes. Define $S_0$ as the set of SNPs with maternal genotype 0 and $S_1$ as the set of SNPs with maternal genotype 1. The possible fetal genotypes on $S_0$ are 0 and 0.5, resulting in a set of possible allele ratios $R_0(f) = \{0, f/2\}$. Similarly, $R_1(f) = \{1-f/2, 1\}$. This method can be trivially extended to include SNPs where maternal genotype is 0.5, but these SNPs will be less informative due to the larger set of possible allele ratios.

Define $N_{a0}$ and $N_{b0}$ as the vectors formed by $n_{as}$ and $n_{bs}$ for SNPs s in $S_0$, and $N_{a1}$ and $N_{b1}$ similarly for $S_1$. The maximum likelihood estimate $\hat{f}$ off is defined by equation 4.

$$\hat{f} = \arg\max_f P(N_{a0}, N_{b0} | f) P(N_{a1}, N_{b1} | f) \qquad (4)$$

Assuming that the allele counts at each SNP are independent conditioned on the SNP's plasma allele ratio, the probabilities can be expressed as products over the SNPs in each set (5).

$$P(N_{a0}, N_{b0} | f) = \Pi_{s \in S_0} P(n_{as}, n_{bs} | f)$$

$$P(N_{a1}, N_{b1} | f) = \Pi_{s \in S_1} P(n_{as}, n_{bs} | f) \qquad (5)$$

The dependence on f is through the sets of possible allele ratios $R_0(f)$ and $R_1(f)$. The SNP probability $P(n_{as}, n_{b\,s} | f)$ can be approximated by assuming the maximum likelihood genotype conditioned on f. At reasonably high fetal fraction and depth of read, the selection of the maximum likelihood genotype will be high confidence. For example, at fetal fraction of 10 percent and depth of read of 1000, consider a SNP where the mother has genotype zero. The expected allele ratios are 0 and 5 percent, which will be easily distinguishable at sufficiently high depth of read. Substitution of the estimated child genotype into equation 5 results in the complete equation (6) for the fetal fraction estimate.

$$\hat{f} = \arg\max_f \left[ \prod_{s \in S_0} (\max_{r_s \in R_0(f)} P(n_{as}, n_{bs} | r_s)) \prod_{s \in S_1} (\max_{r_s \in R_1(f)} P(n_{as}, n_{bs} | r_s)) \right] \qquad (6)$$

The fetal fraction must be in the range [0, 1] and so the optimization can be easily implemented by a constrained one-dimensional search.

In the presence of low depth of read or high noise level, it may be preferable not to assume the maximum likelihood genotype, which may result in artificially high confidences. Another method would be to sum over the possible genotypes at each SNP, resulting in the following expression (7) for $P(n_a, n_b|f)$ for a SNP in $S_0$. The prior probability $P(r)$ could be assumed uniform over $R_0(f)$, or could be based on population frequencies. The extension to group $S_1$ is trivial.

$$P(n_a, n_b|f) = \Sigma_{r \in R_0(f)} P(n_a, n_a|r) P(r) \quad (7)$$

In some embodiments the probabilities may be derived as follows. A confidence can be calculated from the data likelihoods of the two hypotheses $H_t$ and $H_f$. The likelihood of each hypothesis is derived based on the response model, the estimated fetal fraction, the mother genotypes, allele population frequencies, and the plasma allele counts.

Define the following notation:
$G_m$, $G_c$ true maternal and child genotypes
$G_{af}$, $G_{tf}$ true genotypes of alleged father and of true father
$G(g_c, g_m, g_{tf}) = P(G_c = g_c | G_m = g_m, G_{tf} = g_{tf})$ inheritance probabilities
$P(g) = P(G_{tf} = g)$ population frequency of genotype g at particular SNP Assuming that the observation at each SNP is independent conditioned on the plasma allele ratio, the likelihood of a paternity hypothesis is the product of the likelihoods on the SNPs. The following equations derive the likelihood for a single SNP. Equation 8 is a general expression for the likelihood of any hypothesis h, which will then be broken down into the specific cases of $H_t$ and $H_f$.

$$P(n_a, n_b | h, G_m, G_{tf}, f) = \quad (8)$$
$$\sum_{g_c \in (0, 0.5, 1)} P(n_a, n_b | G_c = g_c, G_m, G_{tf}, h, f)$$
$$P(G_c = g_c, G_m, G_{tf}, h, f) =$$
$$\sum_{g_c \in (0, 0.5, 1)} P(n_a, n_b | G_c = g_c, G_m, f) P(G_c = g_c | G_m, G_{tf}, h) =$$
$$\sum_{g_c \in (0, 0.5, 1)} F(n_a, n_b, g_c, g_m, f) P(G_c = g_c | G_m, G_{tf}, h)$$

In the case of $H_t$, the alleged father is the true father and the fetal genotypes are inherited from the maternal genotypes and alleged father genotypes according to equation 9.

$$P(n_a, n_b | H_t, G_m, G_{tf}, f) = \quad (9)$$
$$\sum_{g_c \in (0, 0.5, 1)} F(n_a, n_b, g_c, g_m, f) P(G_c = g_c | G_m, G_{tf}, H_t) =$$
$$\sum_{g_c \in (0, 0.5, 1)} F(n_a, n_b, g_c, g_m, f) G(g_c, G_m, G_{tf})$$

In the case of $H_f$, the alleged father is not the true father. The best estimate of the true father genotypes are given by the population frequencies at each SNP. Thus, the probabilities of child genotypes are determined by the known mother genotypes and the population frequencies, as in equation 10.

$$P(n_a, n_b | H_t, G_m, G_{tf}, f) =$$
$$\sum_{g_c \in (0, 0.5, 1)} F(n_a, n_b, g_c, g_m, f) P(G_c = g_c | G_m, G_{tf}, H_f) =$$
$$\sum_{g_c \in (0, 0.5, 1)} F(n_a, n_b, g_c, g_m, f) P(G_c = g_c | G_m) =$$

$$\sum_{g_c \in (0, 0.5, 1)} \sum_{g_{tf} \in (0, 0.5, 1)} F(n_a, n_b, g_c, g_m, f)$$
$$P(G_c = g_c | G_m, G_{tf} = g_{tf}) P(G_{tf} = g_{tf}) =$$
$$\sum_{g_c \in (0, 0.5, 1)} \sum_{g_{tf} \in (0, 0.5, 1)} F(n_a, n_b, g_c, g_m, f) G(g_c, G_m, g_{tf}) P(g_{tf})$$

The confidence $C_p$ on correct paternity is calculated from the product over SNPs of the two likelihoods using Bayes rule (11).

$$C_p = \frac{\prod_s P(n_{as}, n_{bs} | H_t, G_{ms}, G_{tf}, f)}{\prod_s P(n_{as}, n_{bs} | H_t, G_{ms}, G_{tf}, f) + \prod_s P(n_{as}, n_{bs} | H_f, G_{ms}, G_{tf}, f)} \quad (11)$$

Exemplary Methods for Identifying and Analyzing Multiple Pregnancies

In some embodiments, any of the methods of the present invention are used to detect the presence of a multiple pregnancy, such as a twin pregnancy, where at least one of the fetuses is genetically different from at least one other fetus. In some embodiments, fraternal twins are identified based on the presence of two fetus with different allele, different allele ratios, or different allele distributions at some (or all) of the tested loci. In some embodiments, fraternal twins are identified by determining the expected allele ratio at each locus (such as SNP loci) for two fetuses that may have the same or different fetal fractions in the sample (such as a plasma sample). In some embodiments, the likelihood of a particular pair of fetal fractions (where f1 is the fetal fraction for fetus 1, and f2 is the fetal fraction for fetus 2) is calculated by considering some or all of the possible genotypes of the two fetuses, conditioned on the mother's genotype and genotype population frequencies. The mixture of two fetal and one maternal genotype, combined with the fetal fractions, determine the expected allele ratio at a SNP. For example, if the mother is AA, fetus 1 is AA, and fetus 2 is AB, the overall fraction of B allele at the SNP is one-half of f2. The likelihood calculation asks how well all of the SNPs together match the expected allele ratios based on all of the possible combinations of fetal genotypes. The fetal fraction pair (f1, f2) that best matches the data is selected. It is not necessary to calculated specific genotypes of the fetuses; instead, one can, for example, considered all of the possible genotypes in a statistical combination. In some embodiments, if the method does not distinguish between singleton and identical twins, an ultrasound can be performed to determine whether there is a singleton or identical twin pregnancy. If the ultrasound detects a twin pregnancy it can be assumed that the pregnancy is an identical twin pregnancy because a fraternal twin pregnancy would have been detected based on the SNP analysis discussed above.

In some embodiments, a pregnant mother is known to have a multiple pregnancy (such as a twin pregnancy) based on prior testing, such as an ultrasound. Any of the methods of the present invention can be used to determine whether the multiple pregnancy includes identical or fraternal twins. For example, the measured allele ratios can be compared to what would be expected for identical twins (the same allele ratios as a singleton pregnancy) or for fraternal twins (such as the calculation of allele ratios as described above). Some identical twins are monochorionic twins, which have a risk of twin-to-twin transfusion syndrome. Thus, twins determined to be identical twins using a method of the invention are desirably tested (such as by ultrasound) to determine if they are monochorionic twins, and if so, these twins can be monitored (such as bi-weekly ultrasounds from 16 weeks) for signs of win-to-twin transfusion syndrome.

In some embodiments, any of the methods of the present invention are used to determine whether any of the fetuses in a multiple pregnancy, such as a twin pregnancy, are aneuploid. Aneuploidy testing for twins begins with the fetal fraction estimate. In some embodiments, the fetal fraction pair (f1, f2) that best matches the data is selected as described above. In some embodiments, a maximum likelihood estimate is performed for the parameter pair (f1, f2) over the range of possible fetal fractions. In some embodiments, the range of f2 is from 0 to f1 because f2 is defined as the smaller fetal fraction. Given a pair (f1, f2), data likelihood is calculated from the allele ratios observed at a set of loci such as SNP loci. In some embodiments, the data likelihood reflects the genotypes of the mother, the father if available, population frequencies, and the resulting probabilities of fetal genotypes. In some embodiments, SNPs are assumed independent. The estimated fetal fraction pair is the one that produces the highest data likelihood. If f2 is 0 then the data is best explained by only one set of fetal genotypes, indicating identical twins, where f1 is the combined fetal fraction. Otherwise f1 and f2 are the estimates of the individual twin fetal fractions. Having established the best estimate of (f1, f2), one can predict the overall fraction of B allele in the plasma for any combination of maternal and fetal genotypes, if desired. It is not necessary to assign individual sequence reads to the individual fetuses. Ploidy testing is performed using another maximum likelihood estimate which compares the data likelihood of two hypotheses. In some embodiments for identical twins, one considers the hypotheses (i) both twins are euploid, and (ii) both twins are trisomic. In some embodiments for fraternal twins, one considers the hypotheses (i) both twins are euploid and (ii) at least one twin is trisomic. The trisomy hypotheses for fraternal twins are based on the lower fetal fraction, since a trisomy in the twin with a higher fetal fraction would also be detected. Ploidy likelihoods are calculated using a method which predicts the expected number of reads at each targeted genome locus conditioned on either the disomy or trisomy hypothesis. There is no requirement for a disomy reference chromosome. The variance model for the expected number of reads takes into account the performance of individual target loci as well as the correlation between loci (see, for example, U.S. Ser. No. 62/008,235, filed Jun. 5, 2014, and U.S. Ser. No. 62/032,785, filed Aug. 4, 2014, which are each hereby incorporated by reference in its entirety). If the smaller twin has fetal fraction f1, our ability to detect a trisomy in that twin is equivalent to our ability to detect a trisomy in a singleton pregnancy at the same fetal fraction. This is because the part of the method that detects the trisomy in some embodiments does not depend on genotypes and does not distinguish between multiple or singleton pregnancy. It simply looks for an increased number of reads in accordance with the determined fetal fraction.

In some embodiments, the method includes detecting the presence of twins based on SNP loci (such as described above). If twins are detected, SPNs are used to determine the fetal fraction of each fetus (f1, f2) such as described above. In some embodiments, samples that have high confidence disomy calls are used to determine the amplification bias on a per-SNP basis. In some embodiments, these samples with high confidence disomy calls are analyzed in the same run as one or more samples of interest. In some embodiments, the amplification bias on a per-SNP basis is used to model the distribution of reads for one or more chromosomes or chromosome segments of interest such as chromosome 21 that are expected or the disomy hypothesis and the trisomy hypothesis given the lower of the two twin fetal fraction. The likelihood or probability of disomy or trisomy is calculated given the two models and the measured quantity of the chromosome or chromosome segment of interest.

In some embodiments, the threshold for a positive aneuploidy call (such as a trisomy call) is set based on the twin with the lower fetal fraction. This way, if the other twin is positive, or if both are positive, the total chromosome representation is definitely above the threshold.

Maximum Likelihood Model Using Percent Fetal Fraction

Determining the ploidy status of a fetus by measuring the free floating DNA contained in maternal serum, or by measuring the genotypic material in any mixed sample, is a non-trivial exercise. There are a number of methods, for example, performing a read count analysis where the presumption is that if the fetus is trisomic at a particular chromosome, then the overall amount of DNA from that chromosome found in the maternal blood will be elevated with respect to a reference chromosome. One way to detect trisomy in such fetuses is to normalize the amount of DNA expected for each chromosome, for example, according to the number of SNPs in the analysis set that correspond to a given chromosome, or according to the number of uniquely mappable portions of the chromosome. Once the measurements have been normalized, any chromosomes for which the amount of DNA measured exceeds a certain threshold are determined to be trisomic. This approach is described in Fan, et al. PNAS, 2008; 105(42); pp. 16266-16271, and also in Chiu et al. BMJ 2011; 342:c7401. In the Chiu et al. paper, the normalization was accomplished by calculating a Z score as follows:

Z score for percentage chromosome 21 in test case= ((percentage chromosome 21 in test case)− (mean percentage chromosome 21 in reference controls))/(standard deviation of percentage chromosome 21 in reference controls).

These methods determine the ploidy status of the fetus using a single hypothesis rejection method. However, they suffer from some significant shortcomings. Since these methods for determining ploidy in the fetus are invariant according to the percentage of fetal DNA in the sample, they use one cut off value; the result of this is that the accuracies of the determinations are not optimal, and those cases where the percentage of fetal DNA in the mixture are relatively low will suffer the worst accuracies.

In an embodiment, a method of the present disclosure is used to determine the ploidy state of the fetus involves taking into account the fraction of fetal DNA in the sample. In another embodiment of the present disclosure, the method involves the use of maximum likelihood estimations. In an embodiment, a method of the present disclosure involves calculating the percent of DNA in a sample that is fetal or placental in origin. In an embodiment, the threshold for calling aneuploidy is adaptively adjusted based on the calculated percent fetal DNA. In some embodiments, the method for estimating the percentage of DNA that is of fetal origin in a mixture of DNA, comprises obtaining a mixed sample that comprises genetic material from the mother, and genetic material from the fetus, obtaining a genetic sample from the father of the fetus, measuring the DNA in the mixed sample, measuring the DNA in the father sample, and calculating the percentage of DNA that is of fetal origin in the mixed sample using the DNA measurements of the mixed sample, and of the father sample.

In an embodiment of the present disclosure, the fraction of fetal DNA, or the percentage of fetal DNA in the mixture can be measured. In some embodiments the fraction can be calculated using only the genotyping measurements made on the maternal plasma sample itself, which is a mixture of fetal and maternal DNA. In some embodiments the fraction may be calculated also using the measured or otherwise known genotype of the mother and/or the measured or otherwise known genotype of the father. In some embodiments the percent fetal DNA may be calculated using the measurements made on the mixture of maternal and fetal DNA along with the knowledge of the parental contexts. In an embodiment, the fraction of fetal DNA may be calculated using population frequencies to adjust the model on the probability on particular allele measurements.

In an embodiment of the present disclosure, a confidence may be calculated on the accuracy of the determination of the ploidy state of the fetus. In an embodiment, the confidence of the hypothesis of greatest likelihood ($H_{major}$) may be calculated as $(1-H_{major})/\Sigma(\text{all H})$. It is possible to determine the confidence of a hypothesis if the distributions of all of the hypotheses are known. It is possible to determine the distribution of all of the hypotheses if the parental genotype information is known. It is possible to calculate a confidence of the ploidy determination if the knowledge of the expected distribution of data for the euploid fetus and the expected distribution of data for the aneuploid fetus are known. It is possible to calculate these expected distributions if the parental genotype data are known. In an embodiment one may use the knowledge of the distribution of a test statistic around a normal hypothesis and around an abnormal hypothesis to determine both the reliability of the call as well as refine the threshold to make a more reliable call. This is particularly useful when the amount and/or percent of fetal DNA in the mixture is low. It will help to avoid the situation where a fetus that is actually aneuploid is found to be euploid because a test statistic, such as the Z statistic does not exceed a threshold that is made based on a threshold that is optimized for the case where there is a higher percent fetal DNA.

In an embodiment, a method disclosed herein can be used to determine a fetal aneuploidy by determining the number of copies of maternal and fetal target chromosomes in a mixture of maternal and fetal genetic material. This method may entail obtaining maternal tissue comprising both maternal and fetal genetic material; in some embodiments this maternal tissue may be maternal plasma or a tissue isolated from maternal blood. This method may also entail obtaining a mixture of maternal and fetal genetic material from said maternal tissue by processing the aforementioned maternal tissue. This method may entail distributing the genetic material obtained into a plurality of reaction samples, to randomly provide individual reaction samples that comprise a target sequence from a target chromosome and individual reaction samples that do not comprise a target sequence from a target chromosome, for example, performing high throughput sequencing on the sample. This method may entail analyzing the target sequences of genetic material present or absent in said individual reaction samples to provide a first number of binary results representing presence or absence of a presumably euploid fetal chromosome in the reaction samples and a second number of binary results representing presence or absence of a possibly aneuploid fetal chromosome in the reaction samples. Either of the number of binary results may be calculated, for example, by way of an informatics technique that counts sequence reads that map to a particular chromosome, to a particular region of a chromosome, to a particular locus or set of loci. This method may involve normalizing the number of binary events based on the chromosome length, the length of the region of the chromosome, or the number of loci in the set. This method may entail calculating an expected distribution of the number of binary results for a presumably euploid fetal chromosome in the reaction samples using the first number. This method may entail calculating an expected distribution of the number of binary results for a presumably aneuploid fetal chromosome in the reaction samples using the first number and an estimated fraction of fetal DNA found in the mixture, for example, by multiplying the expected read count distribution of the number of binary results for a presumably euploid fetal chromosome by $(1+n/2)$ where n is the estimated fetal fraction. In some embodiments, the sequence reads may be treated at probabilistic mappings rather than binary results; this method would yield higher accuracies, but require more computing power. The fetal fraction may be estimated by a plurality of methods, some of which are described elsewhere in this disclosure. This method may involve using a maximum likelihood approach to determine whether the second number corresponds to the possibly aneuploid fetal chromosome being euploid or being aneuploid. This method may involve calling the ploidy status of the fetus to be the ploidy state that corresponds to the hypothesis with the maximum likelihood of being correct given the measured data.

Note that the use of a maximum likelihood model may be used to increase the accuracy of any method that determines the ploidy state of a fetus. Similarly, a confidence maybe calculated for any method that determines the ploidy state of the fetus. The use of a maximum likelihood model would result in an improvement of the accuracy of any method where the ploidy determination is made using a single hypothesis rejection technique. A maximum likelihood model may be used for any method where a likelihood distribution can be calculated for both the normal and abnormal cases. The use of a maximum likelihood model implies the ability to calculate a confidence for a ploidy call.

Further Discussion of the Method

In an embodiment, a method disclosed herein utilizes a quantitative measure of the number of independent observations of each allele at a polymorphic locus, where this does not involve calculating the ratio of the alleles. This is different from methods, such as some microarray based methods, which provide information about the ratio of two alleles at a locus but do not quantify the number of independent observations of either allele. Some methods known in the art can provide quantitative information regarding the number of independent observations, but the calculations leading to the ploidy determination utilize only the allele ratios, and do not utilize the quantitative information. To illustrate the importance of retaining information about the number of independent observations consider the sample locus with two alleles, A and B. In a first experiment twenty A alleles and twenty B alleles are observed, in a second experiment 200 A alleles and 200 B alleles are observed. In both experiments the ratio $(A/(A+B))$ is equal to 0.5, however the second experiment conveys more information than the first about the certainty of the frequency of the A or B allele. The instant method, rather than utilizing the allele ratios, uses the quantitative data to more accurately model the most likely allele frequencies at each polymorphic locus.

In an embodiment, the instant methods build a genetic model for aggregating the measurements from multiple polymorphic loci to better distinguish trisomy from disomy and also to determine the type of trisomy. Additionally, the instant method incorporates genetic linkage information to enhance the accuracy of the method. This is in contrast to some methods known in the art where allele ratios are averaged across all polymorphic loci on a chromosome. The method disclosed herein explicitly models the allele frequency distributions expected in disomy as well as and trisomy resulting from nondisjunction during meiosis I, nondisjunction during meiosis II, and nondisjunction during mitosis early in fetal development. To illustrate why this is important, if there were no crossovers nondisjunction during meiosis I would result a trisomy in which two different homologs were inherited from one parent; nondisjunction during meiosis II or during mitosis early in fetal development would result in two copies of the same homolog from one parent. Each scenario results in different expected allele frequencies at each polymorphic locus and also at all physically linked loci (i.e. loci on the same chromosome) considered jointly. Crossovers, which result in the exchange of genetic material between homologs, make the inheritance pattern more complex, but the instant method accommodates for this by using genetic linkage information, i.e. recombination rate information and the physical distance between loci. To better distinguish between meiosis I nondisjunction and meiosis II or mitotic nondisjunction the instant method incorporates into the model an increasing probability of crossover as the distance from the centromere increases. Meiosis II and mitotic nondisjunction can be distinguished by the fact that mitotic nondisjunction typically results in identical or nearly identical copies of one homolog while the two homologs present following a meiosis II nondisjunction event often differ due to one or more crossovers during gametogenesis.

In an embodiment, a method of the present disclosure may not determine the haplotypes of the parents if disomy is assumed. In an embodiment, in case of trisomy, the instant method can make a determination about the haplotypes of one or both parents by using the fact that plasma takes two copies from one parent, and parent phase information can be determined by noting which two copies have been inherited from the parent in question. In particular, a child can inherit either two of the same copies of the parent (matched trisomy) or both copies of the parent (unmatched trisomy). At each SNP one can calculate the likelihood of the matched trisomy and of the unmatched trisomy. A ploidy calling method that does not use the linkage model accounting for crossovers would calculate the overall likelihood of the trisomy as a simple weighted average of the matched and unmatched trisomies over all chromosomes. However, due to the biological mechanisms that result in disjunction error and crossing over, trisomy can change from matched to unmatched (and vice versa) on a chromosome only if a crossover occurs. The instant method probabilistically takes into account the likelihood of crossover, resulting in ploidy calls that are of greater accuracy than those methods that do not.

In an embodiment, a reference chromosome is used to determine the child fraction and noise level amount or probability distribution. In an embodiment, the child fraction, noise level, and/or probability distribution is determined using only the genetic information available from the chromosome whose ploidy state is being determined. The instant method works without the reference chromosome, as well as without fixing the particular child fraction or noise level. This is a significant improvement and point of differentiation from methods known in the art where genetic data from a reference chromosome is necessary to calibrate the child fraction and chromosome behavior.

In an embodiment where a reference chromosome is not needed to determine the fetal fraction, determining the hypothesis is done as follows:

$$H^* = \underset{H}{\mathrm{argmax}} LIK(D|H) * priorprob(H)$$

With the algorithm with reference chromosome, one typically assumes that the reference chromosome is a disomy, and then one may either (a) fix the most likely child fraction and random noise level N based on this assumption and reference chromosome data:

$$[cfr^*, N^*] = \underset{cfr,N}{\mathrm{argmax}} LIK(D(ref.chrom)|H11, cfr, N)$$

And then reduce $$LIK(D|H) = LIK(D|H, cfr^*, N^*)$$

or (b) estimate the child fraction and noise level distribution based on this assumption and reference chromosome data. In particular, one would not fix just one value for cfr and N, but assign probability p(cfr, N) for the wider range of possible cfr, N values:

$$p(cfr,N) \sim LIK(D(ref.chrom)|H11, cfr, N) * priorprob(cfr, N)$$

where priorprob(cfr, N) is the prior probability of particular child fraction and noise level, determined by prior knowledge and experiments. If desired, just uniform over the range of cfr, N. One may then write:

$$LIK(D|H) = \sum_{cfr,N} LIK(D|H, cfr, N) * p(cfr, N)$$

Both methods above give good results.

Note that in some instances using a reference chromosome is not desirable, possible or feasible. In such a case, it is possible to derive the best ploidy call for each chromosome separately. In particular:

$$LIK(D|H) = \sum_{cfr,N} LIK(D|H, cfr, N) * p(cfr, N|H)$$

p(cfr, N|H) may be determined as above, for each chromosome separately, assuming hypothesis H, not just for the reference chromosome assuming disomy. It is possible, using this method, to keep both noise and child fraction parameters fixed, fix either of the parameters, or keep both parameters in probabilistic form for each chromosome and each hypothesis.

Measurements of DNA are noisy and/or error prone, especially measurements where the amount of DNA is small, or where the DNA is mixed with contaminating DNA. This noise results in less accurate genotypic data, and less accurate ploidy calls. In some embodiments, platform modeling or some other method of noise modeling may be used to counter the deleterious effects of noise on the ploidy determination. The instant method uses a joint model of both channels, which accounts for the random noise due to the amount of input DNA, DNA quality, and/or protocol quality.

This is in contrast to some methods known in the art where the ploidy determinations are made using the ratio of allele intensities at a locus. This method precludes accurate SNP noise modeling. In particular, errors in the measurements typically do not specifically depend on the measured channel intensity ratio, which reduces the model to using one-dimensional information. Accurate modeling of noise, channel quality and channel interaction requires a two-dimensional joint model, which can not be modeled using allele ratios.

In particular, projecting two channel information to the ratio r where $f(x,y)$ is $r=x/y$, does not lend itself to accurate channel noise and bias modeling. Noise on a particular SNP is not a function of the ratio, i.e. noise $(x,y) \neq f(x,y)$ but is in fact a joint function of both channels. For example, in the binomial model, noise of the measured ratio has a variance of $r(1-r)/(x+y)$ which is not a function purely of r. In such a model, where any channel bias or noise is included, suppose that on SNP i, the observed channel X value is $x=a_iX+b_i$, where X is the true channel value, $b_i$ is the extra channel bias and random noise. Similarly, suppose that $y=c_iY+d_i$. The observed ratio $r=x/y$ can not accurately predict the true ratio X/Y or model the leftover noise, since $(a_iX+b_i)/(c_iY+d_i)$ is not a function of X/Y.

The method disclosed herein describes an effective way to model noise and bias using joint binomial distributions of all of the measurement channels individually. Relevant equations may be found elsewhere in the document in sections which speaks of per SNP consistent bias, P(good) and P(ref|bad), P(mut|bad) which effectively adjust SNP behavior. In an embodiment, a method of the present disclosure uses a BetaBinomial distribution, which avoids the limiting practice of relying on the allele ratios only, but instead models the behavior based on both channel counts.

In an embodiment, a method disclosed herein can call the ploidy of a gestating fetus from genetic data found in maternal plasma by using all available measurements. In an embodiment, a method disclosed herein can call the ploidy of a gestating fetus from genetic data found in maternal plasma by using the measurements from only a subset of parental contexts. Some methods known in the art only use measured genetic data where the parental context is from the AA|BB context, that is, where the parents are both homozygous at a given locus, but for a different allele. One problem with this method is that a small proportion of polymorphic loci are from the AA|BB context, typically less than 10%. In an embodiment of a method disclosed herein, the method does not use genetic measurements of the maternal plasma made at loci where the parental context is AA|BB. In an embodiment, the instant method uses plasma measurements for only those polymorphic loci with the AA|AB, AB|AA, and AB|AB parental context.

Some methods known in the art involve averaging allele ratios from SNPs in the AA|BB context, where both parent genotypes are present, and claim to determine the ploidy calls from the average allele ratio on these SNPs. This method suffers from significant inaccuracy due differential SNP behavior. Note that this method assumes that have both parent genotypes are known. In contrast, in some embodiments, the instant method uses a joint channel distribution model that does not assume the presence of either of the parents, and does not assume the uniform SNP behavior. In some embodiments, the instant method accounts for the different SNP behavior/weighing. In some embodiments, the instant method does not require the knowledge of one or both parental genotypes. An example of how the instant method may accomplish this follows:

In some embodiments, the log likelihood of a hypothesis may be determined on a per SNP basis. On a particular SNP i, assuming fetal ploidy hypothesis H and percent fetal DNA cf, the log likelihood of observed data D is defined as:

$$LIK(D|H, i) = \log P(D|H, cf, i) = \log(\sum_{m,f,c} P(D|m, f, c, H, cf, i)P(c|m, f, H)P(m|i)P(f|i))$$

where m are possible true mother genotypes, f are possible true father genotypes, where m,f∈{AA,AB,BB}, and where c are possible child genotypes given the hypothesis H. In particular, for monosomy c {A, B}, for disomy c∈{AA, AB, BB}, for trisomy c∈{AAA, AAB, ABB, BBB}. Note that including parental genotypic data typically results in more accurate ploidy determinations, however, parental genotypic data is not necessary for the instant method to work well.

Some methods known in the art involve averaging allele ratios from SNPs where the mother is homozygous but a different allele is measured in the plasma (either AA|AB or AA|BB contexts), and claim to determine the ploidy calls from the average allele ratio on these SNPs. This method is intended for cases where the paternal genotype is not available. Note that it is questionable how accurately one can claim that plasma is heterozygous on a particular SNP without the presence of homozygous and opposite father BB: for cases with low child fraction, what looks like presence of B allele could be just presence of noise; additionally, what looks like no B present could be simple allele drop out of the fetal measurements. Even in a case where one can actually determine heterozygosity of the plasma, this method will not be able to distinguish paternal trisomies. In particular, for SNPs where mother is AA, and where some B is measured in the plasma, if the father is GG, the resulting child genotype is AGG, resulting in an average ratio of 33% A (for child fraction=100%). But in the case where the father is AG, the resulting child genotype could be AGG for matched trisomy, contributing to the 33% A ratio, or AAG for unmatched trisomy, drawing the average ratio more toward 66% A. Given that many trisomies are on chromosomes with crossovers, the overall chromosome can have anywhere between no unmatched trisomy and all unmatched trisomy, this ratio can vary anywhere between 33-66%. For a plain disomy, the ratio should be around 50%. Without the use of a linkage model or an accurate error model of the average, this method would miss many cases of paternal trisomy. In contrast, the method disclosed herein assigns parental genotype probabilities for each parental genotypic candidate, based on available genotypic information and population frequency, and does not explicitly require parental genotypes. Additionally, the method disclosed herein is able to detect trisomy even in the absence or presence of parent genotypic data, and can compensate by identifying the points of possible crossovers from matched to unmatched trisomy using a linkage model.

Some methods known in the art claim a method for averaging allele ratios from SNPs where neither the maternal or paternal genotype is known, and for determining the ploidy calls from average ratio on these SNPs. However, a method to accomplish these ends is not disclosed. The method disclosed herein is able to make accurate ploidy calls in such a situation, and the reduction to practice is disclosed elsewhere in this document, using a joint probability maximum likelihood method and optionally utilizes SNP noise and bias models, as well as a linkage model.

Some methods known in the art involve averaging allele ratios and claim to determine the ploidy calls from the average allele ratio at one or a few SNPs. However, such methods do not utilize the concept of linkage. The methods disclosed herein do not suffer from these drawbacks.

Using Sequence Length as a Prior to Determine the Origin of DNA

It has been reported that the distribution of length of sequences differ for maternal and fetal DNA, with fetal generally being shorter. In an embodiment of the present disclosure, it is possible to use previous knowledge in the form of empirical data, and construct prior distribution for expected length of both mother (P(X|maternal)) and fetal DNA (P(X|fetal)). Given new unidentified DNA sequence of length x, it is possible to assign a probability that a given sequence of DNA is either maternal or fetal DNA, based on prior likelihood of x given either maternal or fetal. In particular if $P(x|maternal) > P(x|fetal)$, then the DNA sequence can be classified as maternal, with $P(x|maternal) = P(x|maternal)/[(P(x|maternal) + P(x|fetal)]$, and if $p(x|maternal) < p(x|fetal)$, then the DNA sequence can be classified as fetal, $P(x|fetal) = P(x|fetal)/[(P(x|maternal) + P(x|fetal)]$. In an embodiment of the present disclosure, a distributions of maternal and fetal sequence lengths can be determined that is specific for that sample by considering the sequences that can be assigned as maternal or fetal with high probability, and then that sample specific distribution can be used as the expected size distribution for that sample.

Variable Read Depth to Minimize Sequencing Cost

In many clinical trials concerning a diagnostic, for example, in Chiu et al. BMJ 2011; 342:c7401, a protocol with a number of parameters is set, and then the same protocol is executed with the same parameters for each of the patients in the trial. In the case of determining the ploidy status of a fetus gestating in a mother using sequencing as a method to measure genetic material one pertinent parameter is the number of reads. The number of reads may refer to the number of actual reads, the number of intended reads, fractional lanes, full lanes, or full flow cells on a sequencer. In these studies, the number of reads is typically set at a level that will ensure that all or nearly all of the samples achieve the desired level of accuracy. Sequencing is currently an expensive technology, a cost of roughly $200 per 5 mappable million reads, and while the price is dropping, any method which allows a sequencing based diagnostic to operate at a similar level of accuracy but with fewer reads will necessarily save a considerable amount of money.

The accuracy of a ploidy determination is typically dependent on a number of factors, including the number of reads and the fraction of fetal DNA in the mixture. The accuracy is typically higher when the fraction of fetal DNA in the mixture is higher. At the same time, the accuracy is typically higher if the number of reads is greater. It is possible to have a situation with two cases where the ploidy state is determined with comparable accuracies wherein the first case has a lower fraction of fetal DNA in the mixture than the second, and more reads were sequenced in the first case than the second. It is possible to use the estimated fraction of fetal DNA in the mixture as a guide in determining the number of reads necessary to achieve a given level of accuracy.

In an embodiment of the present disclosure, a set of samples can be run where different samples in the set are sequenced to different reads depths, wherein the number of reads run on each of the samples is chosen to achieve a given level of accuracy given the calculated fraction of fetal DNA in each mixture. In an embodiment of the present disclosure, this may entail making a measurement of the mixed sample to determine the fraction of fetal DNA in the mixture; this estimation of the fetal fraction may be done with sequencing, it may be done with TAQMAN, it may be done with qPCR, it may be done with SNP arrays, it may be done with any method that can distinguish different alleles at a given loci. The need for a fetal fraction estimate may be eliminated by including hypotheses that cover all or a selected set of fetal fractions in the set of hypotheses that are considered when comparing to the actual measured data. After the fraction fetal DNA in the mixture has been determined, the number of sequences to be read for each sample may be determined.

In an embodiment of the present disclosure, 100 pregnant women visit their respective OB's, and their blood is drawn into blood tubes with an anti-lysant and/or something to inactivate DNAase. They each take home a kit for the father of their gestating fetus who gives a saliva sample. Both sets of genetic materials for all 100 couples are sent back to the laboratory, where the mother blood is spun down and the buffy coat is isolated, as well as the plasma. The plasma comprises a mixture of maternal DNA as well as placentally derived DNA. The maternal buffy coat and the paternal blood is genotyped using a SNP array, and the DNA in the maternal plasma samples are targeted with SURESELECT hybridization probes. The DNA that was pulled down with the probes is used to generate 100 tagged libraries, one for each of the maternal samples, where each sample is tagged with a different tag. A fraction from each library is withdrawn, each of those fractions are mixed together and added to two lanes of a ILLUMINA HISEQ DNA sequencer in a multiplexed fashion, wherein each lane resulted in approximately 50 million mappable reads, resulting in approximately 100 million mappable reads on the 100 multiplexed mixtures, or approximately 1 million reads per sample. The sequence reads were used to determine the fraction of fetal DNA in each mixture. 50 of the samples had more than 15% fetal DNA in the mixture, and the 1 million reads were sufficient to determine the ploidy status of the fetuses with a 99.9% confidence.

Of the remaining mixtures, 25 had between 10 and 15% fetal DNA; a fraction of each of the relevant libraries prepped from these mixtures were multiplexed and run down one lane of the HISEQ generating an additional 2 million reads for each sample. The two sets of sequence data for each of the mixture with between 10 and 15% fetal DNA were added together, and the resulting 3 million reads per sample which were sufficient to determine the ploidy state of those fetuses with 99.9% confidence.

Of the remaining mixtures, 13 had between 6 and 10% fetal DNA; a fraction of each of the relevant libraries prepped from these mixtures were multiplexed and run down one lane of the HISEQ generating an additional 4 million reads for each sample. The two sets of sequence data for each of the mixture with between 6 and 10% fetal DNA were added together, and the resulting 5 million total reads per mixture which were sufficient to determine the ploidy state of those fetuses with 99.9% confidence.

Of the remaining mixtures, 8 had between 4 and 6% fetal DNA; a fraction of each of the relevant libraries prepped from these mixtures were multiplexed and run down one lane of the HISEQ generating an additional 6 million reads for each sample. The two sets of sequence data for each of the mixture with between 4 and 6% fetal DNA were added together, and the resulting 7 million total reads per mixture which were sufficient to determine the ploidy state of those fetuses with 99.9% confidence.

Of the remaining four mixtures, all of them had between 2 and 4% fetal DNA; a fraction of each of the relevant libraries prepped from these mixtures were multiplexed and run down one lane of the HISEQ generating an additional 12 million reads for each sample. The two sets of sequence data for each of the mixture with between 2 and 4% fetal DNA were added together, and the resulting 13 million total reads per mixture which were sufficient to determine the ploidy state of those fetuses with 99.9% confidence.

This method required six lanes of sequencing on a HISEQ machine to achieve 99.9% accuracy over 100 samples. If the same number of runs had been required for every sample, to ensure that every ploidy determination was made with a 99.9% accuracy, it would have taken 25 lanes of sequencing, and if a no-call rate or error rate of 4% was tolerated, it could have been achieved with 14 lanes of sequencing.

Using Raw Genotyping Data

There are a number of methods that can accomplish NPD using fetal genetic information measured on fetal DNA found in maternal blood. Some of these methods involve making measurements of the fetal DNA using SNP arrays, some methods involve untargeted sequencing, and some methods involve targeted sequencing. The targeted sequencing may target SNPs, it may target STRs, it may target other polymorphic loci, it may target non-polymorphic loci, or some combination thereof. Some of these methods may involve using a commercial or proprietary allele caller that calls the identity of the alleles from the intensity data that comes from the sensors in the machine doing the measuring. For example, the ILLUMINA INFINIUM system or the AFFYMETRIX GENECHIP microarray system involves beads or microchips with attached DNA sequences that can hybridize to complementary segments of DNA; upon hybridization, there is a change in the fluorescent properties of the sensor molecule that can be detected. There are also sequencing methods, for example the ILLUMINA SOLEXA GENOME SEQUENCER or the ABI SOLID GENOME SEQUENCER, wherein the genetic sequence of fragments of DNA are sequenced; upon extension of the strand of DNA complementary to the strand being sequenced, the identity of the extended nucleotide is typically detected via a fluorescent or radio tag appended to the complementary nucleotide. In all of these methods the genotypic or sequencing data is typically determined on the basis of fluorescent or other signals, or the lack thereof. These systems are typically combined with low level software packages that make specific allele calls (secondary genetic data) from the analog output of the fluorescent or other detection device (primary genetic data). For example, in the case of a given allele on a SNP array, the software will make a call, for example, that a certain SNP is present or not present if the fluorescent intensity is measure above or below a certain threshold. Similarly, the output of a sequencer is a chromatogram that indicates the level of fluorescence detected for each of the dyes, and the software will make a call that a certain base pair is A or T or C or G. High throughput sequencers typically make a series of such measurements, called a read, that represents the most likely structure of the DNA sequence that was sequenced. The direct analog output of the chromatogram is defined here to be the primary genetic data, and the base pair/SNP calls made by the software are considered here to be the secondary genetic data. In an embodiment, primary data refers to the raw intensity data that is the unprocessed output of a genotyping platform, where the genotyping platform may refer to a SNP array, or to a sequencing platform. The secondary genetic data refers to the processed genetic data, where an allele call has been made, or the sequence data has been assigned base pairs, and/or the sequence reads have been mapped to the genome.

Many higher level applications take advantage of these allele calls, SNP calls and sequence reads, that is, the secondary genetic data, that the genotyping software produces. For example, DNA NEXUS, ELAND or MAQ will take the sequencing reads and map them to the genome. For example, in the context of non-invasive prenatal diagnosis, complex informatics, such as PARENTAL SUPPORT™, may leverage a large number of SNP calls to determine the genotype of an individual. Also, in the context of preimplantation genetic diagnosis, it is possible to take a set of sequence reads that are mapped to the genome, and by taking a normalized count of the reads that are mapped to each chromosome, or section of a chromosome, it may be possible to determine the ploidy state of an individual. In the context of non-invasive prenatal diagnosis it may be possible to take a set of sequence reads that have been measured on DNA present in maternal plasma, and map them to the genome. One may then take a normalized count of the reads that are mapped to each chromosome, or section of a chromosome, and use that data to determine the ploidy state of an individual. For example, it may be possible to conclude that those chromosomes that have a disproportionately large number of reads are trisomic in the fetus that is gestating in the mother from which the blood was drawn.

However, in reality, the initial output of the measuring instruments is an analog signal. When a certain base pair is called by the software that is associated with the sequencing software, for example the software may call the base pair a T, in reality the call is the call that the software believes to be most likely. In some cases, however, the call may be of low confidence, for example, the analog signal may indicate that the particular base pair is only 90% likely to be a T, and 10% likely to be an A. In another example, the genotype calling software that is associated with a SNP array reader may call a certain allele to be G. However, in reality, the underlying analog signal may indicate that it is only 70% likely that the allele is G, and 30% likely that the allele is T. In these cases, when the higher level applications use the genotype calls and sequence calls made by the lower level software, they are losing some information. That is, the primary genetic data, as measured directly by the genotyping platform, may be messier than the secondary genetic data that is determined by the attached software packages, but it contains more information. In mapping the secondary genetic data sequences to the genome, many reads are thrown out because some bases are not read with enough clarity and or mapping is not clear. When the primary genetic data sequence reads are used, all or many of those reads that may have been thrown out when first converted to secondary genetic data sequence read can be used by treating the reads in a probabilistic manner.

In an embodiment of the present disclosure, the higher level software does not rely on the allele calls, SNP calls, or sequence reads that are determined by the lower level software. Instead, the higher level software bases its calculations on the analog signals directly measured from the genotyping platform. In an embodiment of the present disclosure, an informatics based method such as PARENTAL SUPPORT™ is modified so that its ability to reconstruct the genetic data of the embryo/fetus/child is engineered to directly use the primary genetic data as measured by the genotyping platform. In an embodiment of the present disclosure, an informatics based method such as PAREN- TAL SUPPORT™ is able to make allele calls, and/or chromosome copy number calls using primary genetic data, and not using the secondary genetic data. In an embodiment of the present disclosure, all genetic calls, SNPs calls, sequence reads, sequence mapping is treated in a probabilistic manner by using the raw intensity data as measured directly by the genotyping platform, rather than converting the primary genetic data to secondary genetic calls. In an embodiment, the DNA measurements from the prepared sample used in calculating allele count probabilities and determining the relative probability of each hypothesis comprise primary genetic data.

In some embodiments, the method can increase the accuracy of genetic data of a target individual which incorporates genetic data of at least one related individual, the method comprising obtaining primary genetic data specific to a target individual's genome and genetic data specific to the genome(s) of the related individual(s), creating a set of one or more hypotheses concerning possibly which segments of which chromosomes from the related individual(s) correspond to those segments in the target individual's genome, determining the probability of each of the hypotheses given the target individual's primary genetic data and the related individual(s)'s genetic data, and using the probabilities associated with each hypothesis to determine the most likely state of the actual genetic material of the target individual. In some embodiments, the method can determining the number of copies of a segment of a chromosome in the genome of a target individual, the method comprising creating a set of copy number hypotheses about how many copies of the chromosome segment are present in the genome of a target individual, incorporating primary genetic data from the target individual and genetic information from one or more related individuals into a data set, estimating the characteristics of the platform response associated with the data set, where the platform response may vary from one experiment to another, computing the conditional probabilities of each copy number hypothesis, given the data set and the platform response characteristics, and determining the copy number of the chromosome segment based on the most probable copy number hypothesis. In an embodiment, a method of the present disclosure can determine a ploidy state of at least one chromosome in a target individual, the method comprising obtaining primary genetic data from the target individual and from one or more related individuals, creating a set of at least one ploidy state hypothesis for each of the chromosomes of the target individual, using one or more expert techniques to determine a statistical probability for each ploidy state hypothesis in the set, for each expert technique used, given the obtained genetic data, combining, for each ploidy state hypothesis, the statistical probabilities as determined by the one or more expert techniques, and determining the ploidy state for each of the chromosomes in the target individual based on the combined statistical probabilities of each of the ploidy state hypotheses. In an embodiment, a method of the present disclosure can determine an allelic state in a set of alleles, in a target individual, and from one or both parents of the target individual, and optionally from one or more related individuals, the method comprising obtaining primary genetic data from the target individual, and from the one or both parents, and from any related individuals, creating a set of at least one allelic hypothesis for the target individual, and for the one or both parents, and optionally for the one or more related individuals, where the hypotheses describe possible allelic states in the set of alleles, determining a statistical probability for each allelic hypothesis in the set of hypotheses given the obtained genetic data, and determining the allelic state for each of the alleles in the set of alleles for the target individual, and for the one or both parents, and optionally for the one or more related individuals, based on the statistical probabilities of each of the allelic hypotheses.

In some embodiments, the genetic data of the mixed sample may comprise sequence data wherein the sequence data may not uniquely map to the human genome. In some embodiments, the genetic data of the mixed sample may comprise sequence data wherein the sequence data maps to a plurality of locations in the genome, wherein each possible mapping is associated with a probability that the given mapping is correct. In some embodiments, the sequence reads are not assumed to be associated with a particular position in the genome. In some embodiments, the sequence reads are associated with a plurality of positions in the genome, and an associated probability belonging to that position.

Counting Method to Determine Chromosome Copy Number

In one aspect, the invention features methods of testing for an abnormal distribution of a fetal chromosome by comparing the number of sequence tags that align to different chromosomes (see, e.g., U.S. Pat. No. 8,296,076, filed Apr. 20, 2012, which is hereby incorporated by reference in its entirety). As is known in the art, the term "sequence tag" refers to a relatively short (e.g., 15-100) nucleic acid sequence that can be used to identify a certain larger sequence, e.g., be mapped to a chromosome or genomic region or gene. In some embodiments, the method involves (i) contacting a sample that includes a mixture of maternal and fetal DNA with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci to produce a reaction mixture; wherein the target loci are from a plurality of different chromosomes; and wherein the plurality of different chromosomes comprise at least one first chromosome suspected of having an abnormal distribution in the sample and at least one second chromosome presumed to be normally distributed in the sample; (ii) subjecting the reaction mixture to primer extension reaction conditions to produce amplified products; (iii) sequencing the amplified products to obtain a plurality of sequence tags aligning to the target loci; wherein the sequence tags are of sufficient length to be assigned to a specific target locus; (iv) assigning on a computer the plurality of sequence tags to their corresponding target loci; (v) determining on a computer a number of sequence tags aligning to the target loci of the first chromosome and a number of sequence tags aligning to the target loci of the second chromosome; and (vi) comparing the numbers from step (v) to determine the presence or absence of an abnormal distribution of the first chromosome.

In one aspect, the invention provides methods for detecting the presence or absence of a fetal aneuploidy by comparing the relative frequency of target amplicons between chromosomes (see, e.g., PCT Publ. No. WO 2012/103031, filed Jan. 23, 2012, which is hereby incorporated by reference in its entirety). In some embodiments, the method involves (i) contacting a sample that includes a mixture of maternal and fetal DNA with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different non-polymorphic target loci to produce a reaction mixture; wherein the target loci are from a plurality of different chromosomes; (ii) subjecting the reaction mixture to primer extension reaction conditions to produce amplified products that includes target amplicons; (iii) quantifying on a computer a relative frequency of the target amplicons from the first and second chromosomes of interest; (iv) comparing on a computer the relative frequency of the target amplicons from the first and second chromosomes of interest; and (v) identifying the presence or absence of an aneuploidy based on the compared relative frequencies of the first and second chromosome of interest. In some embodiments, the first chromosome is a chromosome suspected of being euploid. In some embodiments, the second chromosome is a chromosome suspected of being aneuploidy Combining Methods of Prenatal Diagnosis There are many methods that may be used for prenatal diagnosis or prenatal screening of aneuploidy or other genetic defects. Described elsewhere in this document, and in U.S. Utility application Ser. No. 11/603,406, filed Nov. 28, 2006; U.S. Utility application Ser. No. 12/076,348, filed Mar. 17, 2008, and PCT Application Ser. No. PCT/S09/52730 is one such method that uses the genetic data of related individuals to increase the accuracy with which genetic data of a target individual, such as a fetus, is known, or estimated. Other methods used for prenatal diagnosis involve measuring the levels of certain hormones in maternal blood, where those hormones are correlated with various genetic abnormalities. An example of this is called the triple test, a test wherein the levels of several (commonly two, three, four or five) different hormones are measured in maternal blood. In a case where multiple methods are used to determine the likelihood of a given outcome, where none of the methods are definitive in and of themselves, it is possible to combine the information given by those methods to make a prediction that is more accurate than any of the individual methods. In the triple test, combining the information given by the three different hormones can result in a prediction of genetic abnormalities that is more accurate than the individual hormone levels may predict.

Disclosed herein is a method for making more accurate predictions about the genetic state of a fetus, specifically the possibility of genetic abnormalities in a fetus that comprises combining predictions of genetic abnormalities in a fetus where those predictions were made using a variety of methods. A "more accurate" method may refer to a method for diagnosing an abnormality that has a lower false negative rate at a given false positive rate. In a favored embodiment of the present disclosure, one or more of the predictions are made based on the genetic data known about the fetus, where the genetic knowledge was determined using the PARENTAL SUPPORT™ method, that is, using genetic data of individual related to the fetus to determine the genetic data of the fetus with greater accuracy. In some embodiments the genetic data may include ploidy states of the fetus. In some embodiments, the genetic data may refer to a set of allele calls on the genome of the fetus. In some embodiments some of the predictions may have been made using the triple test. In some embodiments, some of the predictions may have been made using measurements of other hormone levels in maternal blood. In some embodiments, predictions made by methods considered diagnoses may be combined with predictions made by methods considered screening. In some embodiments, the method involves measuring maternal blood levels of alpha-fetoprotein (AFP). In some embodiments, the method involves measuring maternal blood levels of unconjugated estriol ($UE_3$). In some embodiments, the method involves measuring maternal blood levels of beta human chorionic gonadotropin (beta-hCG). In some embodiments, the method involves measuring maternal blood levels of invasive trophoblast antigen (ITA). In some embodiments, the method involves measuring maternal blood levels of inhibin. In some embodiments, the method involves measuring maternal blood levels of pregnancy-associated plasma protein A (PAPP-A). In some embodiments, the method involves measuring maternal blood levels of other hormones or maternal serum markers. In some embodiments, some of the predictions may have been made using other methods. In some embodiments, some of the predictions may have been made using a fully integrated test such as one that combines ultrasound and blood test at around 12 weeks of pregnancy and a second blood test at around 16 weeks. In some embodiments, the method involves measuring the fetal nuchal translucency (NT). In some embodiments, the method involves using the measured levels of the aforementioned hormones for making predictions. In some embodiments the method involves a combination of the aforementioned methods.

There are many ways to combine the predictions, for example, one could convert the hormone measurements into a multiple of the median (MoM) and then into likelihood ratios (LR). Similarly, other measurements could be transformed into LRs using the mixture model of NT distributions. The LRs for NT and the biochemical markers could be multiplied by the age and gestation-related risk to derive the risk for various conditions, such as trisomy 21. Detection rates (DRs) and false-positive rates (FPRs) could be calculated by taking the proportions with risks above a given risk threshold.

In an embodiment, a method to call the ploidy state involves combining the relative probabilities of each of the ploidy hypotheses determined using the joint distribution model and the allele count probabilities with relative probabilities of each of the ploidy hypotheses that are calculated using statistical techniques taken from other methods that determine a risk score for a fetus being trisomic, including but not limited to: a read count analysis, comparing heterozygosity rates, a statistic that is only available when parental genetic information is used, the probability of normalized genotype signals for certain parent contexts, a statistic that is calculated using an estimated fetal fraction of the first sample or the prepared sample, and combinations thereof.

Another method could involve a situation with four measured hormone levels, where the probability distribution around those hormones is known: $p(x_1, x_2, x_3, x_4|e)$ for the euploid case and $p(x_1, x_2, x_3, x_4|a)$ for the aneuploid case. Then one could measure the probability distribution for the DNA measurements, $g(y|e)$ and $g(y|a)$ for the euploid and aneuploid cases respectively. Assuming they are independent given the assumption of euploid/aneuploid, one could combine as $p(x_1, x_2, x_3, x_4|a)g(y|a)$ and $p(x_1, x_2, x_3, x_4|e)g(y|e)$ and then multiply each by the prior $p(a)$ and $p(e)$ given the maternal age. One could then choose the one that is highest.

In an embodiment, it is possible to evoke central limit theorem to assume distribution on $g(y|a\ ore)$ is Gaussian, and measure mean and standard deviation by looking at multiple samples. In another embodiment, one could assume they are not independent given the outcome and collect enough samples to estimate the joint distribution $p(x_1, x_2, x_3, x_4|a\ or\ e)$.

In an embodiment, the ploidy state for the target individual is determined to be the ploidy state that is associated with the hypothesis whose probability is the greatest. In some cases, one hypothesis will have a normalized, combined probability greater than 90%. Each hypothesis is associated with one, or a set of, ploidy states, and the ploidy state associated with the hypothesis whose normalized, combined probability is greater than 90%, or some other threshold value, such as 50%, 80%, 95%, 98%, 99%, or 99.9%, may be chosen as the threshold required for a hypothesis to be called as the determined ploidy state.

DNA from Children from Previous Pregnancies in Maternal Blood

One difficulty to non-invasive prenatal diagnosis is differentiating fetal cells from the current pregnancy from fetal cells from previous pregnancies. Some believe that genetic matter from prior pregnancies will go away after some time, but conclusive evidence has not been shown. In an embodiment of the present disclosure, it is possible to determine fetal DNA present in the maternal blood of paternal origin (that is, DNA that the fetus inherited from the father) using the PARENTAL SUPPORT™ (PS) method, and the knowledge of the paternal genome. This method may utilize phased parental genetic information. It is possible to phase the parental genotype from unphased genotypic information using grandparental genetic data (such as measured genetic data from a sperm from the grandfather), or genetic data from other born children, or a sample of a miscarriage. One could also phase unphased genetic information by way of a HapMap-based phasing, or a haplotyping of paternal cells. Successful haplotyping has been demonstrated by arresting cells at phase of mitosis when chromosomes are tight bundles and using microfluidics to put separate chromosomes in separate wells. In another embodiment it is possible to use the phased parental haplotypic data to detect the presence of more than one homolog from the father, implying that the genetic material from more than one child is present in the blood. By focusing on chromosomes that are expected to be euploid in a fetus, one could rule out the possibility that the fetus was afflicted with a trisomy. Also, it is possible to determine if the fetal DNA is not from the current father, in which case one could use other methods such as the triple test to predict genetic abnormalities.

There may be other sources of fetal genetic material available via methods other than a blood draw. In the case of the fetal genetic material available in maternal blood, there are two main categories: (1) whole fetal cells, for example, nucleated fetal red blood cells or erythroblats, and (2) free floating fetal DNA. In the case of whole fetal cells, there is some evidence that fetal cells can persist in maternal blood for an extended period of time such that it is possible to isolate a cell from a pregnant woman that contains the DNA from a child or fetus from a prior pregnancy. There is also evidence that the free floating fetal DNA is cleared from the system in a matter of weeks. One challenge is how to determine the identity of the individual whose genetic material is contained in the cell, namely to ensure that the measured genetic material is not from a fetus from a prior pregnancy. In an embodiment of the present disclosure, the knowledge of the maternal genetic material can be used to ensure that the genetic material in question is not maternal genetic material. There are a number of methods to accomplish this end, including informatics based methods such as PARENTAL SUPPORT™, as described in this document or any of the patents referenced in this document.

In an embodiment of the present disclosure, the blood drawn from the pregnant mother may be separated into a fraction comprising free floating fetal DNA, and a fraction comprising nucleated red blood cells. The free floating DNA may optionally be enriched, and the genotypic information of the DNA may be measured. From the measured genotypic information from the free floating DNA, the knowledge of the maternal genotype may be used to determine aspects of the fetal genotype. These aspects may refer to ploidy state, and/or a set of allele identities. Then, individual nucleated red blood cells may be genotyped using methods described elsewhere in this document, and other referent patents, especially those mentioned in the first section of this document. The knowledge of the maternal genome would allow one to determine whether or not any given single blood cell is genetically maternal. And the aspects of the fetal genotype that were determined as described above would allow one to determine if the single blood cell is genetically derived from the fetus that is currently gestating. In essence, this aspect of the present disclosure allows one to use the genetic knowledge of the mother, and possibly the genetic information from other related individuals, such as the father, along with the measured genetic information from the free floating DNA found in maternal blood to determine whether an isolated nucleated cell found in maternal blood is either (a) genetically maternal, (b) genetically from the fetus currently gestating, or (c) genetically from a fetus from a prior pregnancy.

Prenatal Sex Chromosome Aneuploidy Determination

In methods known in the art, people attempting to determine the sex of a gestating fetus from the blood of the mother have used the fact that fetal free floating DNA (fffDNA) is present in the plasma of the mother. If one is able to detect Y-specific loci in the maternal plasma, this implies that the gestating fetus is a male. However, the lack of detection of Y-specific loci in the plasma does not always guarantee that the gestating fetus is a female when using methods known in the art, as in some cases the amount of fffDNA is too low to ensure that the Y-specific loci would be detected in the case of a male fetus.

Presented here is a novel method that does not require the measurement of Y-specific nucleic acids, that is, DNA that is from loci that are exclusively paternally derived. The Parental Support method, disclosed previously, uses crossover frequency data, parental genotypic data, and informatics techniques, to determine the ploidy state of a gestating fetus. The sex of a fetus is simply the ploidy state of the fetus at the sex chromosomes. A child that is XX is female, and XY is male. The method described herein is also able to determine the ploidy state of the fetus. Note that sexing is effectively synonymous with ploidy determination of the sex chromosomes;

in the case of sexing, an assumption is often made that the child is euploid, therefore there are fewer possible hypotheses.

The method disclosed herein involves looking at loci that are common to both the X and Y chromosome to create a baseline in terms of expected amount of fetal DNA present for a fetus. Then, those regions that are specific only to the X chromosome can be interrogated to determine if the fetus is female or male. In the case of a male, we expect to see less fetal DNA from loci that are specific to the X chromosome than from loci that are specific to both the X and the Y. In contrast, in female fetuses, we expect the amount of DNA for each of these groups to be the same. The DNA in question can be measured by any technique that can quantitate the amount of DNA present on a sample, for example, qPCR, SNP arrays, genotyping arrays, or sequencing. For DNA that is exclusively from an individual we would expect to see the following:

|  | DNA specific to X | DNA specific to X and Y | DNA specific to Y |
|---|---|---|---|
| Male (XY) | A | 2A | A |
| Female (XX) | 2A | 2A | 0 |

In the case of DNA from a fetus that is mixed with DNA from the mother, and where the fraction of fetal DNA in the mixture is F, and where the fraction of maternal DNA in the mixture is M, such that F+M=100%, we would expect to see the following:

|  | DNA specific to X | DNA specific to X and Y | DNA specific to Y |
|---|---|---|---|
| Male fetus (XY) | M + ½ F | M + F | ½ F |
| Female fetus (XX) | M + F | M + F | 0 |

In the case where F and M are known, the expected ratios can be computed, and the observed data can be compared to the expected data. In the case where M and F are not known, a threshold can be selected based on historical data. In both cases, the measured amount of DNA at loci specific to both X and Y can be used as a baseline, and the test for the sex of the fetus can be based on the amount of DNA observed on loci specific to only the X chromosome. If that amount is lower than the baseline by an amount roughly equal to ½ F, or by an amount that causes it to fall below a predefined threshold, the fetus is determined to be male, and if that amount is about equal to the baseline, or if is not lower by an amount that causes it to fall below a predefined threshold, the fetus is determined to be female.

In another embodiment, one can look only at those loci that are common to both the X and the Y chromosomes, often termed the Z chromosome. A subset of the loci on the Z chromosome are typically always A on the X chromosome, and B on the Y chromosome. If SNPs from the Z chromosome are found to have the B genotype, then the fetus is called a male; if the SNPs from the Z chromosome are found to only have A genotype, then the fetus is called a female. In another embodiment, one can look at the loci that are found only on the X chromosome. Contexts such as AA|B are particularly informative as the presence of a B indicates that the fetus has an X chromosome from the father. Contexts such as AB|B are also informative, as we expect to see B present only half as often in the case of a female fetus as compared to a male fetus. In another embodiment, one can look at the SNPs on the Z chromosome where both A and B alleles are present on both the X and the Y chromosome, and where the it is known which SNPs are from the paternal Y chromosome, and which are from the paternal X chromosome.

In an embodiment, it is possible to amplify single nucleotide positions known to varying between the homologous non-recombining (HNR) region shared by chromosome Y and chromosome X. The sequence within this HNR region is largely identical between the X and Y chromosomes. Within this identical region are single nucleotide positions that, while invariant among X chromosomes and among Y chromosomes in the population, are different between the X and Y chromosomes. Each PCR assay could amplify a sequence from loci that are present on both the X and Y chromosomes. Within each amplified sequence would be a single base that can be detected using sequencing or some other method (see, for example, U.S. Publication No. 2011/0178719, filed Feb. 3, 2011, which is hereby incorporated by reference in its entirety).

In an embodiment, the sex of the fetus could be determined from the fetal free floating DNA found in maternal plasma, the method comprising some or all of the following steps: 1) Design PCR (either regular or mini-PCR, plus multiplexing if desired) primers amplify X/Y variant single nucleotide positions within HNR region, 2) obtain maternal plasma, 3) PCR Amplify targets from maternal plasma using HNR X/Y PCR assays, 4) sequence the amplicons, 5) Examine sequence data for presence of Y-allele within one or more of the amplified sequences. The presence of one or more would indicate a male fetus. Absence of all Y-alleles from all amplicons indicates a female fetus.

In an embodiment, one could use targeted sequencing to measure the DNA in the maternal plasma and/or the parental genotypes. In an embodiment, one could ignore all sequences that clearly originate from paternally sourced DNA. For example, in the context AA|AB, one could count the number of A sequences and ignore all the B sequences. In order to determine a heterozygosity rate for the above algorithm, one could compare the number of observed A sequences to the expected number of total sequences for the given probe. There are many ways one could calculate an expected number of sequences for each probe on a per sample basis. In an embodiment, it is possible to use historical data to determine what fraction of all sequence reads belongs to each specific probe and then use this empirical fraction, combined with the total number of sequence reads, to estimate the number of sequences at each probe. Another approach could be to target some known homozygous alleles and then use historical data to relate the number of reads at each probe with the number of reads at the known homozygous alleles. For each sample, one could then measure the number of reads at the homozygous alleles and then use this measurement, along with the empirically derived relationships, to estimate the number of sequence reads at each probe.

In some embodiments, it is possible to determine the sex of the fetus by combining the predictions made by a plurality of methods. In some embodiments the plurality of methods are taken from methods described in this disclosure. In some embodiments, at least one of the plurality of methods are taken from methods described in this disclosure.

In some embodiments the method described herein can be used to determine the ploidy state of the gestating fetus. In an embodiment, the ploidy calling method uses loci that are specific to the X chromosome, or common to both the X and Y chromosome, but does not make use of any Y-specific loci. In an embodiment, the ploidy calling method uses one or more of the following: loci that are specific to the X chromosome, loci that are common to both the X and Y chromosome, and loci that are specific to the Y chromosome. In an embodiment, where the ratios of sex chromosomes are similar, for example 45,X (Turner Syndrome), 46,XX (normal female) and 47,XXX (trisomy X), the differentiation can be accomplished by comparing the allele distributions to expected allele distributions according to the various hypotheses. In another embodiment, this can be accomplished by comparing the relative number of sequence reads for the sex chromosomes to one or a plurality of reference chromosomes that are assumed to be euploid. Also note that these methods can be expanded to include aneuploid cases.

Single Gene Disease Screening

In an embodiment, a method for determining the ploidy state of the fetus may be extended to enable simultaneous testing for single gene disorders. Single-gene disease diagnosis leverages the same targeted approach used for aneuploidy testing, and requires additional specific targets. In an embodiment, the single gene NPD diagnosis is through linkage analysis. In many cases, direct testing of the cfDNA sample is not reliable, as the presence of maternal DNA makes it virtually impossible to determine if the fetus has inherited the mother's mutation. Detection of a unique paternally-derived allele is less challenging, but is only fully informative if the disease is dominant and carried by the father, limiting the utility of the approach. In an embodiment, the method involves PCR or related amplification approaches.

In some embodiments, the method involves phasing the abnormal allele with surrounding very tightly linked SNPs in the parents using information from first-degree relatives. Then Parental Support may be run on the targeted sequencing data obtained from these SNPs to determine which homologs, normal or abnormal, were inherited by the fetus from both parents. As long as the SNPs are sufficiently linked, the inheritance of the genotype of the fetus can be determined very reliably. In some embodiments, the method comprises (a) adding a set of SNP loci to densely flank a specified set of common diseases to our multiplex pool for aneuploidy testing; (b) reliably phasing the alleles from these added SNPs with the normal and abnormal alleles based on genetic data from various relatives; and (c) reconstructing the fetal haplotype, or set of phased SNP alleles on the inherited maternal and paternal homologs in the region surrounding the disease locus to determine fetal genotype. In some embodiments additional probes that are closely linked to a disease linked locus are added to the set of polymorphic locus being used for aneuploidy testing.

Reconstructing fetal diplotype is challenging because the sample is a mixture of maternal and fetal DNA. In some embodiments, the method incorporates relative information to phase the SNPs and disease alleles, then take into account physical distance of the SNPs and recombination data from location specific recombination likelihoods and the data observed from the genetic measurements of the maternal plasma to obtain the most likely genotype of the fetus.

In an embodiment, a number of additional probes per disease linked locus are included in the set of targeted polymorphic loci; the number of additional probes per disease linked locus may be between 4 and 10, between 11 and 20, between 21 and 40, between 41 and 60, between 61 and 80, or combinations thereof.

Phasing the diploid data from the parents can be challenging, and there are a number of ways this can be accomplished. Some are discussed in this disclosure, others are described in greater detail in other disclosures (see, e.g., PCT Publ. No. WO2009105531, filed Feb. 9, 2009, and PCT Publ. No. WO2010017214, filed Aug. 4, 2009, which are each hereby incorporated by reference in its entirety). In one embodiment, a parent can be phased by inference by measuring tissue from the parent that is haploid, for example by measuring one or more sperm or eggs. In one embodiment the parent can be phased by inference using the measured genotypic data of a first degree relative such as the parent's parent(s) or siblings. In one embodiment, the parent can be phased by dilution where the DNA is diluted, in one or a plurality of wells, to the point where there is expected to be no more than approximately one copy of each haplotype in each well, and then measuring the DNA in the one or more wells. In one embodiment, the parent genotype can be phased by using computer programs that use population based haplotype frequencies to infer the most likely phase.

In one embodiment, the parent can be phased if the phased haplotypic data is known for the other parent, along with the unphased genetic data of one or more genetic offspring of the parents. In some embodiments, the genetic offspring of the parents may be one or more embryos, fetuses, and/or born children. Some of these methods and other methods for phasing one or both parents are disclosed in greater detail in, e.g., U.S. Publ. No. 2011/0033862, filed Aug. 19, 2010; U.S. Publ. No. 2011/0178719, filed Feb. 3, 2011; U.S. Publ. No. 2007/0184467, filed Nov. 22, 2006; U.S. Publ. No. 2008/0243398, filed Mar. 17, 2008, which are each hereby incorporated by reference in its entirety.

Fetal Genome Reconstruction

In one aspect, the invention features methods for determining a haplotype of a fetus. In various embodiments, this method allows one to determine which polymorphic loci (such as SNPs) were inherited by the fetus and to reconstruct which homologs (including recombination events) are present in the fetus (and thereby interpolate the sequence between the polymorphic loci). If desired, essentially the entire genome of the fetus can be reconstructed. If there is some remaining ambiguity in the genome of the fetus (such as in intervals with a crossover), this ambiguity can be minimized if desired by analyzing additional polymorphic loci. In various embodiments, the polymorphic loci are chosen to cover one or more of the chromosomes at a density to reduce any ambiguity to a desired level. This method has important applications for the detection of polymorphisms or other mutations of interest in a fetus since it enables their detection based on linkage (such as the presence of linked polymorphic loci in the fetal genome) rather than by directing detecting the polymorphism or other mutation of interest in the fetal genome. For example, if a parent is a carrier for a mutation associated with cystic fibrosis (CF), a nucleic acid sample that includes maternal DNA from the mother of the fetus and fetal DNA from the fetus can be analyzed to determine whether the fetal DNA include the haplotype containing the CF mutation. In particular, polymorphic loci can be analyzed to determine whether the fetal DNA includes the haplotype containing the CF mutation without having to detect the CF mutation itself in the fetal DNA. This is useful in screening for one or more mutations, such as disease-linked mutations, without having to directly detect the mutations.

In some embodiments, the method involves determining a parental haplotype (e.g., a haplotype of the mother or father of the fetus). In some embodiments, this determination is made without using data from a relative of the mother or father. In some embodiments, a parental haplotype is determined using a dilution approach followed by SNP genotyping or sequencing as described herein and elsewhere (see, e.g., U.S. Publ. No. 2011/0033862, filed Aug. 19, 2010, which is hereby incorporated by reference in its entirety). Because the DNA is diluted, it is unlikely that more than one haplotype is in the same fraction (or tube). Thus, there may be effectively a single molecule of DNA in the tube, which allows the haplotype on a single DNA molecule to be determined. In some embodiments, the method includes dividing a DNA sample into a plurality of fractions such that at least one of the fractions includes one chromosome or one chromosome segment from a pair of chromosomes, and genotyping (e.g., determining the presence of two or more polymorphic loci) the DNA sample in at least one of the fractions, thereby determining a parental haplotype. In some embodiments, the genotyping involves sequencing (such as shotgun sequencing). In some embodiments, the genotyping involves use of a SNP array to detect polymorphic loci, such as at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci. In some embodiments, the genotyping involves the use of multiplex PCR. In some embodiments, the method involves contacting the sample in a fraction with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci (such as SNPs) to produce a reaction mixture; and subjecting the reaction mixture to primer extension reaction conditions to produce amplified products that are measured with a high throughput sequencer to produce sequencing data.

In some embodiments, a haplotype of the mother is determined by any of the methods described herein using data from a relative of the mother. In some embodiments, a haplotype of the father is determined by any of the methods described herein using data from a relative of the father. In some embodiments, a haplotype is determined for both the father and the mother. In some embodiments, a SNP array is used to determine the presence of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci in a DNA sample from the mother (or father) and a relative of the mother (or father). In some embodiments, the method involves contacting a DNA sample from the mother (or father) and/or a relative of the mother (or father) with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci (such as SNPs) to produce a reaction mixture; and subjecting the reaction mixture to primer extension reaction conditions to produce amplified products that are measured with a high throughput sequencer to produce sequencing data. The parental haplotype may be determined based on the SNP array or sequencing data. In some embodiments, parental data may be phased by methods described or referred to elsewhere in this document.

This parental haplotype data can be used to determine if the fetus inherited the parental haplotype. In some embodiments, a nucleic acid sample that includes maternal DNA from the mother of the fetus and fetal DNA from the fetus is analyzed using a SNP array to detect at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci. In some embodiments, a nucleic acid sample that includes maternal DNA from the mother of the fetus and fetal DNA from the fetus is analyzed by contacting the sample with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci (such as SNPs) to produce a reaction mixture. In some embodiments, the reaction mixture is subjected to primer extension reaction conditions to produce amplified products. In some embodiments, the amplified products are measured with a high throughput sequencer to produce sequencing data. In various embodiments, the SNP array or sequencing data is used to determine a parental haplotype by using data about the probability of chromosomes crossing over at different locations in a chromosome (such as by using recombination data such as may be found in the HapMap database to create a recombination risk score for any interval) to model dependence between polymorphic alleles on the chromosome. In some embodiments, allele counts at the polymorphic loci are calculated on a computer based on the sequencing data. In some embodiments, a plurality of ploidy hypotheses each pertaining to a different possible ploidy state of the chromosome are created on a computer; a model (such as a joint distribution model) for the expected allele counts at the polymorphic loci on the chromosome is built on a computer for each ploidy hypothesis; a relative probability of each of the ploidy hypotheses is determined on a computer using the joint distribution model and the allele counts; and the ploidy state of the fetus is called by selecting the ploidy state corresponding to the hypothesis with the greatest probability. In some embodiments, building a joint distribution model for allele counts and the step of determining the relative probability of each hypothesis are done using a method that does not require the use of a reference chromosome. In some embodiments, a fetal haplotype is determined for one or more chromosomes taken from the group consisting of chromosomes 13, 18, 21, X, and Y. In some embodiments, a fetal haplotype is determined for all of the fetal chromosomes. In various embodiments, the method determines essentially the entire genome of the fetus. In some embodiments, the haplotype is determined for at least 30, 40, 50, 60, 70, 80, 90, or 95% of the genome of the fetus. In some embodiments, the haplotype determination of the fetus includes information about which allele is present for at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci.

Compositions of DNA

When performing an informatics analysis on sequencing data measured on a mixture of fetal and maternal blood to determine genomic information pertaining to the fetus, for example the ploidy state of the fetus, it may be advantageous to measure the allele distributions at a set of alleles. Unfortunately, in many cases, such as when attempting to determine the ploidy state of a fetus from the DNA mixture found in the plasma of a maternal blood sample, the amount of DNA available is not sufficient to directly measure the allele distributions with good fidelity in the mixture. In these cases, amplification of the DNA mixture will provide sufficient numbers of DNA molecules that the desired allele distributions may be measured with good fidelity. However, current methods of amplification typically used in the amplification of DNA for sequencing are often very biased, meaning that they do not amplify both alleles at a polymorphic locus by the same amount. A biased amplification can result in allele distributions that are quite different from the allele distributions in the original mixture. For most purposes, highly accurate measurements of the relative amounts of alleles present at polymorphic loci are not needed. In contrast, in an embodiment of the present disclosure, amplification or enrichment methods that specifically enrich polymorphic alleles and preserve allelic ratios is advantageous.

A number of methods are described herein that may be used to preferentially enrich a sample of DNA at a plurality of loci in a way that minimizes allelic bias. Some examples are using circularizing probes to target a plurality of loci where the 3' ends and 5' ends of the pre-circularized probe are designed to hybridize to bases that are one or a few positions away from the polymorphic sites of the targeted allele. Another is to use PCR probes where the 3' end PCR probe is designed to hybridize to bases that are one or a few positions away from the polymorphic sites of the targeted allele. Another is to use a split and pool approach to create mixtures of DNA where the preferentially enriched loci are enriched with low allelic bias without the drawbacks of direct multiplexing. Another is to use a hybrid capture approach where the capture probes are designed such that the region of the capture probe that is designed to hybridize to the DNA flanking the polymorphic site of the target is separated from the polymorphic site by one or a small number of bases.

In the case where measured allele distributions at a set of polymorphic loci are used to determine the ploidy state of an individual, it is desirable to preserve the relative amounts of alleles in a sample of DNA as it is prepared for genetic measurements. This preparation may involve WGA amplification, targeted amplification, selective enrichment techniques, hybrid capture techniques, circularizing probes or other methods meant to amplify the amount of DNA and/or selectively enhance the presence of molecules of DNA that correspond to certain alleles.

In some embodiments of the present disclosure, there is a set of DNA probes designed to target loci where the loci have maximal minor allele frequencies. In some embodiments of the present disclosure, there is a set of probes that are designed to target where the loci have the maximum likelihood of the fetus having a highly informative SNP at those loci. In some embodiments of the present disclosure, there is a set of probes that are designed to target loci where the probes are optimized for a given population subgroup. In some embodiments of the present disclosure, there is a set of probes that are designed to target loci where the probes are optimized for a given mix of population subgroups. In some embodiments of the present disclosure, there is a set of probes that are designed to target loci where the probes are optimized for a given pair of parents which are from different population subgroups that have different minor allele frequency profiles. In some embodiments of the present disclosure, there is a circularized strand of DNA that comprises at least one base pair that annealed to a piece of DNA that is of fetal origin. In some embodiments of the present disclosure, there is a circularized strand of DNA that comprises at least one base pair that annealed to a piece of DNA that is of placental origin. In some embodiments of the present disclosure, there is a circularized strand of DNA that circularized while at least some of the nucleotides were annealed to DNA that was of fetal origin. In some embodiments of the present disclosure, there is a circularized strand of DNA that circularized while at least some of the nucleotides were annealed to DNA that was of placental origin. In some embodiments of the present disclosure, there is a set of probes wherein some of the probes target single tandem repeats, and some of the probes target single nucleotide polymorphisms. In some embodiments, the loci are selected for the purpose of non-invasive prenatal diagnosis. In some embodiments, the probes are used for the purpose of non-invasive prenatal diagnosis. In some embodiments, the loci are targeted using a method that could include circularizing probes, MIPs, capture by hybridization probes, probes on a SNP array, or combinations thereof. In some embodiments, the probes are used as circularizing probes, MIPs, capture by hybridization probes, probes on a SNP array, or combinations thereof. In some embodiments, the loci are sequenced for the purpose of non-invasive prenatal diagnosis.

In the case where the relative informativeness of a sequence is greater when combined with relevant parent contexts, it follows that maximizing the number of sequence reads that contain a SNP for which the parental context is known may maximize the informativeness of the set of sequencing reads on the mixed sample. In an embodiment, the number of sequence reads that contain a SNP for which the parent contexts are known may be enhanced by using qPCR to preferentially amplify specific sequences. In an embodiment, the number of sequence reads that contain a SNP for which the parent contexts are known may be enhanced by using circularizing probes (for example, MIPs) to preferentially amplify specific sequences. In an embodiment, the number of sequence reads that contain a SNP for which the parent contexts are known may be enhanced by using a capture by hybridization method (for example SURESELECT) to preferentially amplify specific sequences. Different methods may be used to enhance the number of sequence reads that contain a SNP for which the parent contexts are known. In an embodiment, the targeting may be accomplished by extension ligation, ligation without extension, capture by hybridization, or PCR.

In a sample of fragmented genomic DNA, a fraction of the DNA sequences map uniquely to individual chromosomes; other DNA sequences may be found on different chromosomes. Note that DNA found in plasma, whether maternal or fetal in origin is typically fragmented, often at lengths under 500 bp. In a typical genomic sample, roughly 3.3% of the mappable sequences will map to chromosome 13; 2.2% of the mappable sequences will map to chromosome 18; 1.35% of the mappable sequences will map to chromosome 21; 4.5% of the mappable sequences will map to chromosome X in a female; 2.25% of the mappable sequences will map to chromosome X (in a male); and 0.73% of the mappable sequences will map to chromosome Y (in a male). These are the chromosomes that are most likely to be aneuploid in a fetus. Also, among short sequences, approximately 1 in 20 sequences will contain a SNP, using the SNPs contained on dbSNP. The proportion may well be higher given that there may be many SNPs that have not been discovered.

In an embodiment of the present disclosure, targeting methods may be used to enhance the fraction of DNA in a sample of DNA that map to a given chromosome such that the fraction significantly exceeds the percentages listed above that are typical for genomic samples. In an embodiment of the present disclosure, targeting methods may be used to enhance the fraction of DNA in a sample of DNA such that the percentage of sequences that contain a SNP are significantly greater than what may be found in typical for genomic samples. In an embodiment of the present disclosure, targeting methods may be used to target DNA from a chromosome or from a set of SNPs in a mixture of maternal and fetal DNA for the purposes of prenatal diagnosis.

Note that a method has been reported (U.S. Pat. No. 7,888,017) for determining fetal aneuploidy by counting the number of reads that map to a suspect chromosome and comparing it to the number of reads that map to a reference chromosome, and using the assumption that an overabundance of reads on the suspect chromosome corresponds to a triploidy in the fetus at that chromosome. Those methods for prenatal diagnosis would not make use of targeting of any sort, nor do they describe the use of targeting for prenatal diagnosis.

By making use of targeting approaches in sequencing the mixed sample, it may be possible to achieve a certain level of accuracy with fewer sequence reads. The accuracy may refer to sensitivity, it may refer to specificity, or it may refer to some combination thereof. The desired level of accuracy may be between 90% and 95%; it may be between 95% and 98%; it may be between 98% and 99%; it may be between 99% and 99.5%; it may be between 99.5% and 99.9%; it may be between 99.9% and 99.99%; it may be between 99.99% and 99.999%, it may be between 99.999% and 100%. Levels of accuracy above 95% may be referred to as high accuracy.

There are a number of published methods in the prior art that demonstrate how one may determine the ploidy state of a fetus from a mixed sample of maternal and fetal DNA, for example: G. J. W. Liao et al. Clinical Chemistry 2011; 57(1) pp. 92-101. These methods focus on thousands of locations along each chromosome. The number of locations along a chromosome that may be targeted while still resulting in a high accuracy ploidy determination on a fetus, for a given number of sequence reads, from a mixed sample of DNA is unexpectedly low. In an embodiment of the present disclosure, an accurate ploidy determination may be made by using targeted sequencing, using any method of targeting, for example qPCR, ligand mediated PCR, other PCR methods, capture by hybridization, or circularizing probes, wherein the number of loci along a chromosome that need to be targeted may be between 5,000 and 2,000 loci; it may be between 2,000 and 1,000 loci; it may be between 1,000 and 500 loci; it may be between 500 and 300 loci; it may be between 300 and 200 loci; it may be between 200 and 150 loci; it may be between 150 and 100 loci; it may be between 100 and 50 loci; it may be between 50 and 20 loci; it may be between 20 and 10 loci. Optimally, it may be between 100 and 500 loci. The high level of accuracy may be achieved by targeting a small number of loci and executing an unexpectedly small number of sequence reads. The number of reads may be between 100 million and 50 million reads; the number of reads may be between 50 million and 20 million reads; the number of reads may be between 20 million and 10 million reads; the number of reads may be between 10 million and 5 million reads; the number of reads may be between 5 million and 2 million reads; the number of reads may be between 2 million and 1 million; the number of reads may be between 1 million and 500,000; the number of reads may be between 500,000 and 200,000; the number of reads may be between 200,000 and 100,000; the number of reads may be between 100,000 and 50,000; the number of reads may be between 50,000 and 20,000; the number of reads may be between 20,000 and 10,000; the number of reads may be below 10,000. Fewer number of read are necessary for larger amounts of input DNA.

In some embodiments, there is a composition comprising a mixture of DNA of fetal origin, and DNA of maternal origin, wherein the percent of sequences that uniquely map to chromosome 13 is greater than 4%, greater than 5%, greater than 6%, greater than 7%, greater than 8%, greater than 9%, greater than 10%, greater than 12%, greater than 15%, greater than 20%, greater than 25%, or greater than 30%. In some embodiments of the present disclosure, there is a composition comprising a mixture of DNA of fetal origin, and DNA of maternal origin, wherein the percent of sequences that uniquely map to chromosome 18 is greater than 3%, greater than 4%, greater than 5%, greater than 6%, greater than 7%, greater than 8%, greater than 9%, greater than 10%, greater than 12%, greater than 15%, greater than 20%, greater than 25%, or greater than 30%. In some embodiments of the present disclosure, there is a composition comprising a mixture of DNA of fetal origin, and DNA of maternal origin, wherein the percent of sequences that uniquely map to chromosome 21 is greater than 2%, greater than 3%, greater than 4%, greater than 5%, greater than 6%, greater than 7%, greater than 8%, greater than 9%, greater than 10%, greater than 12%, greater than 15%, greater than 20%, greater than 25%, or greater than 30%. In some embodiments of the present disclosure, there is a composition comprising a mixture of DNA of fetal origin, and DNA of maternal origin, wherein the percent of sequences that uniquely map to chromosome X is greater than 6%, greater than 7%, greater than 8%, greater than 9%, greater than 10%, greater than 12%, greater than 15%, greater than 20%, greater than 25%, or greater than 30%. In some embodiments of the present disclosure, there is a composition comprising a mixture of DNA of fetal origin, and DNA of maternal origin, wherein the percent of sequences that uniquely map to chromosome Y is greater than 1%, greater than 2%, greater than 3%, greater than 4%, greater than 5%, greater than 6%, greater than 7%, greater than 8%, greater than 9%, greater than 10%, greater than 12%, greater than 15%, greater than 20%, greater than 25%, or greater than 30%.

In some embodiments, a composition is described comprising a mixture of DNA of fetal origin, and DNA of maternal origin, wherein the percent of sequences that uniquely map to a chromosome, and that contains at least one single nucleotide polymorphism is greater than 0.2%, greater than 0.3%, greater than 0.4%, greater than 0.5%, greater than 0.6%, greater than 0.7%, greater than 0.8%, greater than 0.9%, greater than 1%, greater than 1.2%, greater than 1.4%, greater than 1.6%, greater than 1.8%, greater than 2%, greater than 2.5%, greater than 3%, greater than 4%, greater than 5%, greater than 6%, greater than 7%, greater than 8%, greater than 9%, greater than 10%, greater than 12%, greater than 15%, or greater than 20%, and where the chromosome is taken from the group 13, 18, 21, X, or Y. In some embodiments of the present disclosure, there is a composition comprising a mixture of DNA of fetal origin, and DNA of maternal origin, wherein the percent of sequences that uniquely map to a chromosome and that contain at least one single nucleotide polymorphism from a set of single nucleotide polymorphisms is greater than 0.15%, greater than 0.2%, greater than 0.3%, greater than 0.4%, greater than 0.5%, greater than 0.6%, greater than 0.7%, greater than 0.8%, greater than 0.9%, greater than 1%, greater than 1.2%, greater than 1.4%, greater than 1.6%, greater than 1.8%, greater than 2%, greater than 2.5%, greater than 3%, greater than 4%, greater than 5%, greater than 6%, greater than 7%, greater than 8%, greater than 9%, greater than 10%, greater than 12%, greater than 15%, or greater than 20%, where the chromosome is taken from the set of chromosome 13, 18, 21, X and Y, and where the number of single nucleotide polymorphisms in the set of single nucleotide polymorphisms is between 1 and 10, between 10 and 20, between 20 and 50, between 50 and 100, between 100 and 200, between 200 and 500, between 500 and 1,000, between 1,000 and 2,000, between 2,000 and 5,000, between 5,000 and 10,000, between 10,000 and 20,000, between 20,000 and 50,000, and between 50,000 and 100,000.

In theory, each cycle in the amplification doubles the amount of DNA present; however, in reality, the degree of amplification is slightly lower than two. In theory, amplification, including targeted amplification, will result in bias free amplification of a DNA mixture; in reality, however, different alleles tend to be amplified to a different extent than other alleles. When DNA is amplified, the degree of allelic bias typically increases with the number of amplification steps. In some embodiments, the methods described herein involve amplifying DNA with a low level of allelic bias. Since the allelic bias compounds with each additional cycle, one can determine the per cycle allelic bias by calculating the nth root of the overall bias where n is the base 2 logarithm of degree of enrichment. In some embodiments, there is a composition comprising a second mixture of DNA, where the second mixture of DNA has been preferentially enriched at a plurality of polymorphic loci from a first mixture of DNA where the degree of enrichment is at least 10, at least 100, at least 1,000, at least 10,000, at least 100,000 or at least 1,000,000, and where the ratio of the alleles in the second mixture of DNA at each locus differs from the ratio of the alleles at that locus in the first mixture of DNA by a factor that is, on average, less than 1,000%, 500%, 200%, 100%, 50%, 20%, 10%, 5%, 2%, 1%, 0.5%, 0.2%, 0.1%, 0.05%, 0.02%, or 0.01%. In some embodiments, there is a composition comprising a second mixture of DNA, where the second mixture of DNA has been preferentially enriched at a plurality of polymorphic loci from a first mixture of DNA where the per cycle allelic bias for the plurality of polymorphic loci is, on average, less than 10%, 5%, 2%, 1%, 0.5%, 0.2%, 0.1%, 0.05%, or 0.02%. In some embodiments, the plurality of polymorphic loci comprises at least 10 loci, at least 20 loci, at least 50 loci, at least 100 loci, at least 200 loci, at least 500 loci, at least 1,000 loci, at least 2,000 loci, at least 5,000 loci, at least 10,000 loci, at least 20,000 loci, or at least 50,000 loci.

Some Embodiments

In some embodiments, a method is disclosed herein for generating a report disclosing the determined ploidy status of a chromosome in a gestating fetus, the method comprising: obtaining a first sample that contains DNA from the mother of the fetus and DNA from the fetus; obtaining genotypic data from one or both parents of the fetus; preparing the first sample by isolating the DNA so as to obtain a prepared sample; measuring the DNA in the prepared sample at a plurality of polymorphic loci; calculating, on a computer, allele counts or allele count probabilities at the plurality of polymorphic loci from the DNA measurements made on the prepared sample; creating, on a computer, a plurality of ploidy hypotheses concerning expected allele count probabilities at the plurality of polymorphic loci on the chromosome for different possible ploidy states of the chromosome; building, on a computer, a joint distribution model for allele count probability of each polymorphic locus on the chromosome for each ploidy hypothesis using genotypic data from the one or both parents of the fetus; determining, on a computer, a relative probability of each of the ploidy hypotheses using the joint distribution model and the allele count probabilities calculated for the prepared sample; calling the ploidy state of the fetus by selecting the ploidy state corresponding to the hypothesis with the greatest probability; and generating a report disclosing the determined ploidy status.

In some embodiments, the method is used to determine the ploidy state of a plurality of gestating fetuses in a plurality of respective mothers, the method further comprising: determining the percent of DNA that is of fetal origin in each of the prepared samples; and wherein the step of measuring the DNA in the prepared sample is done by sequencing a number of DNA molecules in each of the prepared samples, where more molecules of DNA are sequenced from those prepared samples that have a smaller fraction of fetal DNA than those prepared samples that have a larger fraction of fetal DNA.

In some embodiments, the method is used to determine the ploidy state of a plurality of gestating fetuses in a plurality of respective mothers, and where the measuring the DNA in the prepared sample is done, for each of the fetuses, by sequencing a first fraction of the prepared sample of DNA to give a first set of measurements, the method further comprising: making a first relative probability determination for each of the ploidy hypotheses for each of the fetuses, given the first set of DNA measurements; resequencing a second fraction of the prepared sample from those fetuses where the first relative probability determination for each of the ploidy hypotheses indicates that a ploidy hypothesis corresponding to an aneuploid fetus has a significant but not conclusive probability, to give a second set of measurements; making a second relative probability determination for ploidy hypotheses for the fetuses using the second set of measurements and optionally also the first set of measurements; and calling the ploidy states of the fetuses whose second sample was resequenced by selecting the ploidy state corresponding to the hypothesis with the greatest probability as determined by the second relative probability determination.

In some embodiments, a composition of matter is disclosed, the composition of matter comprising: a sample of preferentially enriched DNA, wherein the sample of preferentially enriched DNA has been preferentially enriched at a plurality of polymorphic loci from a first sample of DNA, wherein the first sample of DNA consisted of a mixture of maternal DNA and fetal DNA derived from maternal plasma, where the degree of enrichment is at least a factor of 2, and wherein the allelic bias between the first sample and the preferentially enriched sample is, on average, selected from the group consisting of less than 2%, less than 1%, less than 0.5%, less than 0.2%, less than 0.1%, less than 0.05%, less than 0.02%, and less than 0.01%. In some embodiments, a method is disclosed to create a sample of such preferentially enriched DNA.

In some embodiment, a method is disclosed for determining the presence or absence of a fetal aneuploidy in a maternal tissue sample comprising fetal and maternal genomic DNA, wherein the method comprises: (a) obtaining a mixture of fetal and maternal genomic DNA from said maternal tissue sample; (b) selectively enriching the mixture of fetal and maternal DNA at a plurality of polymorphic alleles; (c) distributing selectively enriched fragments from the mixture of fetal and maternal genomic DNA of step a to provide reaction samples comprising a single genomic DNA molecule or amplification products of a single genomic DNA molecule; (d) conducting massively parallel DNA sequencing of the selectively enriched fragments of step c) to determine the sequence of said selectively enriched fragments; (e) identifying the chromosomes to which the sequences obtained in step d) belong; (f) analyzing the data of step d) to determine i) the number of fragments of genomic DNA from step d) that belong to at least one first target chromosome that is presumed to be diploid in both the mother and the fetus, and ii) the number of fragments of genomic DNA from step d) that belong to a second target chromosome, wherein said second chromosome is suspected to be aneuploid in the fetus; (g) calculating an expected distribution of the number of fragments of genomic DNA from step d) for the second target chromosome if the second target chromosome is euploid, using the number determined in step f) part i); (h) calculating an expected distribution of the number of fragments of genomic DNA from step d) for the second target chromosome if the second target chromosome is aneuploid, using the first number is step f) part i) and an estimated fraction of fetal DNA found in the mixture of step b); and (i) using a maximum likelihood or maximum a posteriori approach to determine whether the number of fragments of genomic DNA determined in step f) part ii) is more likely to be part of the distribution calculated in step g) or the distribution calculated in step h); thereby indicating the presence or absence of a fetal aneuploidy.

Exemplary Cancer Diagnostic Methods

Note that it has been demonstrated that DNA that originated from cancer that is living in a host can be found in the blood of the host. In the same way that genetic diagnoses can be made from the measurement of mixed DNA found in maternal blood, genetic diagnoses can equally well be made from the measurement of mixed DNA found in host blood. The genetic diagnoses may include aneuploidy states, or gene mutations. Any claim in the instant disclosure that reads on determining the ploidy state or genetic state of a fetus from the measurements made on maternal blood can equally well read on determining the ploidy state or genetic state of a cancer from the measurements on host blood.

In some embodiments, a method of the present disclosure allows one to determine the ploidy status of a cancer, the method including obtaining a mixed sample that contains genetic material from the host, and genetic material from the cancer; measuring the DNA in the mixed sample; calculating the fraction of DNA that is of cancer origin in the mixed sample; and determining the ploidy status of the cancer using the measurements made on the mixed sample and the calculated fraction. In some embodiments, the method may further include administering a cancer therapeutic based on the determination of the ploidy state of the cancer. In some embodiments, the method may further include administering a cancer therapeutic based on the determination of the ploidy state of the cancer, wherein the cancer therapeutic is taken from the group comprising a pharmaceutical, a biologic therapeutic, and antibody based therapy and combination thereof.

Exemplary Clinical Actions

In some embodiments, any of the methods include taking a clinical action based on a result of a method of the invention (such as the determination of the presence or absence of a polymorphism or mutation, ploidy state, or paternity). In some embodiments in which an embryo or fetus has one or more one or more polymorphisms or mutations of interest (such as a CNV) based on a result of a method of the invention, the clinical action includes performing additional testing (such as testing to confirm the presence of the polymorphism or mutation), not implanting the embryo for IVF, implanting a different embryo for IVF, terminating a pregnancy, preparing for a special needs child, or undergoing an intervention designed to decrease the severity of the phenotypic presentation of a genetic disorder. In some embodiments, the clinical action is selected from the group consisting of performing an ultrasound, amniocentesis on the fetus, amniocentesis on a subsequent fetus that inherits genetic material from the mother and/or father, chorion villus biopsy on the fetus, chorion villus biopsy on a subsequent fetus that inherits genetic material from the mother and/or father, in vitro fertilization, preimplantation genetic diagnosis on one or more embryos that inherited genetic material from the mother and/or father, karyotyping on the mother, karyotyping on the father, fetal echocardiogram (such as an echocardiogram of a fetus with trisomy 21, 18, or 13, monosomy X, or a microdeletion), and combinations thereof. In some embodiments, the clinical action is selected from the group consisting of administering growth hormone to a born child with monosomy X (such as administration starting at ~9 months), administering calcium to a born child with a 22q deletion (such as DiGeorge syndrome), administering an androgen such as testosterone to a born child with 47,XXY (such as one injection per month for 3 months of 25 mg testosterone enanthate to an infant or toddler), performing a test for cancer on a woman with a complete or partial molar pregnancy (such as a triploid fetus), administering a therapy for cancer such as a chemotherapeutic agent to a woman with a complete or partial molar pregnancy (such as a triploid fetus), screening a fetus determined to be male (such as a fetus determined to be male using a method of the invention) for one or more X-linked genetic disorders such as Duchenne muscular dystrophy (DMD), adrenoleukodystrophy, or hemophilia, performing amniocentesis on a male fetus at risk for an X-linked disorder, administering dexamethasone to a women with a female fetus at risk male (such as a fetus determined to be female using a method of the invention) for congenital adrenal hyperplasia, performing amniocentesis on a female fetus at risk for congenital adrenal hyperplasia, administering killed vaccines (instead of live vaccines) or not administering certain vaccines to a born child who is (or is suspected of being) immune deficient from a 22q11.2 deletion, performing occupational and/or physical therapy, performing early intervention in education, delivering the baby at a tertiary care center with a NICU and/or having pediatric specialists available at delivery, behavioral intervention for born child (such as a child with XXX, XXY, or XYY), and combinations thereof.

In some embodiments, ultrasound or another screening test is performed on a women determined to have multiple pregnancies (such as twins) to determine whether or not two or more of the fetus are monochorionic. Monozygotic twins result from ovulation and fertilization of a single oocyte, with subsequent division of the zygote; placentation may be dichorionic or monochorionic. Dizygotic twins occur from ovulation and fertilization of two oocytes, which usually results in dichorionic placentation. Monochorionic twins have a risk of twin-to-twin transfusion syndrome, which may cause unequal distribution of blood between fetuses that results in differences in their growth and development, sometimes resulting in stillbirth. Thus, twins determined to be monozygotic twins using a method of the invention are desirably tested (such as by ultrasound) to determine if they are monochorionic twins, and if so, these twins can be monitored (such as bi-weekly ultrasounds from 16 weeks) for signs of win-to-twin transfusion syndrome.

In some embodiments in which an embryo or fetus does not have one or more one or more polymorphisms or mutations of interest (such as a CNV) based on a result of a method of the invention, the clinical action includes implanting the embryo for IVF or continuing a pregnancy. In some embodiments, the clinical action is additional testing to confirm the absence of the polymorphism or mutation selected from the group consisting of performing an ultrasound, amniocentesis, chorion villus biopsy, and combinations thereof.

In some embodiments in which an individual has one or more polymorphisms or mutations (such as a polymorphism or mutation associated with a disease or disorder such as cancer or an increased risk for a disease or disorder such as cancer) based on a result of a method of the invention, the clinical action includes performing additional testing or administering one or more therapies for a disease or disorder (such as a therapy for cancer, a therapy for the specific type of cancer or type of mutation the individual is diagnosed with, or any of the therapies disclosed herein). In some embodiments, the clinical action is additional testing to confirm the presence or absence of a polymorphism or mutation selected from the group consisting of biopsy, surgery, medical imaging (such as a mammogram or an ultrasound), and combinations thereof. In some embodiments, the additional testing includes performing the same or a different method (such as any of the methods described herein) to confirm the presence or absence of the polymorphism or mutation (such as a CNV), such as testing either a second fraction of the same sample that was tested or a different sample from the same individual (such as the same pregnant mother, fetus, embryo, or individual at increased risk for cancer). In some embodiments, the additional testing is performed for an individual for whom the probability of a polymorphism or mutation (such as a CNV) is above a threshold value. In some embodiments, the additional testing is performed for an individual for whom the confidence or z-score for the determination of a polymorphism or mutation (such as a CNV) is above a threshold value (such as additional testing to confirm the presence of a likely polymorphism or mutation). In some embodiments, the additional testing is performed for an individual for whom the confidence or z-score for the determination of a polymorphism or mutation (such as a CNV) is between minimum and maximum threshold values (such as additional testing to increase the confidence that the initial result is correct). In some embodiments, the additional testing is performed for an individual for whom the confidence for the determination of the presence or absence of a polymorphism or mutation (such as a CNV) is below a threshold value (such as a "no call" result due to not being able to determine the presence or absence of the CNV with sufficient confidence). An exemplary Z core is calculated in Chiu et al. BMJ 2011; 342:c7401 (which is hereby incorporated by reference in its entirety) in which chromosome 21 is used as an example and can be replaced with any other chromosome or chromosome segment in the test sample.

Z score for percentage chromosome 21 in test case=
((percentage chromosome 21 in test case)-
(mean percentage chromosome 21 in reference controls))/(standard deviation of percentage chromosome 21 in reference controls).

In some embodiments, the additional testing is performed for an individual for whom the initial sample did not meet quality control guidelines or had a fetal fraction or a tumor fraction below a threshold value. In some embodiments, the method includes selecting an individual for additional testing based on the result of a method of the invention, the probability of the result, the confidence of the result, or the z-score; and performing the additional testing on the individual (such as on the same or a different sample). In some embodiments, a subject diagnosed with a disease or disorder (such as cancer) undergoes repeat testing using a method of the invention or known testing for the disease or disorder at multiple time points to monitor the progression of the disease or disorder or the remission or reoccurrence of the disease or disorder.

Exemplary Implementation Methods

Any of the embodiments disclosed herein may be implemented in digital electronic circuitry, integrated circuitry, specially designed ASICs (application-specific integrated circuits), computer hardware, firmware, software, or in combinations thereof. Apparatus of the presently disclosed embodiments can be implemented in a computer program product tangibly embodied in a machine-readable storage device for execution by a programmable processor; and method steps of the presently disclosed embodiments can be performed by a programmable processor executing a program of instructions to perform functions of the presently disclosed embodiments by operating on input data and generating output. The presently disclosed embodiments can be implemented advantageously in one or more computer programs that are executable and/or interpretable on a programmable system including at least one programmable processor, which may be special or general purpose, coupled to receive data and instructions from, and to transmit data and instructions to, a storage system, at least one input device, and at least one output device. Each computer program can be implemented in a high-level procedural or object-oriented programming language or in assembly or machine language if desired; and in any case, the language can be a compiled or interpreted language. A computer program may be deployed in any form, including as a stand-alone program, or as a module, component, subroutine, or other unit suitable for use in a computing environment. A computer program may be deployed to be executed or interpreted on one computer or on multiple computers at one site, or distributed across multiple sites and interconnected by a communication network.

Computer readable storage media, as used herein, refers to physical or tangible storage (as opposed to signals) and includes without limitation volatile and non-volatile, removable and non-removable media implemented in any method or technology for the tangible storage of information such as computer-readable instructions, data structures, program modules or other data. Computer readable storage media includes, but is not limited to, RAM, ROM, EPROM, EEPROM, flash memory or other solid state memory technology, CD-ROM, DVD, or other optical storage, magnetic cassettes, magnetic tape, magnetic disk storage or other magnetic storage devices, or any other physical or material medium which can be used to tangibly store the desired information or data or instructions and which can be accessed by a computer or processor.

In some embodiments, the invention features a computer configured to accomplish one or more of the in vitro methods described herein. In some embodiments, the data is analyzed by the computer system as described herein. In some embodiments, genetic data (such as sequencing or microarray data) from at least 100; 200; 500; 750; 1,000; 2,000; 5,000; 7,500; 10,000; 20,000; 25,000; 30,000; 40,000; 50,000; 75,000; or 100,000 different loci is analyzed by the computer is less than 200, 100, 60, 30, 20, 10, 5, or 1 minute, or in less than 30 or 10 seconds to detect the present or absence of a mutation (such as a CNV or SNV) at the loci.

Any of the methods described herein may include the output of data in a physical format, such as on a computer screen, or on a paper printout. In explanations of any embodiments elsewhere in this document, it should be understood that the described methods may be combined with the output of the actionable data in a format that can be acted upon by a physician. In addition, the described methods may be combined with the actual execution of a clinical decision that results in a clinical treatment, or the execution of a clinical decision to make no action. Some of the embodiments described in the document for determining genetic data pertaining to a target individual may be combined with the decision to select one or more embryos for transfer in the context of IVF, optionally combined with the process of transferring the embryo to the womb of the prospective mother. Some of the embodiments described in the document for determining genetic data pertaining to a target individual may be combined with the notification of a potential chromosomal abnormality, or lack thereof, with a medical professional, optionally combined with the decision to abort, or to not abort, a fetus in the context of prenatal diagnosis. Some of the embodiments described herein may be combined with the output of the actionable data, and the execution of a clinical decision that results in a clinical treatment, or the execution of a clinical decision to make no action.

Exemplary Diagnostic Boxes

In an embodiment, the present disclosure comprises a diagnostic box that is capable of partly or completely carrying out any of the methods described in this disclosure. In an embodiment, the diagnostic box may be located at a physician's office, a hospital laboratory, or any suitable location reasonably proximal to the point of patient care. The box may be able to run the entire method in a wholly automated fashion, or the box may require one or a number of steps to be completed manually by a technician. In an embodiment, the box may be able to analyze at least the genotypic data measured on the maternal plasma. In an embodiment, the box may be linked to means to transmit the genotypic data measured on the diagnostic box to an external computation facility which may then analyze the genotypic data, and possibly also generate a report. The diagnostic box may include a robotic unit that is capable of transferring aqueous or liquid samples from one container to another. It may comprise a number of reagents, both solid and liquid. It may comprise a high throughput sequencer. It may comprise a computer.

EXPERIMENTAL SECTION

The presently disclosed embodiments are described in the following Examples, which are set forth to aid in the understanding of the disclosure, and should not be construed to limit in any way the scope of the disclosure as defined in the claims which follow thereafter. The following examples are put forth so as to provide those of ordinary skill in the art with a complete disclosure and description of how to use the described embodiments, and are not intended to limit the scope of the disclosure nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by volume, and temperature is in degrees Centigrade. It should be understood that variations in the methods as described may be made without changing the fundamental aspects that the experiments are meant to illustrate.

Experiment 1

The objective was to show that a Bayesian maximum likelihood estimation (MLE) algorithm that uses parent genotypes to calculate fetal fraction improves accuracy of non-invasive prenatal trisomy diagnosis compared to published methods.

Figure 14:
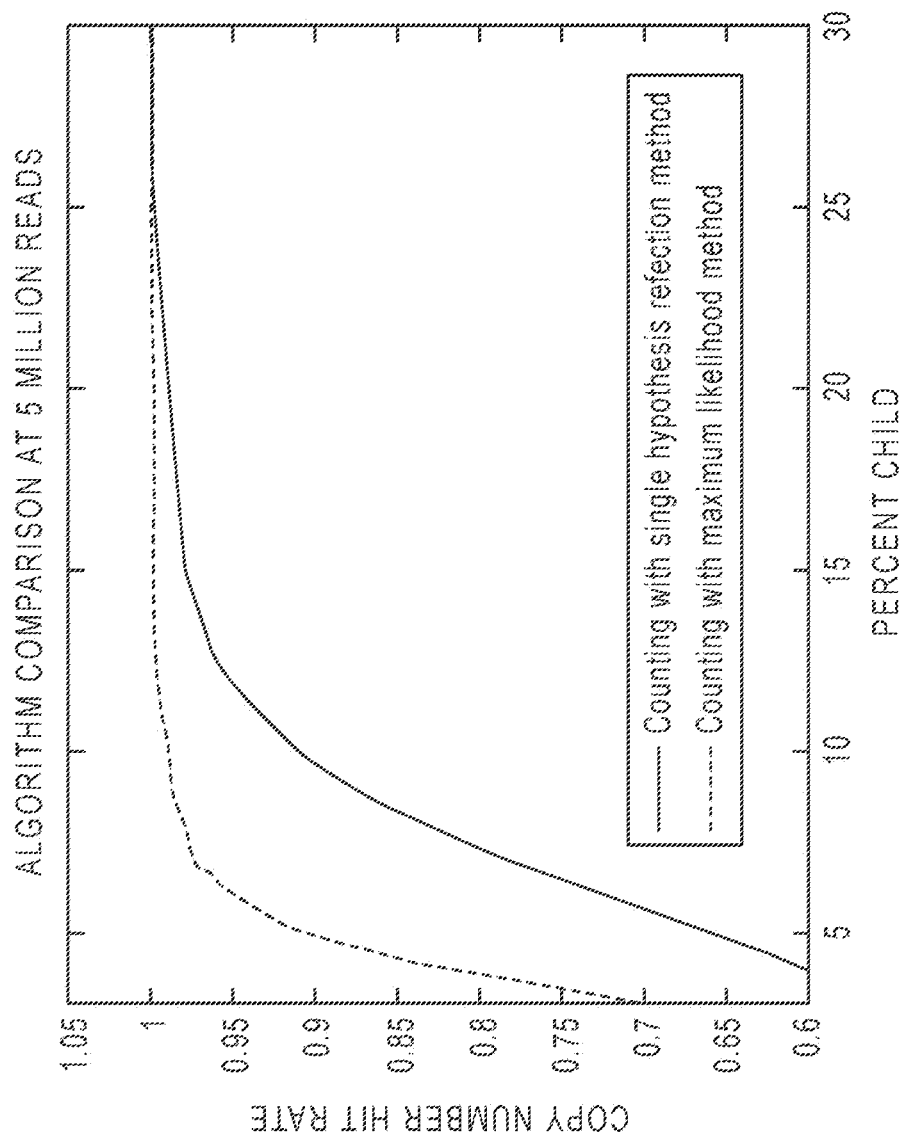
FIG. 14: Simulated ploidy call accuracies for counting method with two different analysis techniques.

Simulated sequencing data for maternal cfDNA was created by sampling reads obtained on trisomy-21 and respective mother cell lines. The rate of correct disomy and trisomy calls were determined from 500 simulations at various fetal fractions for a published method (Chiu et al. BMJ 2011; 342:c7401) and our MLE-based algorithm. We validated the simulations by obtaining 5 million shotgun reads from four pregnant mothers and respective fathers collected under an IRB-approved protocol. Parental genotypes were obtained on a 290K SNP array. (See FIG. 14)

In simulations, the MLE-based approach achieved 99.0% accuracy for fetal fractions as low as 9% and reported confidences that corresponded well to overall accuracy. We validated these results using four real samples wherein we obtained all correct calls with a computed confidence exceeding 99%. In contrast, our implementation of the published algorithm for Chiu et al. required 18% fetal fraction to achieve 99.0% accuracy, and achieved only 87.8% accuracy at 9% fetal DNA.

Fetal fraction determination from parental genotypes in conjunction with a MLE-based approach achieves greater accuracy than published algorithms at the fetal fractions expected during the 1st and early 2nd trimester. Furthermore, the method disclosed herein produces a confidence metric that is crucial in determining the reliability of the result, especially at low fetal fractions where ploidy detection is more difficult. Published methods use a less accurate threshold method for calling ploidy based on large sets of disomy training data, an approach that predefines a false positive rate. In addition, without a confidence metric, published methods are at risk of reporting false negative results when there is insufficient fetal cfDNA to make a call. In some embodiments, a confidence estimate is calculated for the called ploidy state.

Experiment 2

The objective was to improve non-invasive detection of fetal trisomy 18, 21, and X particularly in samples consisting of low fetal fraction by using a targeted sequencing approach combined with parent genotypes and Hapmap data in a Bayesian Maximum Likelihood Estimation (MLE) algorithm.

Maternal samples from four euploid and two trisomy-positive pregnancies and respective paternal samples were obtained under an IRB-approved protocol from patients where fetal karyotype was known. Maternal cfDNA was extracted from plasma and roughly 10 million sequence reads were obtained following preferential enrichment that targeted specific SNPs. Parent samples were similarly sequenced to obtain genotypes.

The described algorithm correctly called chromosome 18 and 21 disomy for all euploid samples and normal chromosomes of aneuploid samples. Trisomy 18 and 21 calls were correct, as were chromosome X copy numbers in male and female fetuses. The confidence produced by the algorithm was in excess of 98% in all cases.

The method described accurately reported the ploidy of all tested chromosomes from six samples, including samples comprised of less than 12% fetal DNA, which account for roughly 30% of $1^{st}$ and early $2^{nd}$-trimester samples. The crucial difference between the instant MLE algorithm and published methods is that it leverages parent genotypes and Hapmap data to improve accuracy and generate a confidence metric. At low fetal fractions, all methods become less accurate; it is important to correctly identify samples without sufficient fetal cfDNA to make a reliable call. Others have used chromosome Y specific probes to estimate fetal fraction of male fetuses, but concurrent parental genotyping enables estimation of fetal fraction for both sexes. Another inherent limitation of published methods using untargeted shotgun sequencing is that accuracy of ploidy calling varies among chromosomes due to differences in factors such as GC richness. The instant targeted sequencing approach is largely independent of such chromosome-scale variations and yields more consistent performance between chromosomes.

Experiment 3

The objective was to determine if trisomy is detectable with high confidence on a triploid fetus, using novel informatics to analyze SNP loci of free floating fetal DNA in maternal plasma.

20 mL of blood was drawn from a pregnant patient following abnormal ultrasound. After centrifugation, maternal DNA was extracted from the buffy coat (DNEASY, QIAGEN); cell-free DNA was extracted from plasma (QIAAMP QIAGEN). Targeted sequencing was applied to SNP loci on chromosomes 2, 21, and X in both DNA samples. Maximum-Likelihood Bayesian estimation selected the most likely hypothesis from the set of all possible ploidy states. The method determines fetal DNA fraction, ploidy state and explicit confidences in the ploidy determination. No assumptions are made about the ploidy of a reference chromosome. The diagnostic uses a test statistic that is independent of sequence read counts, which is the recent state of the art.

The instant method accurately diagnosed trisomy of chromosomes 2 and 21. Child fraction was estimated at 11.9% [CI 11.7-12.1]. The fetus was found to have one maternal and two paternal copies of chromosomes 2 and 21 with confidence of effectively 1 (error probability<$10^{-30}$). This was achieved with 92,600 and 258,100 reads on chromosomes 2 and 21 respectively.

This is the first demonstration of non-invasive prenatal diagnosis of trisomic chromosomes from maternal blood where the fetus was triploid, as confirmed by metaphase karyotype. Extant methods of non-invasive diagnosis would not detect aneuploidy in this sample. Current methods rely on a surplus of sequence reads on a trisomic chromosome relative to disomic reference chromosomes; but a triploid fetus has no disomic reference. Furthermore, extant methods would not achieve similarly high-confidence ploidy determination with this fraction of fetal DNA and number of sequence reads. It is straightforward to extend the approach to all 24 chromosomes.

Experiment 4

Figure 15:
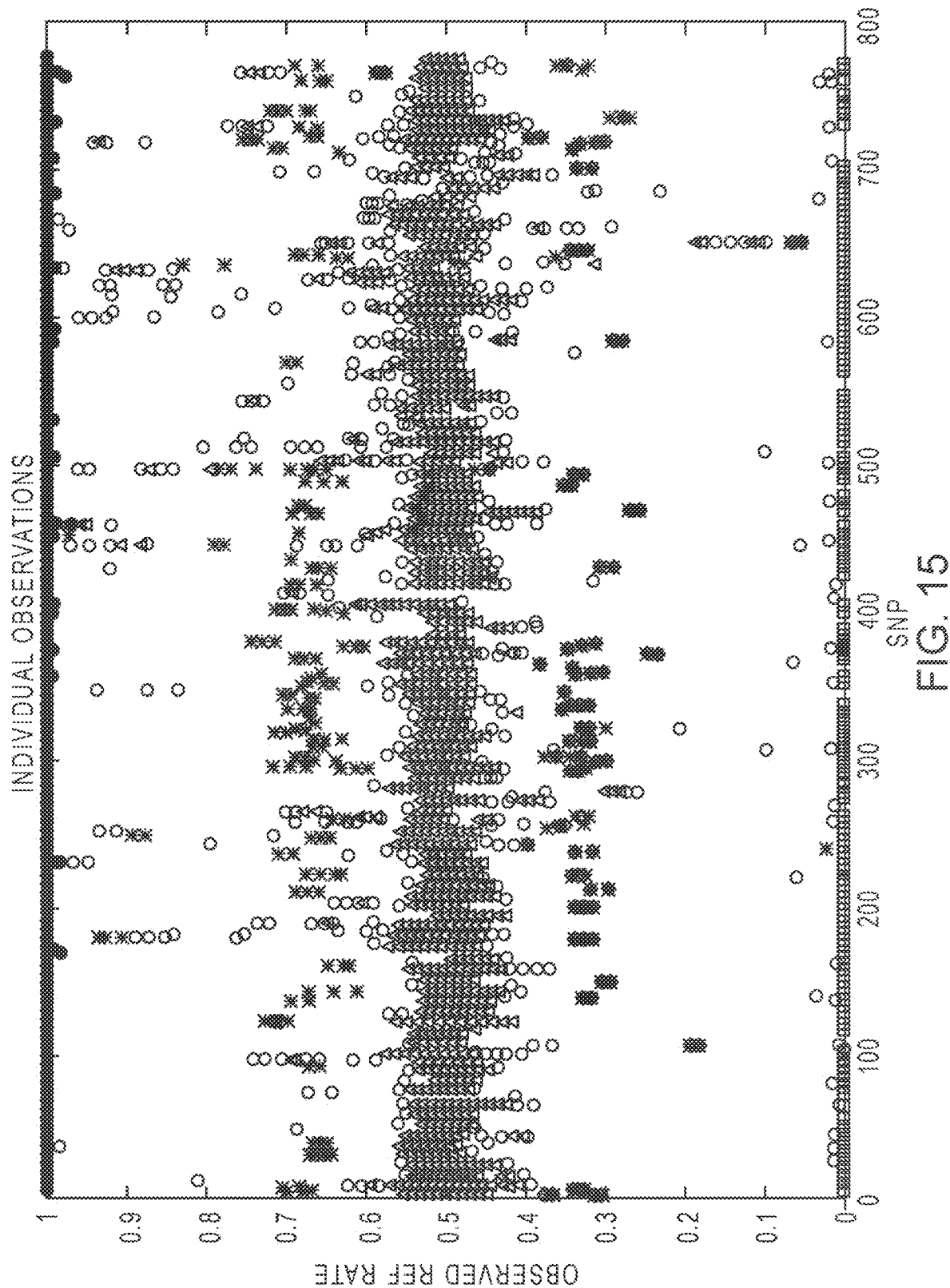
FIG. 15: Ratio of two alleles for a plurality of SNPs in a cell line in Experiment 4.
Figure 16:
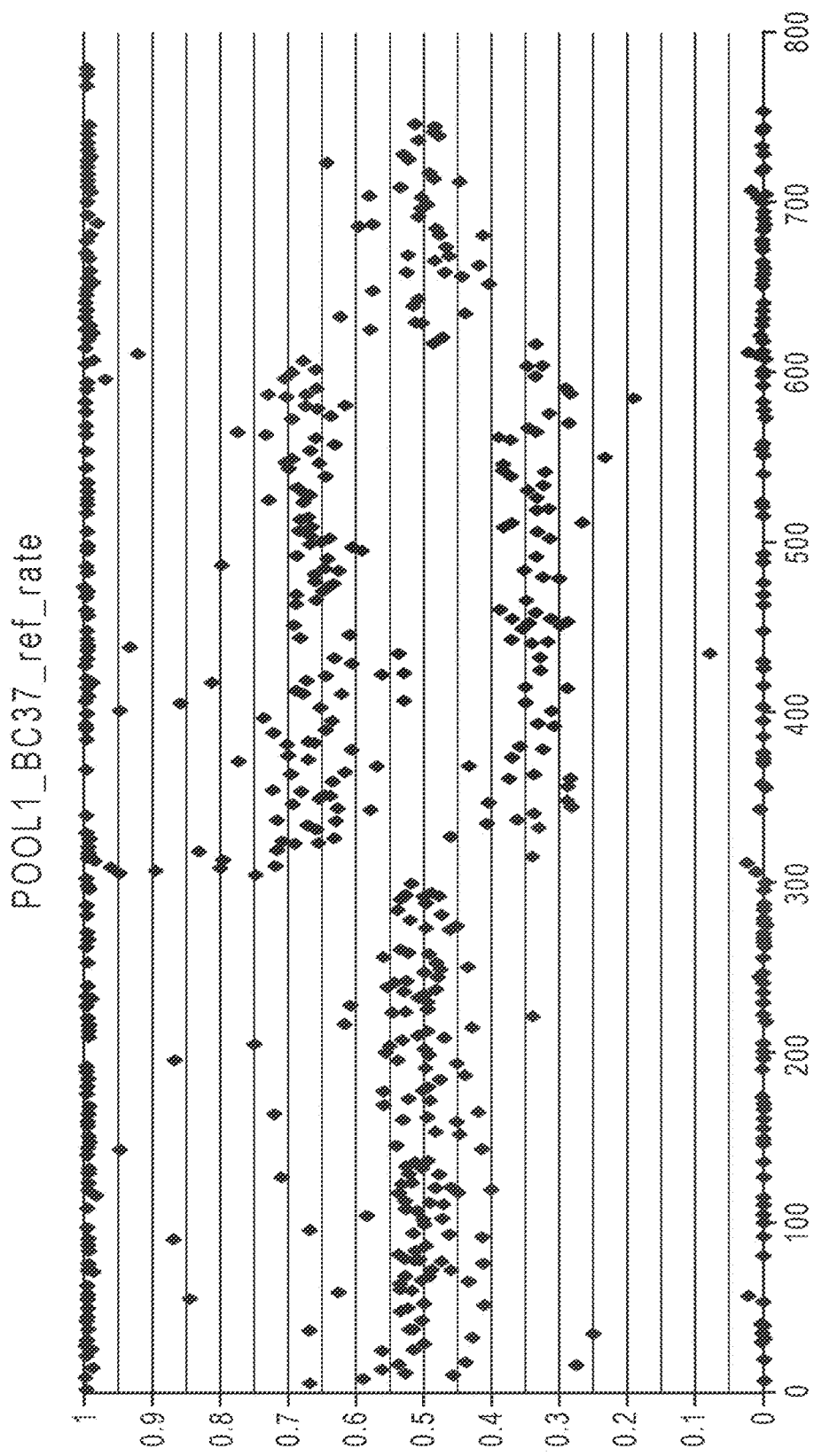
FIG. 16: Ratio of two alleles for a plurality of SNPs in a cell line in Experiment 4 sorted by chromosome.
Figure 17A:
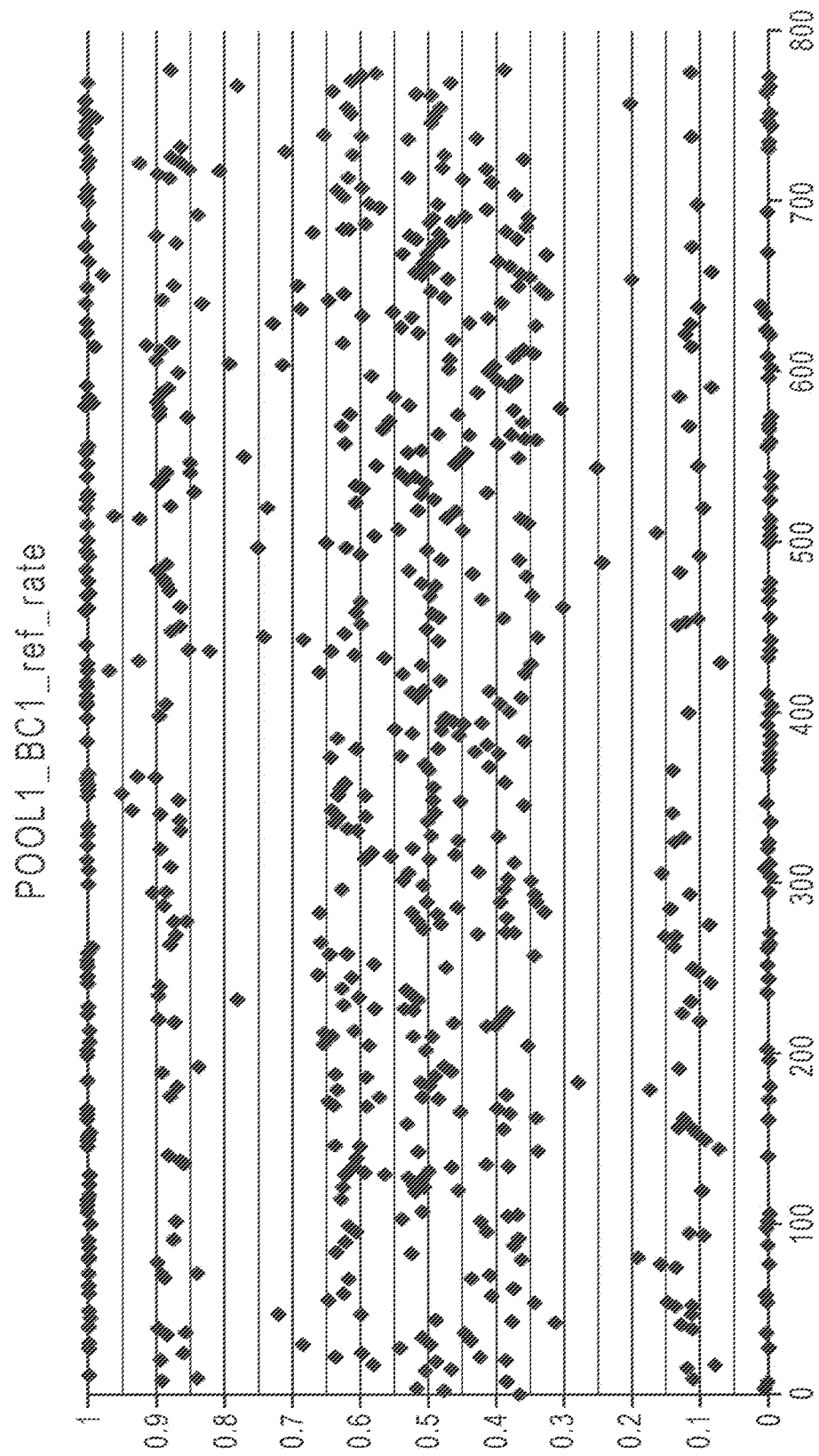
FIGS. 17A-17D: Ratio of two alleles for a plurality of SNPs in four pregnant women plasma samples, sorted by chromosome.
Figure 17B:
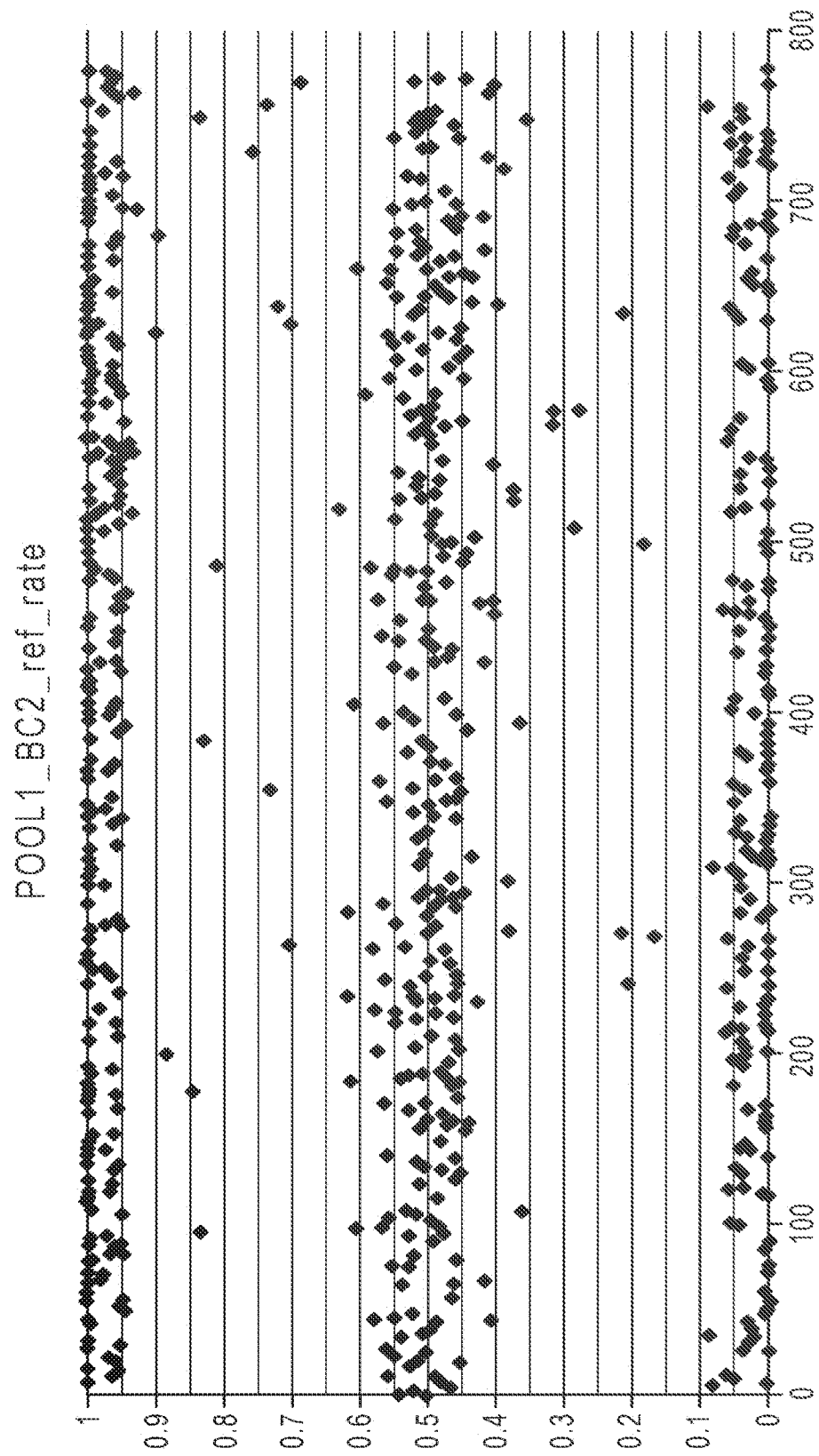
Figure 17C:
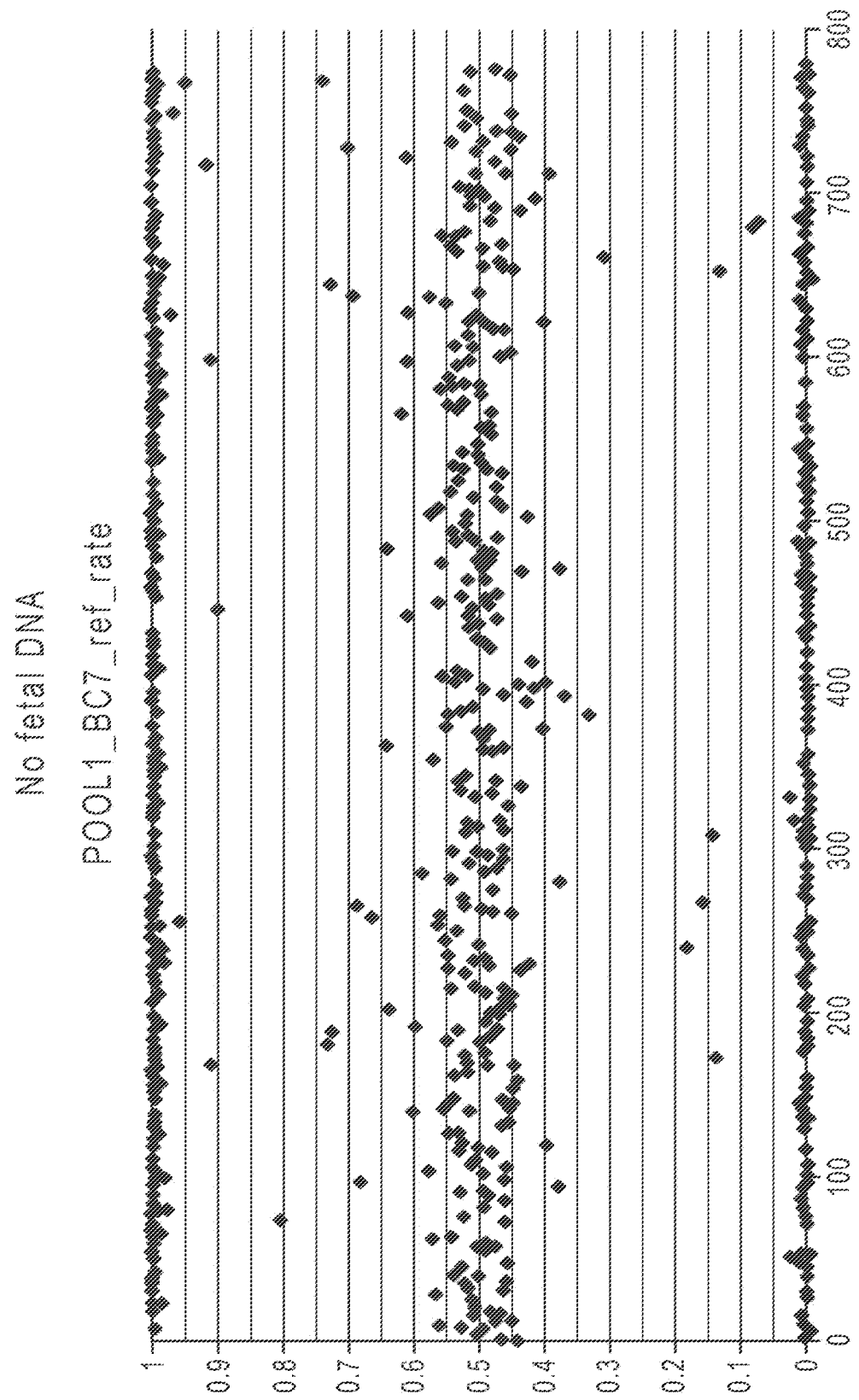
Figure 17D:
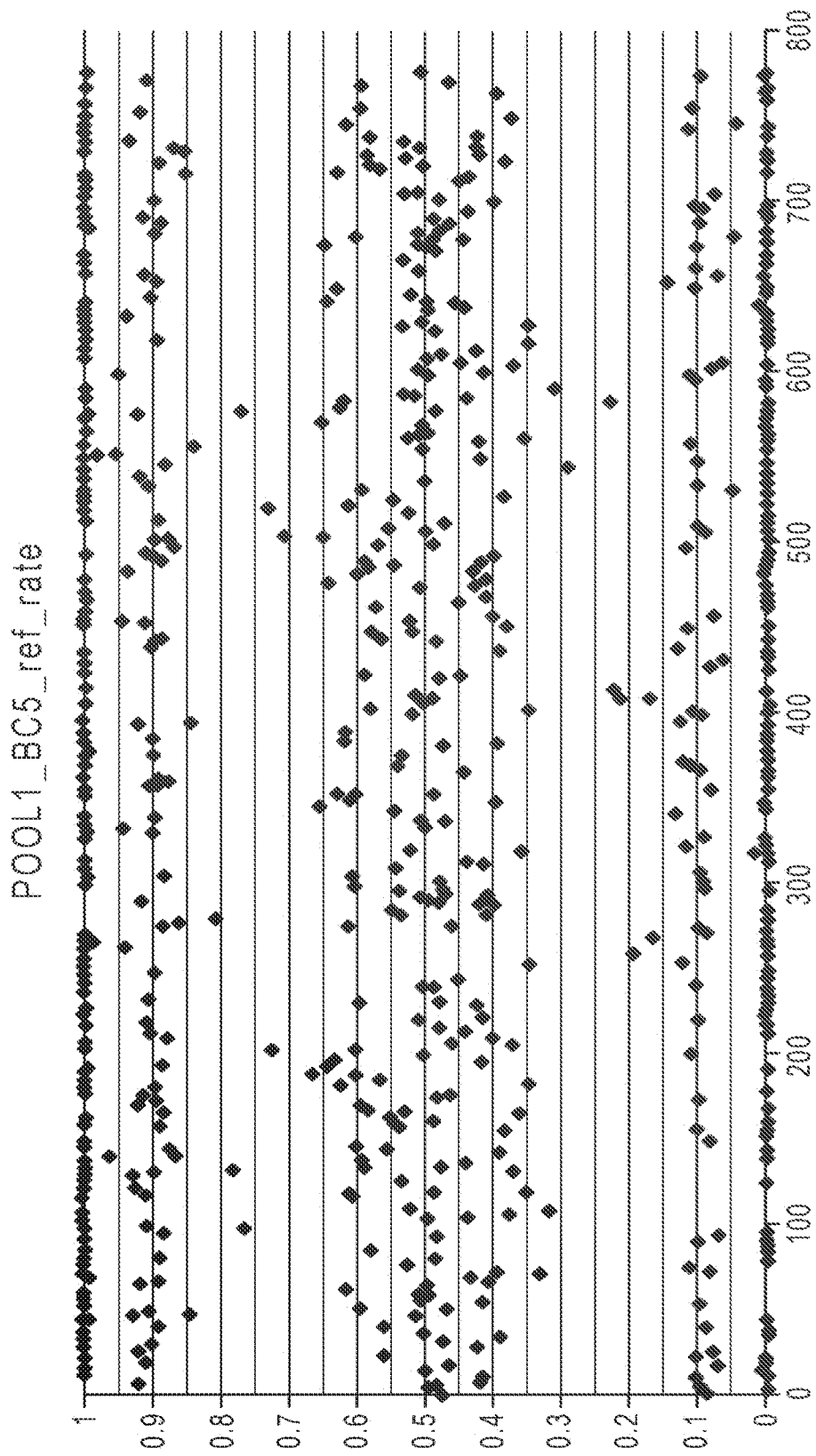

The following protocol was used for 800-plex amplification of DNA isolated from maternal plasma from a euploid pregnancy and also genomic DNA from a triploidy 21 cell line using standard PCR (meaning no nesting was used). Library preparation and amplification involved single tube blunt ending followed by A-tailing. Adaptor ligation was run using the ligation kit found in the AGILENT SURESELECT kit, and PCR was run for 7 cycles. Then, 15 cycles of STA (95° C. for 30s; 72° C. for 1 min; 60° C. for 4 min; 65° C. for 1 min; 72° C. for 30s) using 800 different primer pairs targeting SNPs on chromosomes 2, 21 and X. The reaction was run with 12.5 nM primer concentration. The DNA was then sequenced with an ILLUMINA IIGAX sequencer. The sequencer output 1.9 million reads, of which 92% mapped to the genome; of those reads that mapped to the genome, more than 99% mapped to one of the regions targeted by the targeted primers. The numbers were essentially the same for both the plasma DNA and the genomic DNA. FIG. 15 shows the ratio of the two alleles for the ~780 SNPs that were detected by the sequencer in the genomic DNA that was taken from a cell line with known trisomy at chromosome 21. Note that the allele ratios are plotted here for ease of visualization, because the allele distributions are not straightforward to read visually. The circles represent SNPs on disomic chromosomes, while the stars represent SNPs on a trisomic chromosome. FIG. 16 is another representation of the same data as in FIG. X, where the Y-axis is the relative number of A and B measured for each SNP, and where the X-axis is the SNP number where the SNPs are separated by chromosome. In FIG. 16, SNP 1 to 312 are found on chromosome 2, from SNP 313 to 605 are found on chromosome 21 which is trisomic, and from SNP 606 to 800 are on chromosome X. The data from chromosomes 2 and X show a disomic chromosome, as the relative sequence counts lie in three clusters: AA at the top of the graph, BB at the bottom of the graph, and AB in the middle of the graph. The data from chromosome 21, which is trisomic, shows four clusters: AAA at the top of the graph, AAB around the 0.65 line (⅔), ABB around the 0.35 line (⅓), and BBB at the bottom of the graph.

FIGS. 17A-D show data for the same 800-plex protocol, but measured on DNA that was amplified from four plasma samples from pregnant women. For these four samples, we expect to see seven clusters of dots: (1) along the top of the graph are those loci where both the mother and the fetus are AA, (2) slightly below the top of the graph are those loci where the mother is AA and the fetus is AB, (3) slightly above the 0.5 line are those loci where the mother is AB and the fetus is AA, (4) along the 0.5 line are those loci where the mother and the fetus are both AB, (5) slightly below the 0.5 line are those loci where the mother is AB and the fetus is BB, (6) slightly above the bottom of the graph are those loci where the mother is BB and the fetus is AB, (1) along the bottom of the graph are those loci where both the mother and the fetus are BB. The smaller the fetal fraction, the less the separation between clusters (1) and (2), between clusters (3), (4) and (5), and between clusters (6) and (7). The separation is expected to be half of the fraction of DNA that is of fetal origin. For example if the DNA is 20% fetal, and 80% maternal, we expect (1) through (7) to be centered at 1.0, 0.9, 0.6, 0.5, 0.4, 0.1 and 0.0 respectively; see for example FIG. 17D, POOL1_BC5_ref_rate. If, instead the DNA is 8% fetal, and 92% maternal, we expect (1) through (7) to be centered at 1.00, 0.96, 0.54, 0.50, 0.46, 0.04 and 0.00 respectively; see for example FIG. 17B, POOL1_BC2_ref_rate. If there is not fetal DNA detected, we do not expect to see (2), (3), (5), or (6); alternately we could say that the separation is zero, and therefore (1) and (2) are on top of each other, as are (3), (4) and (5), and also (6) and (7); see e.g. FIG. 17C, POOL1_BC7_ref_rate. Note that the fetal fraction for FIG. 17A, POOL1_BC1_ref_rate is about 25%.

Experiment 5

Figure 18:
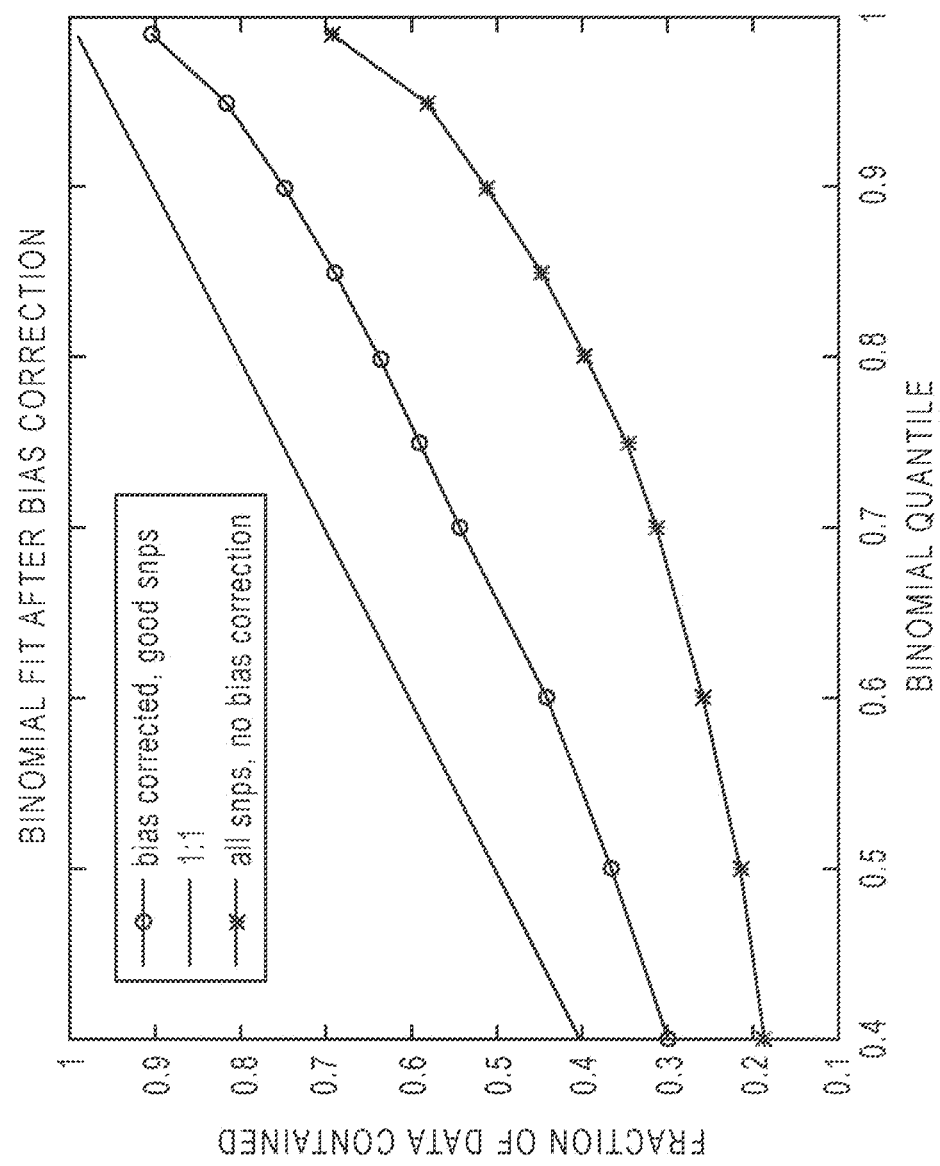
FIG. 18: Fraction of data that can be explained by binomial variance before and after data correction.

Most methods of DNA amplification and measurement will produce some allele bias, wherein the two alleles that are typically found at a locus are detected with intensities or counts that are not representative of the actual amounts of alleles in the sample of DNA. For example, for a single individual, at a heterozygous locus we expect to see a 1:1 ratio of the two alleles, which is the theoretical ratio expected for a heterozygous locus; however due to allele bias, we may see 55:45, or even 60:40. Also note that in the context of sequencing, if the depth of read is low, then simple stochastic noise could result in significant allele bias. In an embodiment, it is possible to model the behavior of each SNP such that if a consistent bias is observed for particular alleles, this bias can be corrected for. FIG. 18 shows the fraction of data that can be explained by binomial variance, before and after bias correction. In FIG. 18, the stars represent the observed allele bias on raw sequence data for the 800-plex experiment; the circles represent the allele bias after correction. Note that if there were no allele bias at all, we would expect the data to fall along the x=y line. A similar set of data that was produced by amplifying DNA using a 150-plex targeted amplification produced data that fell very closely on the 1:1 line after bias correction.

Experiment 6

Figure 19:
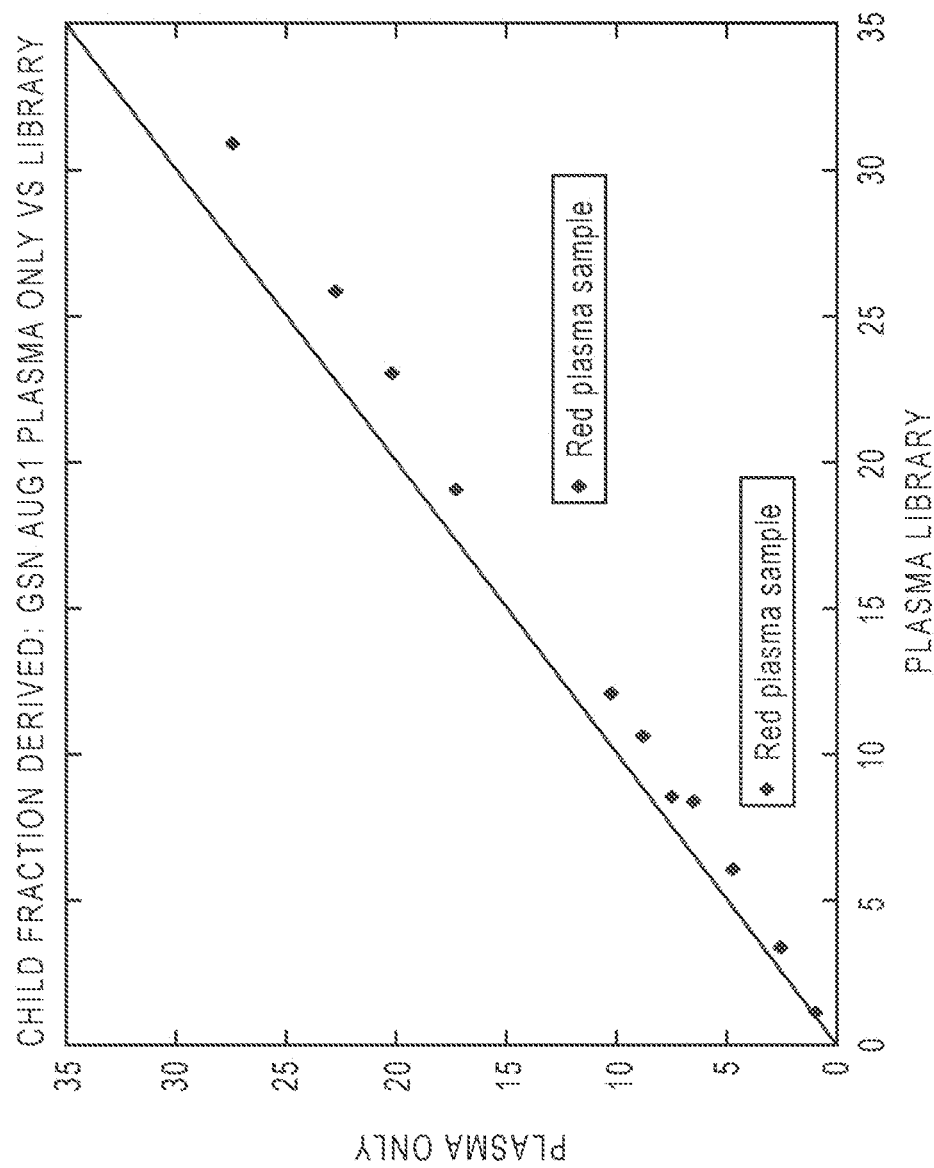
FIG. 19: Graph showing relative enrichment of fetal DNA in samples following a short library preparation protocol.

Universal amplification of DNA using ligated adaptors with primers specific to the adaptor tags, where the primer annealing and extension times are limited to a few minutes has the effect of enriching the proportion of shorter DNA strands. Most library protocols designed for creating DNA libraries suitable for sequencing contain such a step, and example protocols are published and well known to those in the art. In some embodiments of the invention, adaptors with a universal tag are ligated to the plasma DNA, and amplified using primers specific to the adaptor tag. In some embodiments, the universal tag can be the same tag as used for sequencing, it can be a universal tag only for PCR amplification, or it can be a set of tags. Since the fetal DNA is typically short in nature, while the maternal DNA can be both short and long in nature, this method has the effect of enriching the proportion of fetal DNA in the mixture. The free floating DNA, thought to be DNA from apoptotic cells, and which contains both fetal and maternal DNA, is short—mostly under 200 bp. Cellular DNA released by cell lysis, a common phenomenon after phlebotomy, is typically almost exclusively maternal, and is also quite long—mostly above 500 bp. Therefore, blood samples that have sat around for more than a few minutes will contain a mixture of short (fetal+maternal) and longer (maternal) DNA. Performing a universal amplification with relatively short extension times on maternal plasma followed by targeted amplification will tend to increase the relative proportion of fetal DNA when compared to the plasma that has been amplified using targeted amplification alone. This can be seen in FIG. 19 which shows the measured fetal percent when the input is plasma DNA (vertical axis) vs. the measured fetal percent when the input DNA is plasma DNA that has had a library prepared using the ILLUMINA GAIIx library preparation protocol. All the dots fall below the line, indicating that the library preparation step enriches the fraction of DNA that is of fetal origin. Two samples of plasma that were red, indicating hemolysis and therefore that there would be an increased amount of long maternal DNA present from cell lysis, show a particularly significant enrichment of fetal fraction when the library preparation is performed prior to targeted amplification. The method disclosed herein is particularly useful in cases where there is hemolysis or some other situation has occurred where cells comprising relatively long strands of contaminating DNA have lysed, contaminating the mixed sample of short DNA with the long DNA. Typically the relatively short annealing and extension times are between 30 seconds and 2 minutes, though they could be as short as 5 or 10 seconds or less, or as long as 5 or 10 minutes.

Experiment 7

The following protocol was used for 1,200-plex amplification of DNA isolated from maternal plasma from a euploid pregnancy and also genomic DNA from a triploidy 21 cell line using a direct PCR protocol, and also a semi-nested approach. Library preparation and amplification involved single tube blunt ending followed by A-tailing. Adaptor ligation was run using a modification of the ligation kit found in the AGILENT SURESELECT kit, and PCR was run for 7 cycles. In the targeted primer pool, there were 550 assays for SNPs from chromosome 21, and 325 assays for SNPs from each of chromosomes 1 and X. Both protocols involved 15 cycles of STA (95° C. for 30s; 72° C. for 1 min; 60° C. for 4 min; 65° C. for 30s; 72° C. for 30s) using 16 nM primer concentration. The semi-nested PCR protocol involved a second amplification of 15 cycles of STA (95° C. for 30s; 72° C. for 1 min; 60° C. for 4 min; 65° C. for 30s; 72° C. for 30s) using an inner forward tag concentration of 29 nM, and a reverse tag concentration of 1 uM or 0.1 uM. The DNA was then sequenced with an ILLUMINA IIGAX sequencer. For the direct PCR protocol, 73% of the reads map to the genome; for the semi-nested protocol, 97.2% of the sequence reads map to the genome. Therefore, the semi-nested protocol result in approximately 30% more information, presumably mostly due to the elimination of primers that are most likely to cause primer dimers.

Figure 20:
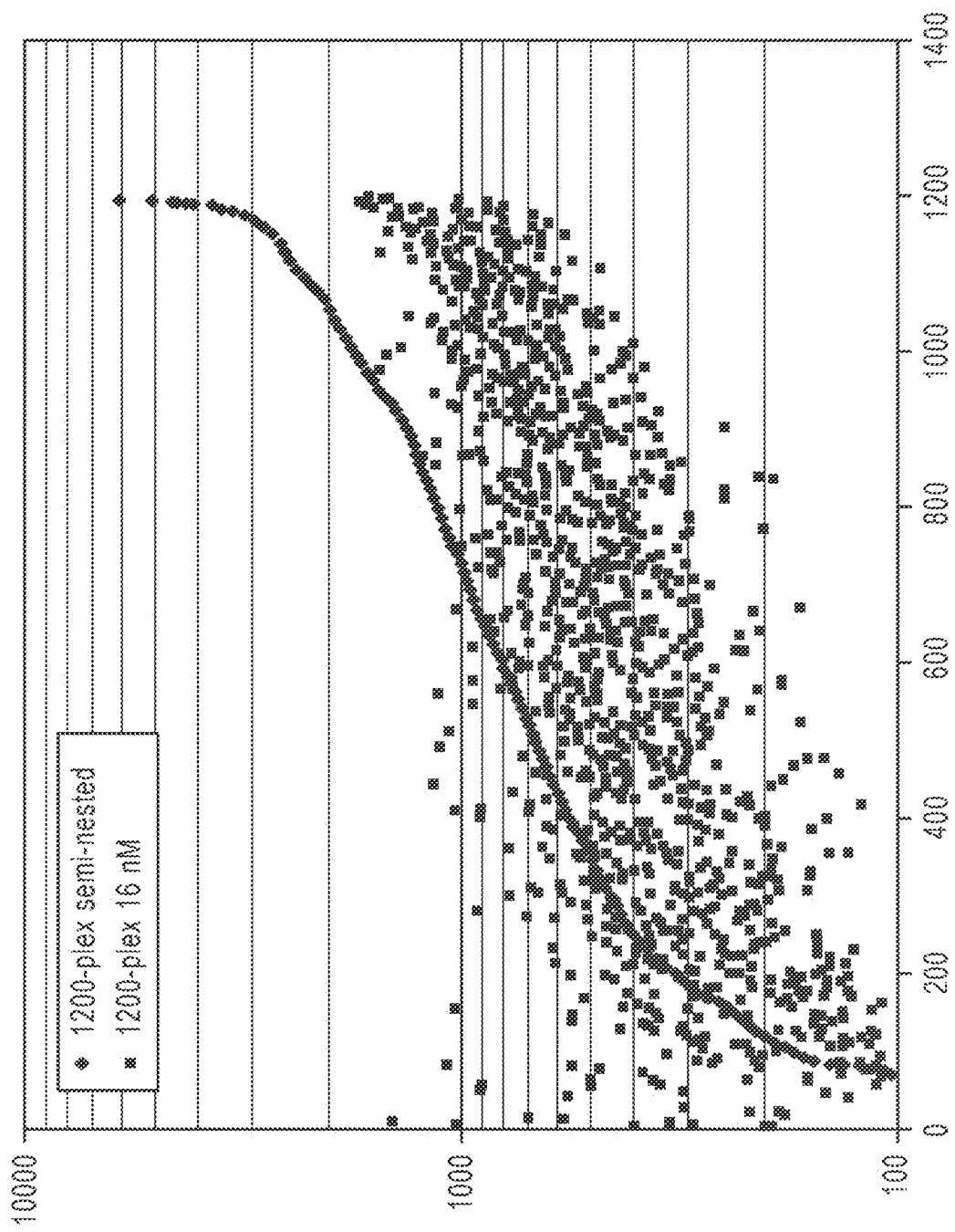
FIG. 20: Depth of read graph comparing direct PCR and semi-nested methods.

The depth of read variability tends to be higher when using the semi-nested protocol than when the direct PCR protocol is used (see FIG. 20) where the diamonds refer to the depth of read for loci run with the semi-nested protocol, and the squares refer to the depth of read for loci run with no nesting. The SNPs are arranged by depth of read for the diamonds, so the diamonds all fall on a curved line, while the squares appear to be loosely correlated; the arrangements of the SNPs is arbitrary, and it is the height of the dot that denotes depth of read rather than its location left to right.

Figure 21:
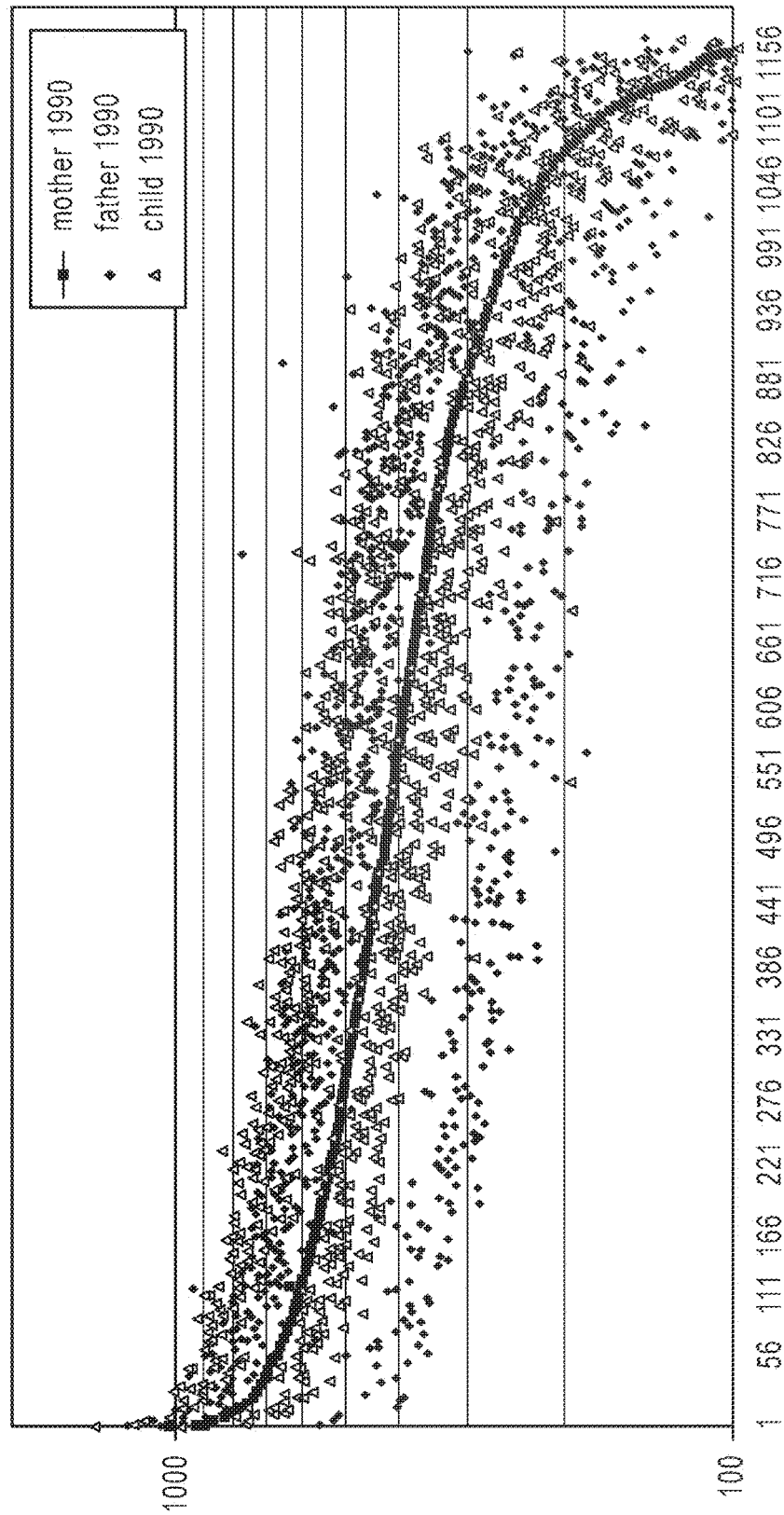
FIG. 21: Comparison of depth of read for direct PCR of three genomic samples.
Figure 22:
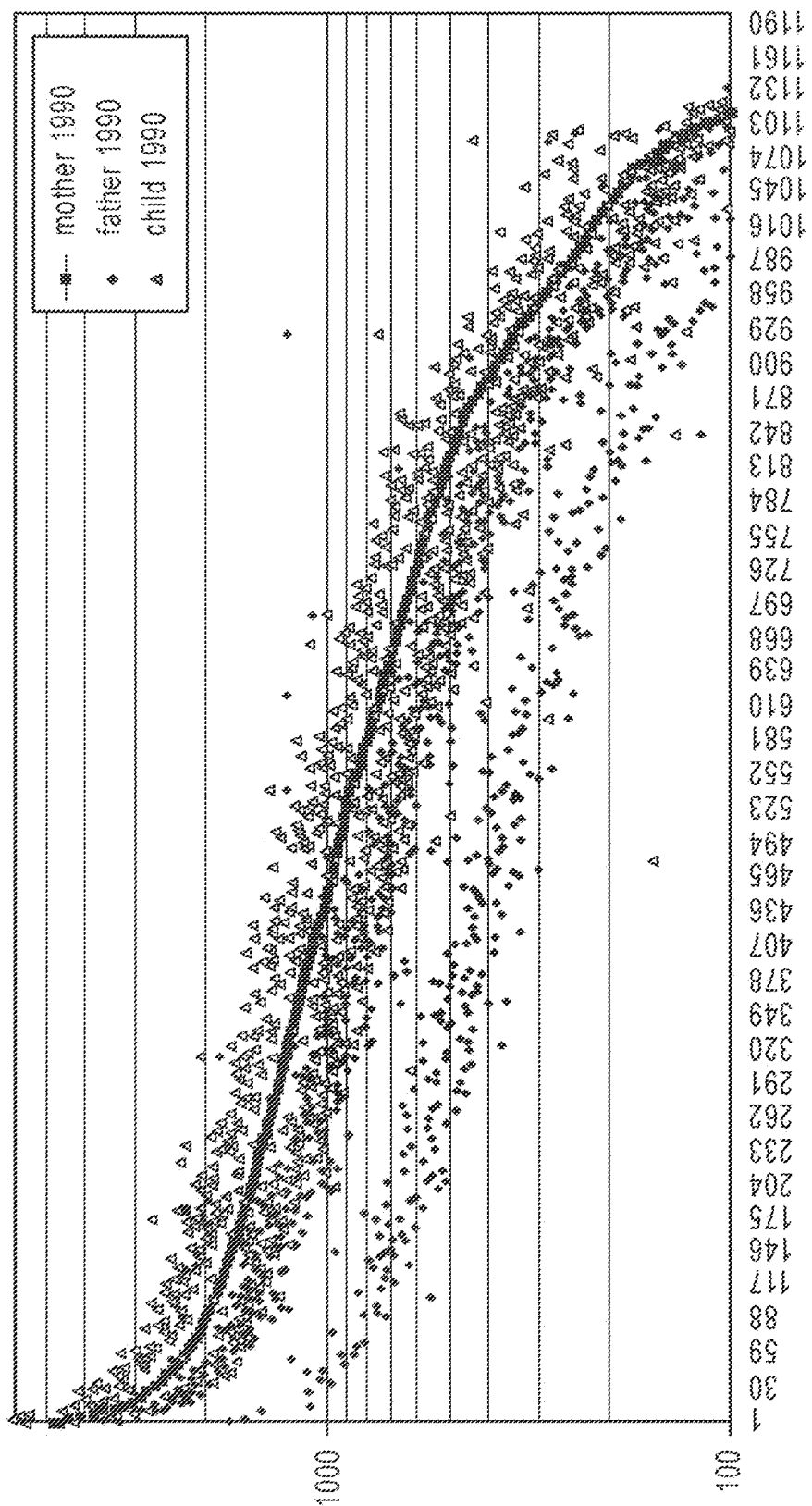
FIG. 22: Comparison of depth of read for semi-nested mini-PCR of three samples.

In some embodiments, the methods described herein can achieve excellent depth of read (DOR) variances. For example, in one version of this experiment (FIG. 21) using a 1,200-plex direct PCR amplification of genomic DNA, of the 1,200 assays: 1186 assays had a DOR greater than 10; the average depth of read was 400; 1063 assays (88.6%) had a depth of read of between 200 and 800, and ideal window where the number of reads for each allele is high enough to give meaningful data, while the number of reads for each allele is not so high that the marginal use of those reads was particularly small. Only 12 alleles had higher depth of read with the highest at 1035 reads. The standard deviation of the DOR was 290, the average DOR was 453, the coefficient of variance of the DOR was 64%, there were 950,000 total reads, and 63.1% of the reads mapped to the genome. In another experiment (FIG. 22) using a 1,200-plex semi-nested protocol, the DOR was higher. The standard deviation of the DOR was 583, the average DOR was 630, the coefficient of variance of the DOR was 93%, there were 870,000 total reads, and 96.3% of the reads mapped to the genome. Note, in both these cases, the SNPs are arranged by the depth of read for the mother, so the curved line represents the maternal depth of read. The differentiation between child and father is not significant; it is only the trend that is significant for the purpose of this explanation.

Experiment 8

In an experiment, the semi-nested 1,200-plex PCR protocol was used to amplify DNA from one cell and from three cells. This experiment is relevant to prenatal aneuploidy testing using fetal cells isolated from maternal blood, or for preimplantation genetic diagnosis using biopsied blastomeres or trophectoderm samples. There were 3 replicates of 1 and 3 cells from 2 individuals (46 XY and 47 XX+21) per condition. Assays targeted chromosomes 1, 21 and X. Three different lysis methods were used: ARCTURUS, MPERv2 and Alkaline lysis. Sequencing was run multiplexing 48 samples in one sequencing lane. The algorithm returned correct ploidy calls for each of the three chromosomes, and for each of the replicates.

Experiment 9

In one experiment, four maternal plasma samples were prepared and amplified using a hemi-nested 9,600-plex protocol. The samples were prepared in the following way: Up to 40 mL of maternal blood were centrifuged to isolate the buffy coat and the plasma. The genomic DNA in the maternal sample was prepared from the buffy coat and paternal DNA was prepared from a blood sample or saliva sample. Cell-free DNA in the maternal plasma was isolated using the QIAGEN CIRCULATING NUCLEIC ACID kit and eluted in 45 uL TE buffer according to manufacturer's instructions. Universal ligation adapters were appended to the end of each molecule of 35 uL of purified plasma DNA and libraries were amplified for 7 cycles using adaptor specific primers. Libraries were purified with AGENCOURT AMPURE beads and eluted in 50 ul water.

3 ul of the DNA was amplified with 15 cycles of STA (95° C. for 10 min for initial polymerase activation, then 15 cycles of 95° C. for 30s; 72° C. for 10 s; 65° C. for 1 min; 60° C. for 8 min; 65° C. for 3 min and 72° C. for 30s; and a final extension at 72° C. for 2 min) using 14.5 nM primer concentration of 9600 target-specific tagged reverse primers and one library adaptor specific forward primer at 500 nM.

The hemi-nested PCR protocol involved a second amplification of a dilution of the first STAs product for 15 cycles of STA (95° C. for 10 min for initial polymerase activation, then 15 cycles of 95° C. for 30s; 65° C. for 1 min; 60° C. for 5 min; 65° C. for 5 min and 72° C. for 30s; and a final extension at 72° C. for 2 min) using reverse tag concentration of 1000 nM, and a concentration of 16.6 u nM for each of 9600 target-specific forward primers.

An aliquot of the STA products was then amplified by standard PCR for 10 cycles with 1 uM of tag-specific forward and barcoded reverse primers to generate barcoded sequencing libraries. An aliquot of each library was mixed with libraries of different barcodes and purified using a spin column.

In this way, 9,600 primers were used in the single-well reactions; the primers were designed to target SNPs found on chromosomes 1, 2, 13, 18, 21, X and Y. The amplicons were then sequenced using an ILLUMINA GAIIX sequencer. Per sample, approximately 3.9 million reads were generated by the sequencer, with 3.7 million reads mapping to the genome (94%), and of those, 2.9 million reads (74%) mapped to targeted SNPs with an average depth of read of 344 and a median depth of read of 255. The fetal fraction for the four samples was found to be 9.9%, 18.9%, 16.3%, and 21.2% Relevant maternal and paternal genomic DNA samples amplified using a semi-nested 9600-plex protocol and sequenced. The semi-nested protocol is different in that it applies 9,600 outer forward primers and tagged reverse primers at 7.3 nM in the first STA. Thermocycling conditions and composition of the second STA, and the barcoding PCR were the same as for the hemi-nested protocol.

The sequencing data was analyzed using informatics methods disclosed herein and the ploidy state was called at six chromosomes for the fetuses whose DNA was present in the 4 maternal plasma samples. The ploidy calls for all 28 chromosomes in the set were called correctly with confidences above 99.2% except for one chromosome that was called correctly, but with a confidence of 83%.

Figure 23:
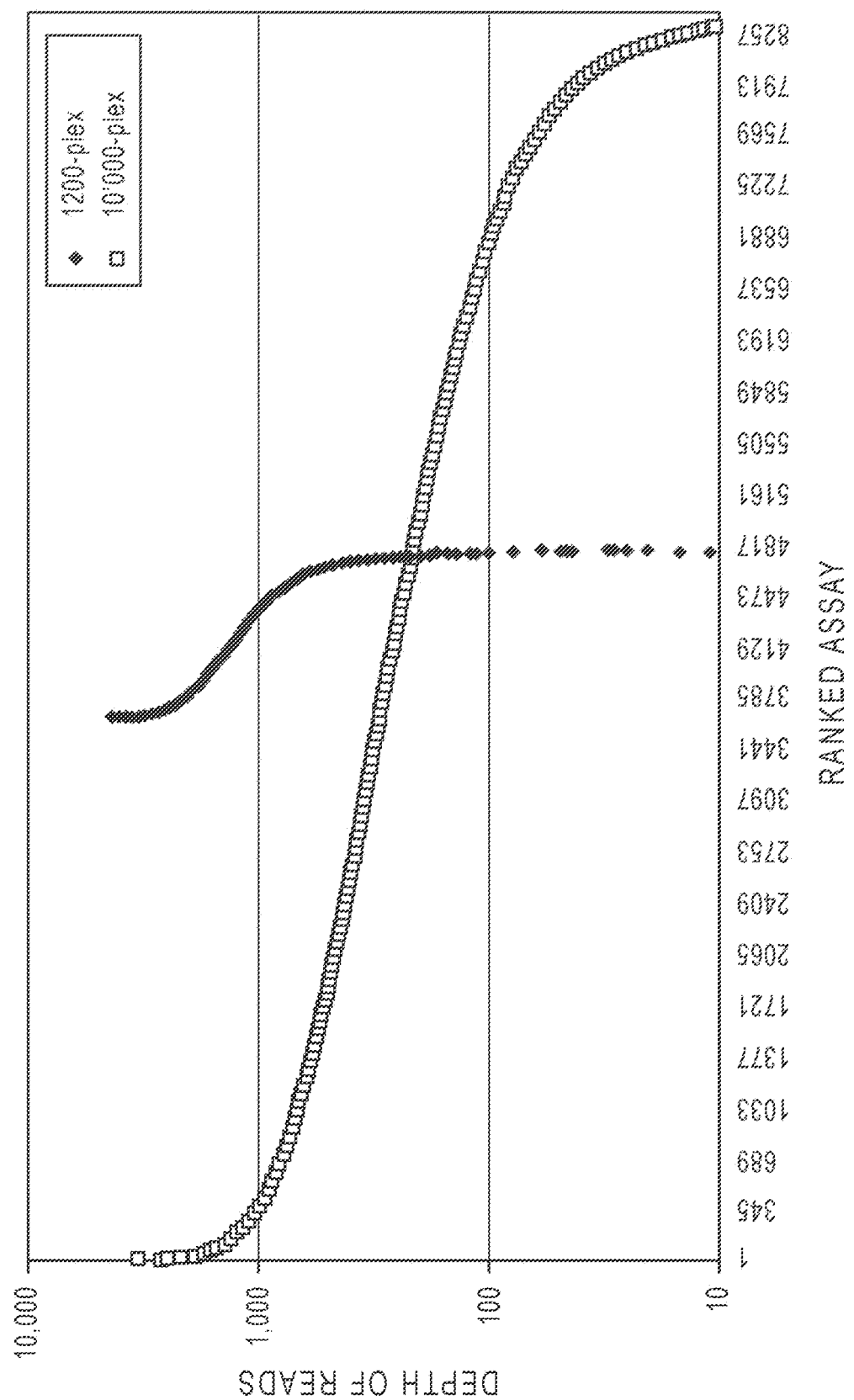
FIG. 23: Comparison of depth of read for 1,200-plex and 9,600-plex reactions.

FIG. 23 shows the depth of read of the 9,600-plex hemi-nesting approach along with the depth of read of the 1,200-plex semi-nested approach described in Experiment 7, though the number of SNPs with a depth of read greater than 100, greater than 200 and greater than 400 was significantly higher than in the 1,200-plex protocol. The number of reads at the $90^{th}$ percentile can be divided by the number of reads at the $10^{th}$ percentile to give a dimensionless metric that is indicative of the uniformity of the depth of read; the smaller the number, the more uniform (narrow) the depth of read. The average $90^{th}$ percentile/$10^{th}$ percentile ratio is 11.5 for the method run in Experiment 9, while it is 5.6 for the method run in Experiment 7. A narrower depth of read for a given protocol plexity is better for sequencing efficiency, as fewer sequence reads are necessary to ensure that a certain percentage of reads are above a read number threshold.

Experiment 10

In one experiment, four maternal plasma samples were prepared and amplified using a semi-nested 9,600-plex protocol. Details of Experiment 10 were very similar to Experiment 9, the exception being the nesting protocol, and including the identity of the four samples. The ploidy calls for all 28 chromosomes in the set were called correctly with confidences above 99.7%. 7.6 million (97%) of reads mapped to the genome, and 6.3 million (80%) of the reads mapped to the targeted SNPs. The average depth of read was 751, and the median depth of read was 396.

Experiment 11

In one experiment, three maternal plasma samples were split into five equal portions, and each portion was amplified using either 2,400 multiplexed primers (four portions) or 1,200 multiplexed primers (one portion) and amplified using a semi-nested protocol, for a total of 10,800 primers. After amplification, the portions were pooled together for sequencing. Details of Experiment 11 were very similar to Experiment 9, the exception being the nesting protocol, and the split and pool approach. The ploidy calls for all 21 chromosomes in the set were called correctly with confidences above 99.7%, except for one missed call where the confidence was 83%. 3.4 million reads mapped to targeted SNPs, the average depth of read was 404 and the median depth of read was 258.

Experiment 12

In one experiment, four maternal plasma samples were split into four equal portions, and each portion was amplified using 2,400 multiplexed primers and amplified using a semi-nested protocol, for a total of 9,600 primers. After amplification, the portions were pooled together for sequencing. Details of Experiment 12 were very similar to Experiment 9, the exception being the nesting protocol, and the split and pool approach. The ploidy calls for all 28 chromosomes in the set were called correctly with confidences above 97%, except for one missed call where the confidence was 78%. 4.5 million reads mapped to targeted SNPs, the average depth of read was 535 and the median depth of read was 412.

Experiment 13

In one experiment, four maternal plasma samples were prepared and amplified using a 9,600-plex triply hemi-nested protocol, for a total of 9,600 primers. Details of Experiment 12 were very similar to Experiment 9, the exception being the nesting protocol which involved three rounds of amplification; the three rounds involved 15, 10 and 15 STA cycles respectively. The ploidy calls for 27 of 28 chromosomes in the set were called correctly with confidences above 99.9%, except for one that was called correctly with 94.6%, and one missed call with a confidence of 80.8%. 3.5 million reads mapped to targeted SNPs, the average depth of read was 414 and the median depth of read was 249.

Experiment 14

In one experiment 45 sets of cells were amplified using a 1,200-plex semi-nested protocol, sequenced, and ploidy determinations were made at three chromosomes. Note that this experiment is meant to simulate the conditions of performing pre-implantation genetic diagnosis on single-cell biopsies from day 3 embryos, or trophectoderm biopsies from day 5 embryos. 15 individual single cells and 30 sets of three cells were placed in 45 individual reaction tubes for a total of 45 reactions where each reaction contained cells from only one cell line, but the different reactions contained cells from different cell lines. The cells were prepared into 5 ul washing buffer and lysed the by adding 5 ul ARCTURUS PICOPURE lysis buffer (APPLIED BIOSYSTEMS) and incubating at 56° C. for 20 min, 95° C. for 10 min.

The DNA of the single/three cells was amplified with 25 cycles of STA (95° C. for 10 min for initial polymerase activation, then 25 cycles of 95° C. for 30s; 72° C. for 10 s; 65° C. for 1 min; 60° C. for 8 min; 65° C. for 3 min and 72° C. for 30s; and a final extension at 72° C. for 2 min) using 50 nM primer concentration of 1200 target-specific forward and tagged reverse primers.

The semi-nested PCR protocol involved three parallel second amplification of a dilution of the first STAs product for 20 cycles of STA (95° C. for 10 min for initial polymerase activation, then 15 cycles of 95° C. for 30s; 65° C. for 1 min; 60° C. for 5 min; 65° C. for 5 min and 72° C. for 30s; and a final extension at 72° C. for 2 min) using reverse tag specific primer concentration of 1000 nM, and a concentration of 60 nM for each of 400 target-specific nested forward primers. In the three parallel 400-plex reactions the total of 1200 targets amplified in the first STA were thus amplified.

An aliquot of the STA products was then amplified by standard PCR for 15 cycles with 1 uM of tag-specific forward and barcoded reverse primers to generate barcoded sequencing libraries. An aliquot of each library was mixed with libraries of different barcodes and purified using a spin column.

In this way, 1,200 primers were used in the single cell reactions; the primers were designed to target SNPs found on chromosomes 1, 21 and X. The amplicons were then sequenced using an ILLUMINA GAIIX sequencer. Per sample, approximately 3.9 million reads were generated by the sequencer, with 500,000 to 800,000 million reads mapping to the genome (74% to 94% of all reads per sample).

Relevant maternal and paternal genomic DNA samples from cell lines were analyzed using the same semi-nested 1200-plex assay pool with a similar protocol with fewer cycles and 1200-plex second STA, and sequenced.

The sequencing data was analyzed using informatics methods disclosed herein and the ploidy state was called at the three chromosomes for the samples.

Figure 24:
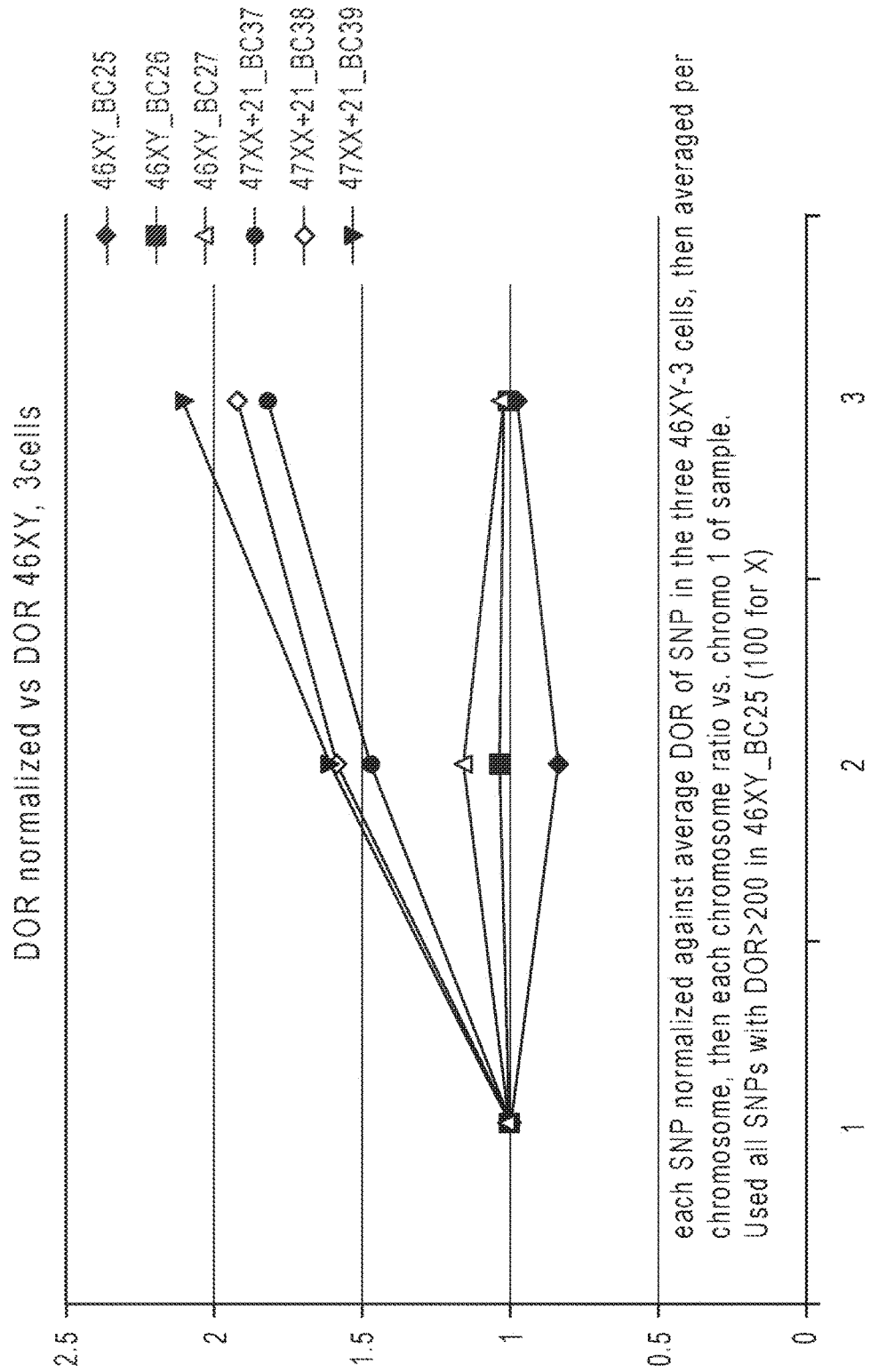
FIG. 24: Read count ratios for six cells at three chromosomes.

FIG. 24 shows normalized depth of read ratios (vertical axis) for six samples at three chromosomes (1=chrom 1; 2=chrom 21; 3=chrom X). The ratios were set to be equal to the number of reads mapping to that chromosome, normalized, and divided by the number of reads mapping to that chromosome averaged over three wells each comprising three 46XY cells. The three sets of data points corresponding to the 46XY reactions are expected to have ratios of 1:1. The three sets of data points corresponding to the 47XX+21 cells are expected to have ratios of 1:1 for chromosome 1, 1.5:1 for chromosome 21, and 2:1 for chromosome X.

Figure 25A:
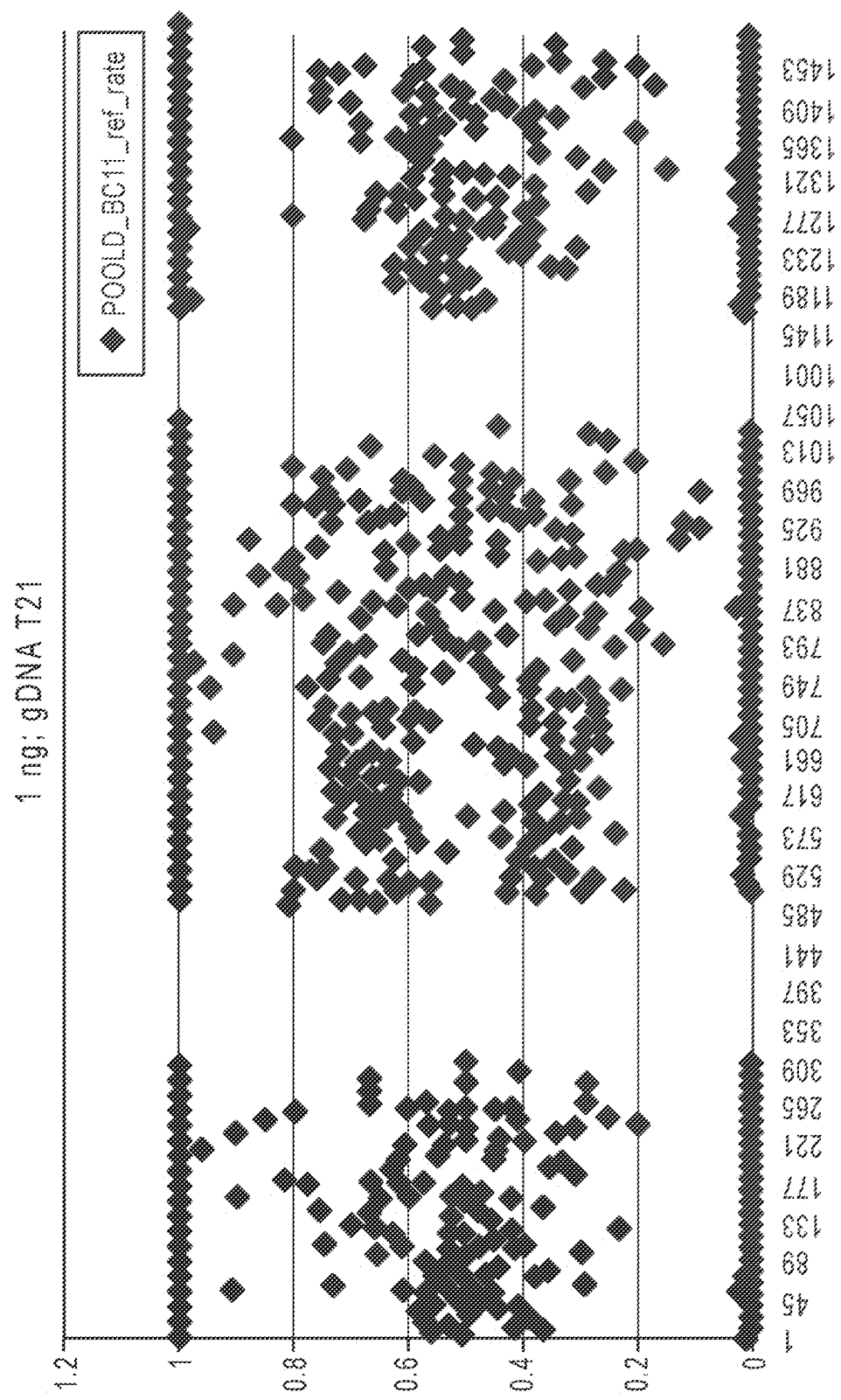
FIGS. 25A-25C: Allele ratios for two three-cell reactions (FIGS. 25B and 25C) and a third reaction run on 1 ng of genomic DNA at three chromosomes (FIG. 25A).
Figure 25B:
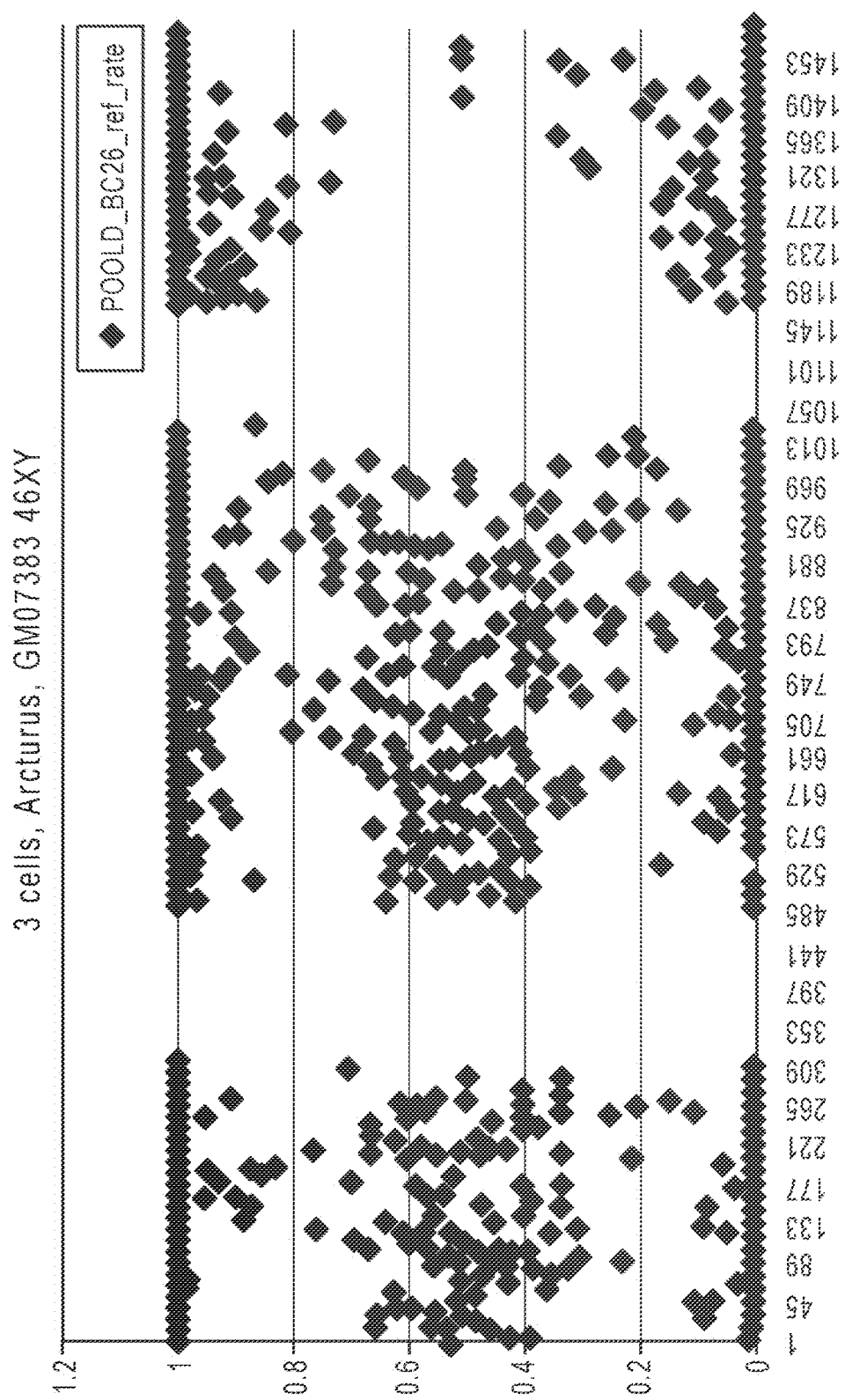
Figure 25C:
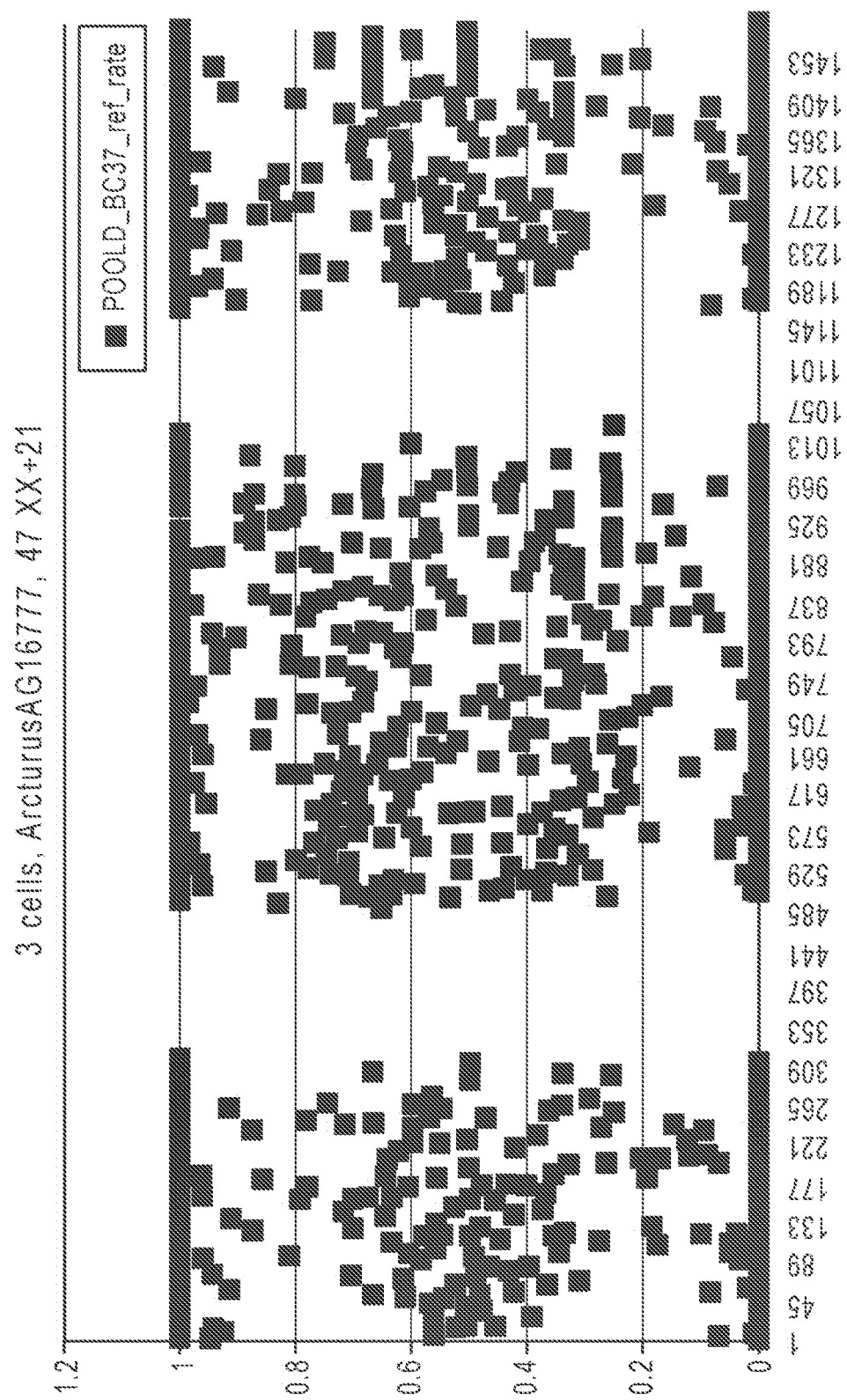
Figure 26A:
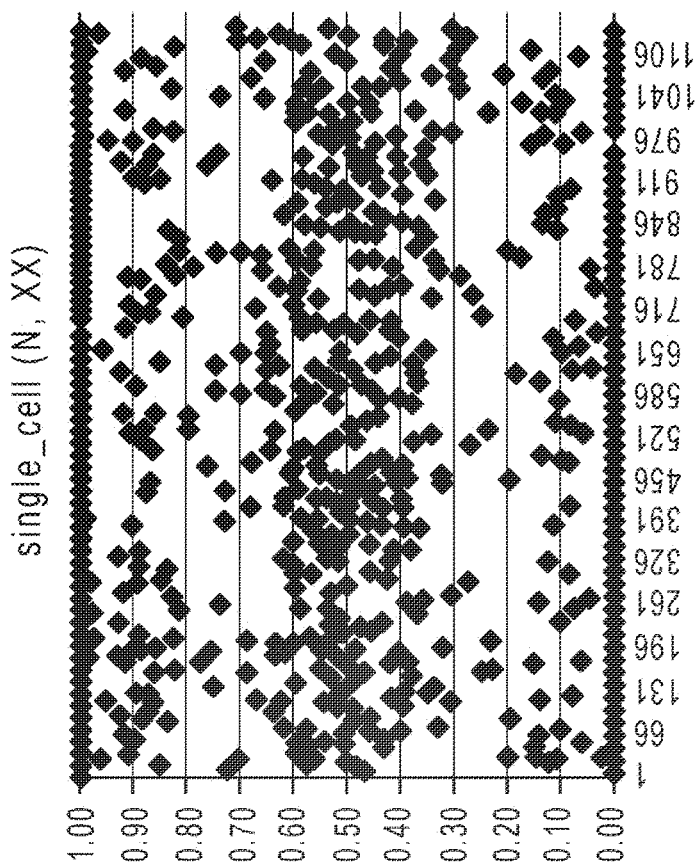
FIGS. 26A and 26B: Allele ratios for two single-cell reactions (FIGS. 26A and 26B) at three chromosomes.
Figure 26B:
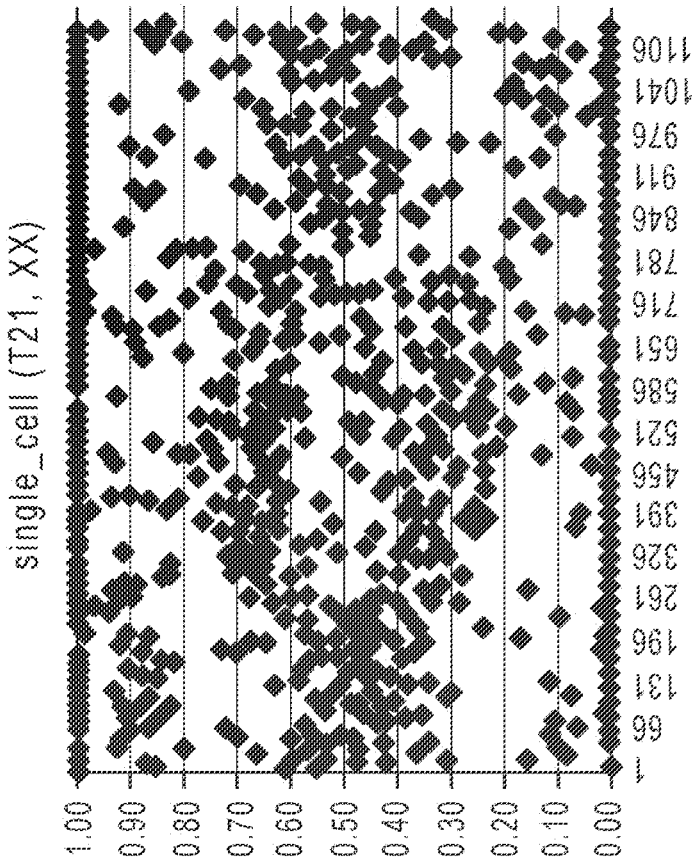

FIG. 25A-25C show allele ratios plotted for three chromosomes (1, 21, X) for three reactions. The reaction in the lower left shows a reaction on three 46XY cells (FIG. 25B). The left region are the allele ratios for chromosome 1, the middle region are the allele ratios for chromosome 21, and the right region are the allele ratios for chromosome X. For the 46XY cells, for chromosome 1 we expect to see ratios of 1, 0.5 and 0, corresponding to AA, AB and BB SNP genotypes. For the 46XY cells, for chromosome 21 we expect to see ratios of 1, 0.5 and 0, corresponding to AA, AB and BB SNP genotypes. For the 46XY cells, for chromosome X we expect to see ratios of 1 and 0, corresponding to A, and B SNP genotypes. The reaction in the lower right shows a reaction on three 47XX+21 cells (FIG. 25C). The allele ratios are segregated by chromosome as in the lower left graph. For the 47XX+21 cells, for chromosome 1 we expect to see ratios of 1, 0.5 and 0, corresponding to AA, AB and BB SNP genotypes. For the 47XX+21 cells, for chromosome 21 we expect to see ratios of 1, 0.67, 0.33 and 0, corresponding to AAA, AAB, ABB and BBB SNP genotypes. For the 47XX+21 cells, for chromosome X we expect to see ratios of 1, 0.5 and 0, corresponding to AA, AB, and BB SNP genotypes. The plot in the upper right was made on a reaction comprising 1 ng of genomic DNA from the 47XX+21 cell line (FIG. 25A). FIG. and 26B shows the same graphs as in FIG. 25A-25C, but for reactions performed on only one cell. The left graph was a reaction that contained a 47XX+21 cell (FIG. 26A), and the right graph was for a reaction that contained a 46XX cell (FIG. 26B).

From the graphs shown in FIGS. 25A-25C and FIGS. 26A and 26B, it is visually apparent that there are two clusters of dots for chromosomes where we expect to see ratios of 1 and 0; three clusters of dots for chromosomes where we expect to see ratios of 1, 0.5, and 0, and four clusters of dots for chromosomes where we expect to see ratios of 1, 0.67, 0.33 and 0. The parental support algorithm was able to make correct calls on all of the three chromosomes for all of the 45 reactions.

Experiment 15

In one experiment, maternal plasma samples were prepared and amplified using a hemi-nested 19,488-plex protocol. The samples were prepared in the following way: up to 20 mL of maternal blood were centrifuged to isolate the buffy coat and the plasma. The genomic DNA in the maternal sample was prepared from the buffy coat and paternal DNA was prepared from a blood sample or saliva sample. Cell-free DNA in the maternal plasma was isolated using the QIAGEN CIRCULATING NUCLEIC ACID kit and eluted in 50 uL TE buffer according to manufacturer's instructions. Universal ligation adapters were appended to the end of each molecule of 40 uL of purified plasma DNA and libraries were amplified for 9 cycles using adaptor specific primers. Libraries were purified with AGENCOURT AMPURE beads and eluted in 50 ul DNA suspension buffer.

6 ul of the DNA was amplified with 15 cycles of STAR 1 (95° C. for 10 min for initial polymerase activation, then 15 cycles of 96° C. for 30s; 65° C. for 1 min; 58° C. for 6 min; 60° C. for 8 min; 65° C. for 4 min and 72° C. for 30s; and a final extension at 72° C. for 2 min) using 7.5 nM primer concentration of 19,488 target-specific tagged reverse primers and one library adaptor specific forward primer at 500 nM.

The hemi-nested PCR protocol involved a second amplification of a dilution of the STAR 1 product for 15 cycles (STAR 2) (95° C. for 10 min for initial polymerase activation, then 15 cycles of 95° C. for 30s; 65° C. for 1 min; 60° C. for 5 min; 65° C. for 5 min and 72° C. for 30s; and a final extension at 72° C. for 2 min) using reverse tag concentration of 1000 nM, and a concentration of 20 nM for each of 19,488 target-specific forward primers.

An aliquot of the STAR 2 products was then amplified by standard PCR for 12 cycles with 1 uM of tag-specific forward and barcoded reverse primers to generate barcoded sequencing libraries. An aliquot of each library was mixed with libraries of different barcodes and purified using a spin column.

In this way, 19,488 primers were used in the single-well reactions; the primers were designed to target SNPs found on chromosomes 1, 2, 13, 18, 21, X and Y. The amplicons were then sequenced using an ILLUMINA GAIIX sequencer. For plasma samples, approximately 10 million reads were generated by the sequencer, with 9.4-9.6 million reads mapping to the genome (94-96%), and of those, 99.95% mapped to targeted SNPs with a mean depth of read of 460 and a median depth of read of 350. For comparison, a perfectly even distribution would be: 10M reads/19,488 targets=513 reads/target. For primer-dimers, 30,000 reads were from sequenced primer-dimers (0.3% of the reads generated by the sequencer). For genomic samples, 99.4-99.7% of the reads mapped to the genome, of those, 99.99% of the mapped to targeted SNPs, and 0.1% of the reads generated by the sequencer were primer-dimers.

For plasma samples with 10 million sequencing reads, typically at least 19,350 of the 19,488 targeted SNPs (99.3%) are amplified and sequenced. For DNA samples with 2M sequencing reads, typically at least 19,000 targeted SNPs (97.5%) are amplified and sequenced. The lower number may be due to sampling noise since the number of reads is lower and the sequencer misses some of the amplified products. If desired, the number of sequencing reads can be increased to increase the number of targeted SNPs that are amplified and sequenced.

Relevant maternal and paternal genomic DNA samples amplified using a semi-nested 19,488 outer forward primers and tagged reverse primers at 7.5 nM in the STAR 1. Thermocycling conditions and composition of STAR 2, and the barcoding PCR were the same as for the hemi-nested protocol.

The average fetal fraction for 407 samples was found to be 14.8%. The sequencing data was analyzed using informatics methods disclosed herein and the ploidy state was called at four chromosomes (13, 18, 21, Y) for the fetuses whose DNA was present in 378 of the 407 maternal plasma samples, and at chromosome X in 375 of the 407 maternal plasma samples. The ploidy calls for all 1,887 chromosomes in the set were called correctly with confidences above 90%. 1882 of the 1887 calls were above 95%; and 1,862 of the 1,887 calls were called with confidences above 99%.

A similar control experiment was performed using water instead of DNA extracted from plasma in the plasma PCR protocol. Based on six such trials of an experiment, 5-6% of the sequenced reads were primer-dimers. Other sequenced reads were due to background noise. This experiment demonstrates that even in the absence of a nucleic acid sample with target loci for the primers to hybridize to (rather than hybridizing to other primers and forming amplified primer dimers) few primer dimers are formed.

Experiment 16

The following experiment illustrates an exemplary method for designing and selecting a library of primers that can be used in any of the multiplexed PCR methods of the invention. The goal is to select primers from an initial library of candidate primers that can be used to simultaneously amplify a large number of target loci (or a subset of target loci) in a single reaction. For an initial set of candidate target loci, primers did not have to be designed or selected for each target locus. Preferably, primers are designed and selected for a large portion of the most desirable target loci.

Step 1

A set of candidate target loci (such as SNPs) were selected based on publically available information about desired parameters for the target loci, such as frequency of the SNPs within a target population or heterozygosity rate of the SNPs (worldwide web at ncbi.nlm.nih.gov/projects/SNP/; Sherry S T, Ward M H, Kholodov M, et al. dbSNP: the NCBI database of genetic variation. Nucleic Acids Res. 2001 Jan. 1; 29(1):308-11, which are each incorporated by reference in its entirety). For each candidate locus, one or more PCR primer pairs were designed using the Primer3 program (the worldwide web at primer3.sourceforge.net; libprimer3 release 2.2.3, which is hereby incorporated by reference in its entirety). If there were no feasible designs for PCR primers for a particular target locus, then that target locus was eliminated from further consideration. If desired, a "target locus score" (higher score representing higher desirability) can be calculated for most or all of the target loci, such as a target locus score calculated based on a weighted average of various desired parameters for the target loci. The parameters may be assigned different weights based on their importance for the particular application that the primers will be used for. Exemplary parameters include the heterozygosity rate of the target locus, the disease prevalence associated with a sequence (e.g., a polymorphism) at the target locus, the disease penetrance associated with a sequence (e.g., a polymorphism) at the target locus, the specificity of the candidate primer(s) used to amplify the target locus, the size of the candidate primer(s) used to amply the target locus, and the size of the target amplicon. In some embodiments, the specificity of the candidate primer for the target locus includes the likelihood that the candidate primer will mis-prime by binding and amplifying a locus other than the target locus it was designed to amplify. In some embodiments, one or more or all the candidate primers that mis-prime are removed from the library.

Step 2

A thermodynamic interaction score was calculated between each primer and all primers for all other target loci from Step 1 (see, e.g., Allawi, H. T. & SantaLucia, J., Jr. (1998), "Thermodynamics of Internal C-T Mismatches in DNA", *Nucleic Acids Res.* 26, 2694-2701; Peyret, N., Seneviratne, P. A., Allawi, H. T. & SantaLucia, J., Jr. (1999), "Nearest-Neighbor Thermodynamics and NMR of DNA Sequences with Internal A-A, C-C, G-G, and T-T Mismatches", *Biochemistry* 38, 3468-3477; Allawi, H. T. & SantaLucia, J., Jr. (1998), "Nearest-Neighbor Thermodynamics of Internal A-C Mismatches in DNA: Sequence Dependence and pH Effects", *Biochemistry* 37, 9435-9444.; Allawi, H. T. & SantaLucia, J., Jr. (1998), "Nearest Neighbor Thermodynamic Parameters for Internal G-A Mismatches in DNA", *Biochemistry* 37, 2170-2179; and Allawi, H. T. & SantaLucia, J., Jr. (1997), "Thermodynamics and NMR of Internal G-T Mismatches in DNA", *Biochemistry* 36, 10581-10594; MultiPLX 2.1 (Kaplinski L, Andreson R, Puurand T, Remm M. MultiPLX: automatic grouping and evaluation of PCR primers. Bioinformatics. 2005 Apr. 15; 21(8):1701-2, which are each hereby incorporated by reference in its entirety). This step resulted in a 2D matrix of interaction scores. The interaction score predicted the likelihood of primer-dimers involving the two interacting primers. The score was calculated as follows:

$$\text{interaction\_score}=\max(-\text{delta}G\_2, 0.8 *(-\text{delta}G\_1))$$

where deltaG_2=Gibbs energy (energy required to break the dimer) for a dimer that is extensible by PCR on both ends, i.e., the 3' end of each primer anneals to the other primer; and deltaG_1=Gibbs energy for a dimer that is extensible by PCR on at least one end.

Step 3:

For each target locus, if there was more than one primer-pair design, then one design was selected using the following method:
1 For each primer-pair design for the locus, find the worst-case (highest) interaction score for the two primers in that design and all primers from all designs for all other target loci.
2 Pick the design with the best (lowest) worst-case interaction score.

Step 4

A graph was built such that each node represented one locus and its associated primer-pair design (e.g., a Maximal Clique problem). One edge was created between every pair of nodes. A weight was assigned to each edge equal to the worst-case (highest) interaction score between the primers associated with the two nodes connected by the edge.

Step 5

If desired, for every pair of designs for two different target loci where one of the primers from one design and one of the primers from the other design would anneal to overlapping target regions, an additional edge was added between the nodes for the two design. The weight of these edges was set equal to the highest weight assigned in Step 4. Thus, Step 5 prevents the library from having primers that would anneal to overlapping target regions, and thus interfere with each other during a multiplex PCR reaction.

Step 6

An initial interaction score threshold was calculated as follows:

$$\text{weight\_threshold}=\max(\text{edge\_weight})-0.05*(\max(\text{edge\_weight})-\min(\text{edge\_weight}))$$

where max(edge_weight) is the maximum edge weight in the graph; and min(edge_weight) is the minimum edge weight in the graph.

The initial bounds for the threshold were set as follows:

max_weight_threshold=max(edge_weight)
min_weight_threshold=min(edge_weight)

Step 7

A new graph was constructed consisting of the same set of nodes as the graph from Step 5, only including edges with weights that exceed weight threshold. Thus, step ignores interactions with scores equal to or below weight threshold.

Step 8

Nodes (and all of the edges connected to the removed nodes) were removed from the graph of Step 7 until there were no edges left. Nodes were removed by applying the following procedure repeatedly:
1 Find the node with the highest degree (highest number of edges). If there is more than one then pick one arbitrarily.
2 Define the set of nodes consisting of the node picked above and all of the nodes connected to it, but excluding any nodes that have degree less than the node picked above.
3 Choose the node from the set that has the lowest target locus score (lower score representing lower desirability) from Step 1. Remove that node from the graph.

Step 9

If the number of nodes remaining in the graph satisfies the required number of target loci for the multiplexed PCR pool (within an acceptable tolerance), then the method was continued at Step 10.

If there were too many or too few nodes remaining in the graph, then a binary search was performed to determine what threshold values would result in the desired number of nodes remaining in the graphs. If there were too many nodes in the graph then, the weight threshold bounds were adjusted as follows:

$$\text{max\_weight\_threshold}=\text{weight\_threshold}$$

Otherwise (if there are two few nodes in the graph), then the weight threshold bounds were adjusted as follows:

$$\text{min\_weight\_threshold}=\text{weight\_threshold}$$

Then, the weight threshold was adjusted follows:

$$\text{weight\_threshold}=(\text{max\_weight\_threshold}+\text{min\_weight\_threshold})/2$$

Steps 7-9 were repeated.

Step 10

The primer-pair designs associated with the nodes remaining in the graph were selected for the library of primers. This primer library can be used in any of the methods of the invention.

If desired, this method of designing and selecting primers can be performed for primer libraries in which only one primer (instead of a primer pair) is used for amplification of a target locus. In this case, a node presents one primer per target locus (rather than a primer pair).

Experiment 17

Figure 27:
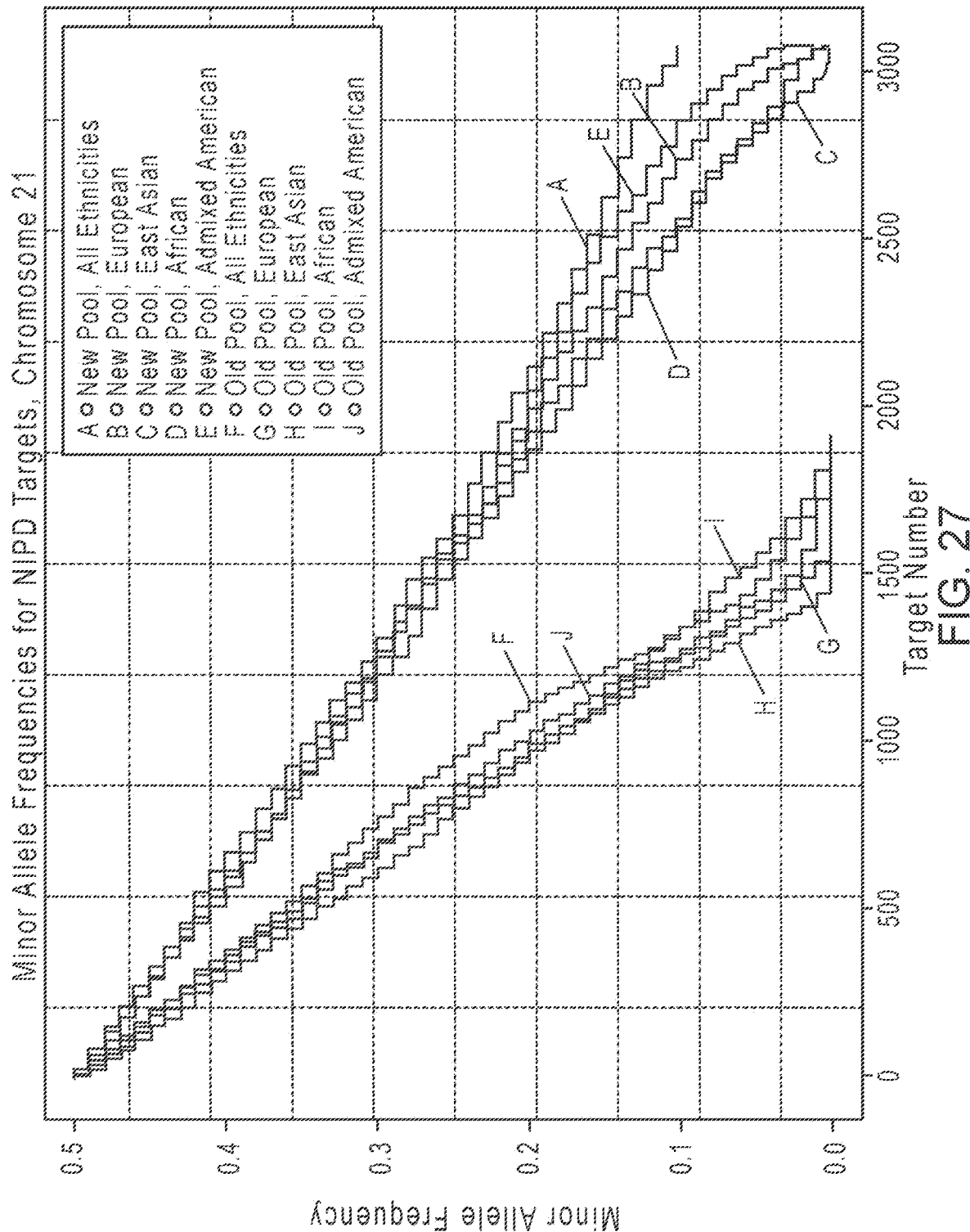
FIG. 27: Comparison of two primer libraries showing the number of loci with a particular minor allele frequency that are targeted by each primer library.
Figure 28A:
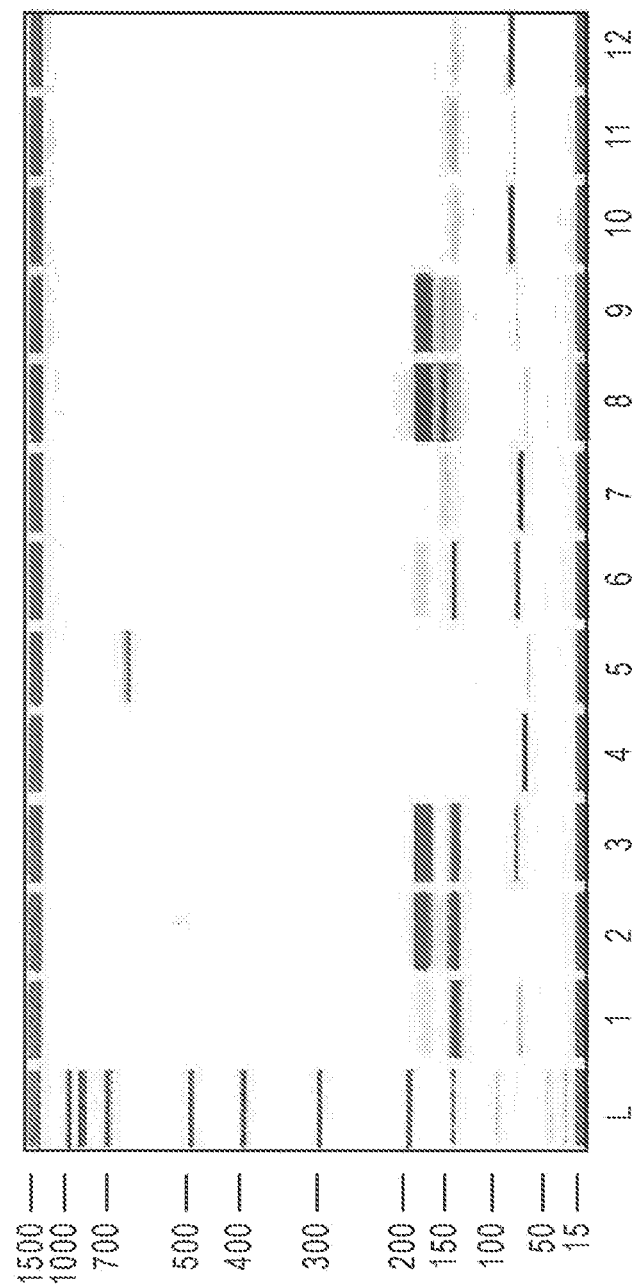
FIG. 28A: Graph of the electrophoresis of PCR products.
Figure 28B:
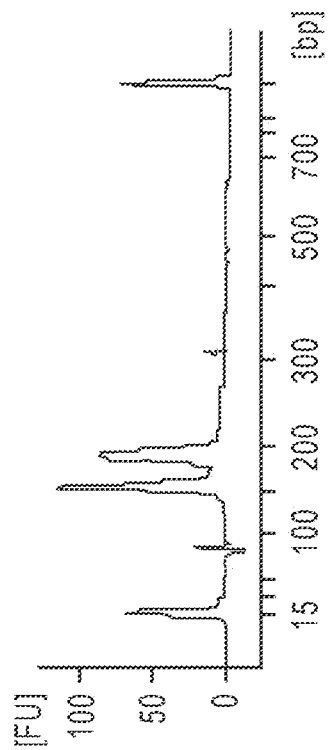
FIGS. 28B-28M are electropherograms of lanes 1-12, respectively, in FIG. 28A.
Figure 28C:
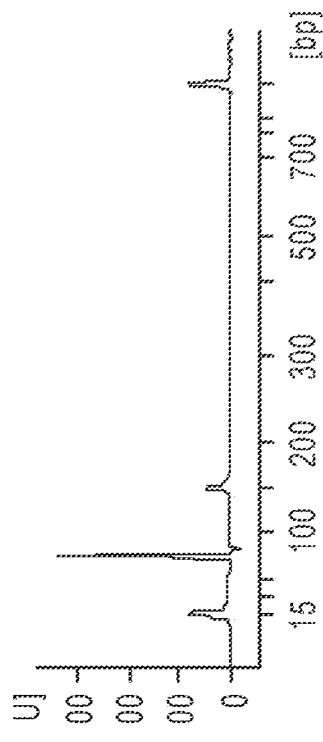
Figure 28D:
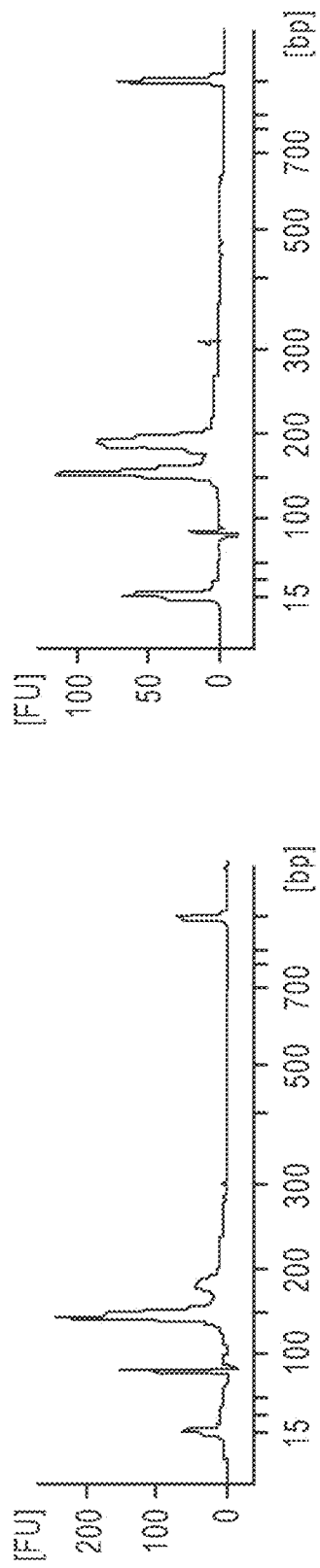
Figure 28E:
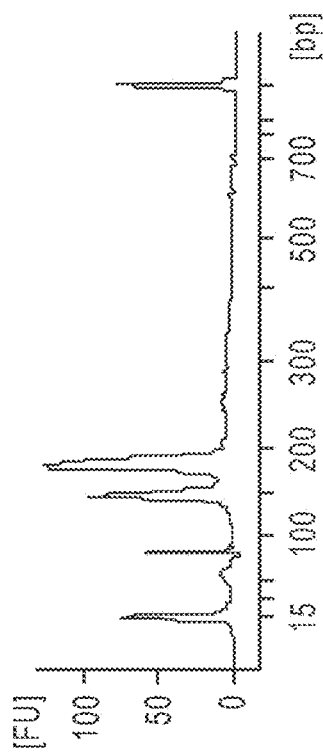
Figure 28F:
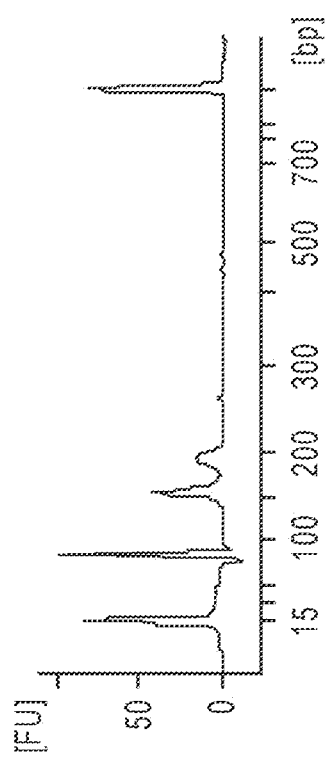
Figure 28G:
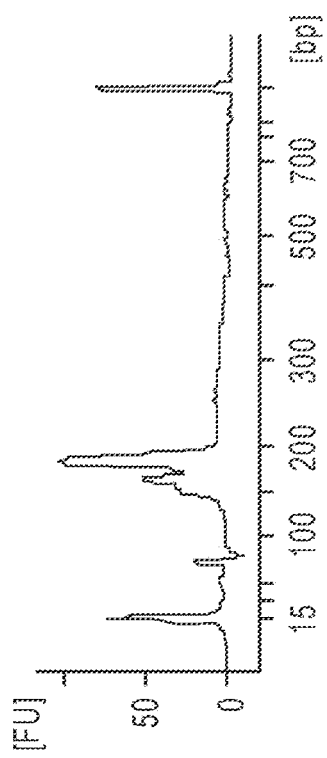
Figure 28H:
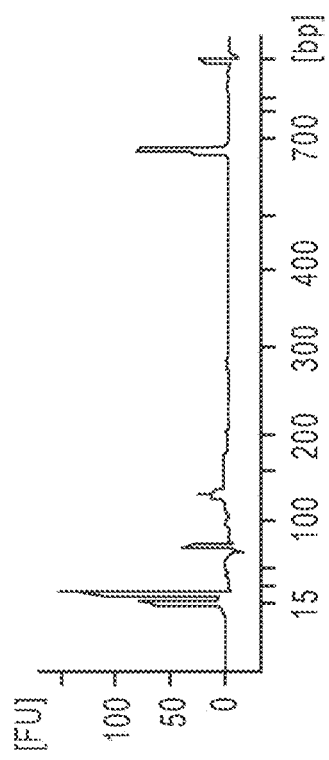
Figure 28I:
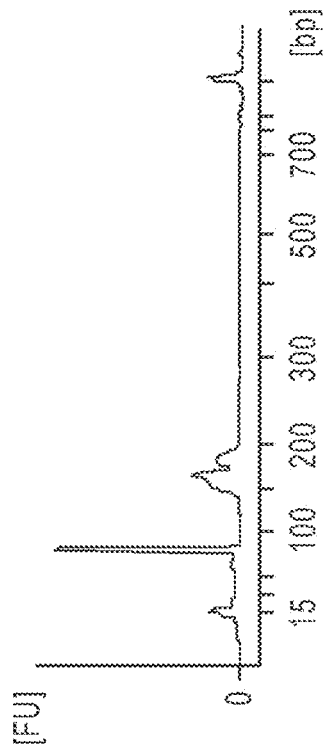
Figure 28J:
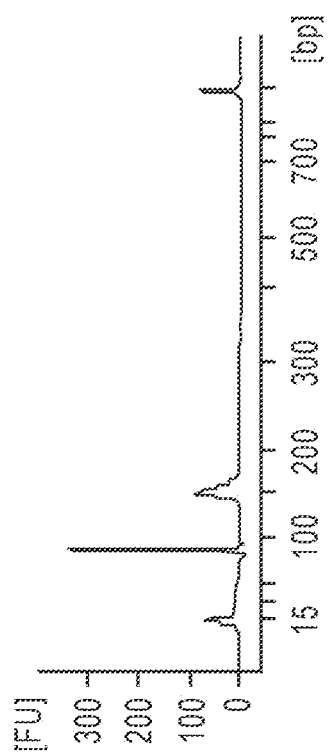
Figure 28K:
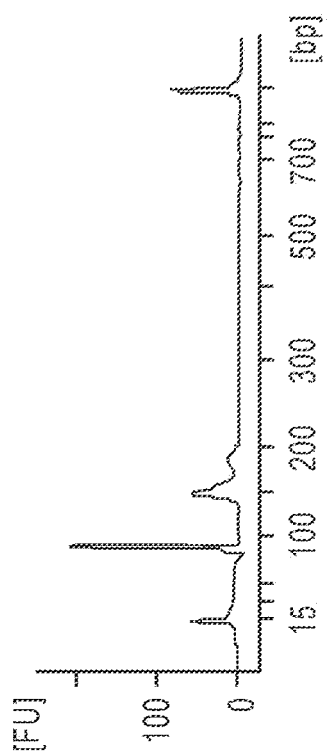
Figure 28L:
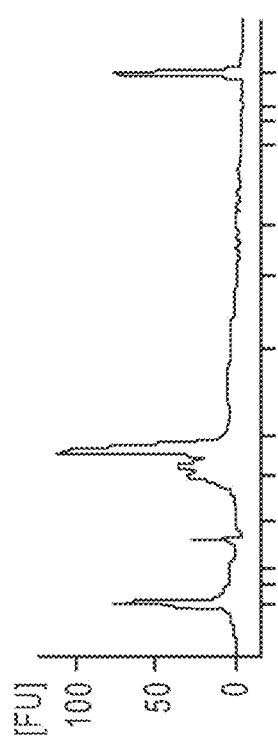
Figure 28M:

FIG. 27 is a graph comparing two primer libraries designed using the methods of the invention. This graph shows the number of loci with a particular minor allele frequency that are targeted by each primer library. During the selection of the "new pool" library, more primers were retained. This library enables the amplification of more target loci, especially target loci with relatively large minor allele frequencies (which are the more informative alleles for some method of the invention, such as for detecting fetal chromosomal abnormalities).

These primer libraries were used in the following multiplex PCR method. Blood (20-40 mL) was collected from each subject into two to four CELL-FREE™ DNA tubes (Streck). Plasma (a minimum of 7 mL) was isolated from each sample via a double centrifugation protocol of 2,000 g for 20 min, followed by 3,220 g for 30 min, with supernatant transfer following the first spin. cfDNA was isolated from 7-20 mL plasma using the QIAGEN QIAamp Circulating Nucleic Acid kit and eluted in 45 uL TE buffer. Pure maternal genomic DNA was isolated from the buffy coat obtained following the first centrifugation, and pure paternal genomic DNA was prepared similarly from a blood, saliva or buccal sample.

Maternal cfDNA, maternal genomic DNA, and paternal genomic DNA samples were pre-amplified for 15 cycles using 11,000 target-specific assays and an aliquot was transferred to a second PCR reaction of 15 cycles using nested primers. Finally, samples were prepared for sequencing by adding barcoded tags in a third 12-cycle round of PCR. Thus, 11,000 targets were amplified in a single reaction; the targets included SNPs found on chromosomes 13, 18, 21, X, and Y. The amplicons were then sequenced using an ILLUMINA GAIIx or HISEQ sequencer. Parental genotypes were sequenced at a lower read depth (~20% of cfDNA read depth) than the fetal genotypes.

Experiment 18

If desired, the size and quantity of the PCR products can be analyzed using standard methods, such as the use of the Agilent Technologies 2100 Bioanalyzer (FIG. 28A-M). For example, direct PCR methods described herein without nesting were used in 2,400-plex (FIGS. 28B-28G) and 19,488-plex experiments (FIGS. 28H to 28M). The amount of primer was 10 nM for FIGS. 28B-28D and 28H to 28J. The amount of primer was 1 nM for FIGS. 28E-28G and 28K to 28M. The amount of input DNA was 24 ng for FIGS. 28B, 28E, 28H, and 28K; 80 ng for FIGS. 28C, 28F, 28I, and 28L; and 250 ng for FIGS. 28D, 28G, 28J, and 28M. More input DNA resulted in a greater proportion of the desired 180 base pair product. The peak at 140 base pairs is a primer dimer product.

Experiment 19

A proof-of-principle study demonstrated the detection of T13, T18, T21, 45,X, and 47,XXY with equally high accuracies across all chromosomes.

Patients

Pregnant couples were enrolled at specific prenatal care centers under protocols approved by an Institutional Review Board pursuant to local laws. Inclusion criteria were at least 18 years of age, gestational age of at least nine weeks, singleton pregnancies, and signed informed consent. Blood samples were drawn from pregnant mothers, and a blood or buccal sample was collected from the father. Samples from 2 pregnancies with T13 (Patau Syndrome), 2 with T18 (Edwards Syndrome), 2 with T21 (Down's Syndrome), 2 with 45,X, 2 with 47,XXY, and 90 normal pregnancies were selected prior to testing from a cohort of ~500 women to test which chromosomal abnormalities the method detects. Normal fetal karyotype was confirmed by molecular karyotyping for the samples where post-birth child tissue was available. Euploid sample were drawn prior to invasive testing from low-risk women. Aneuploid samples were drawn at least 7 days after invasive testing and aneuploidy was confirmed via cytogenetic karyotyping or fluorescence in situ hybridization at independent laboratories.

Sample Preparation and Multiplex PCR

For the data in FIGS. 30A-E, 30G, 30H, and 31A-31G, sample preparation and 19,488-plex-PCR were performed as described in Experiment 15. For the data in FIG. 30F, sample preparation and 11,000-plex-PCR were performed as described in Experiment 17.

Methodology and Data Analysis

The algorithm considers parental genotypes and crossover frequency data (such as data from the HapMap database) to calculate expected allele distributions for 19,488 polymorphic loci for a very large number possible fetal ploidy states, and at various fetal cfDNA fractions. (FIGS. 29A-29C). Unlike allele ratio based-methods, it also takes into account linkage disequilibrium, and uses non-Gaussian data models to describe the expected distribution of allele measurements at a SNP given observed platform characteristics and amplification biases. It then compares the various predicted allele distributions to the actual allelic distributions as measured in the cfDNA sample (FIG. 29C), and calculates the likelihood of each hypothesis (monosomy, disomy, or trisomy, for which there are numerous hypotheses based on the various potential crossovers) based on the sequencing data. The algorithm sums the likelihoods of each individual monosomy, disomy, or trisomy hypotheses (FIG. 29D), and calls the ploidy state with the maximum overall likelihood as the copy number and fetal fraction (FIG. 29E). Although laboratory researchers were not blinded to sample karyotype, the algorithm called the ploidy states without human intervention and was blind to the truth.

Data Interpretation

Graphical Representations of the Generated Data

To determine the ploidy state of a chromosome of interest, the algorithm considers the distribution of sequence counts from each of two possible alleles at 3,000 to 4,000 SNPs per chromosome. It is important to note that the algorithm makes ploidy calls using an approach that does not lend itself to visualization. Thus, for the purposes of illustration, the data is displayed here in a simplified fashion as ratios of the two most likely alleles, labeled as A and B, so that the relevant trends can be more readily visualized. This simplified illustration does not take into account some of the features of the algorithm. For example, two important aspects of the algorithm that are not possible to illustrate with a method of visualization that displays allele ratios are: 1) the ability to leverage linkage disequilibrium, i.e. the influence that a measurement at one SNP has on the likely identity of a neighboring SNP, and 2) the use of non-Gaussian data models that describe the expected distribution of allele measurements at a SNP given platform characteristics and amplification biases. Also note that the algorithm only considers the two most common alleles at each SNP, ignoring other possible alleles.

The graphical representations in FIG. 30A-30H include samples for which two, one, or three fetal chromosomes are present. Generally, these indicate euploidy (FIGS. 30A-30C) monosomy (FIG. 30D), and trisomy (FIGS. 30E-30H), respectively. In all plots, each spot represents a single SNP, where the targeted SNPs are plotted sequentially from left to right for one chromosome along the horizontal axes. The vertical axes indicate the number of reads for the A allele as a fraction of the total number of reads for both the A and B alleles for that SNP. Note that the measurements are made on total cfDNA isolated from maternal blood, and the cfDNA includes both maternal and fetal cfDNA; thus, each spot represents the combination of the fetal and maternal DNA contribution for that SNP. Therefore, increasing the proportion of maternal cfDNA from 0% to 100% will gradually shift some spots up or down within the plots, depending on the maternal and fetal genotype. This is described in more detail below with the corresponding plots.

If desired to facilitate visualization, the spots may be color-coded according to maternal genotype, as maternal genotype contributes more to the localization of each spot and the majority of trisomies are maternally-inherited; this assists in visualizing ploidy states. Specifically, SNPs for which the maternal genotype is AA may be indicated in red, those for which the maternal genotype is AB may be indicated in green, and those for which the maternal genotype is BB may be indicated in blue.

In all cases, SNPs that are homozygous for the A allele (AA) in both the mother and the fetus are found tightly associated with the upper limit of the plots, as the fraction of A allele reads is high because there should be no B alleles present. Conversely, SNPs that are homozygous for the B allele in both the mother and the fetus are found tightly associated with the lower limit of the plots, as the fraction of A allele reads is low because there should be only B alleles. The spots that are not tightly associated with the upper and lower limits of the plots represent SNPs for which the mother, the fetus, or both are heterozygous; these spots are useful for identifying fetal ploidy, but can also be informative for determining paternal versus maternal inheritance. These spots segregate based on both maternal and fetal genotypes and fetal fraction, and as such the precise position of each individual spot along the y-axis depends on both stoichiometry and fetal fraction. For example, loci where the mother is AA and the fetus is AB are expected to have a different fraction of A allele reads, and thus different positioning along the y-axis, depending on the fetal fraction.

Two Chromosomes Present

Figure 30A:
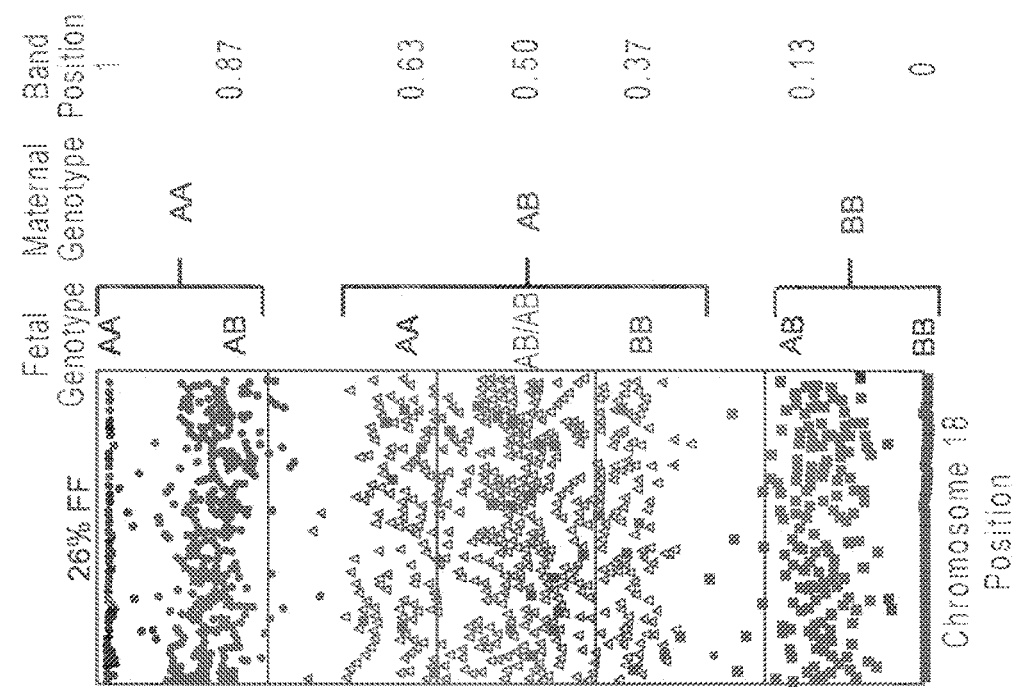
FIGS. 30A-30H: Typical graphical representations of euploidy (FIGS. 30A-30C), monosomy (FIG. 30D), and trisomy (FIGS. 30E-30H). For all plots, the x-axis represents the linear position of the individual polymorphic loci along each chromosome (as indicated below the plots), and the y-axis represents the number of A allele reads as a fraction of the total (A+B) allele reads. Maternal and fetal genotypes, as well as the position on the y-axis around which the bands are centered, are indicated to the right of the plots. If desired to facilitate visualization, the plots may be color-coded according to maternal genotype, such that red indicates a maternal genotype of AA, blue indicates a maternal genotype of BB, and green indicates a maternal genotype of AB. If desired, maternal allele contributions may be indicated in color in the "Fetal Genotype" column. Allele contributions are indicated as maternal|fetal, such that alleles for which the mother is AA and the fetus is AB are indicated as AA|AB.
Figure 30B:
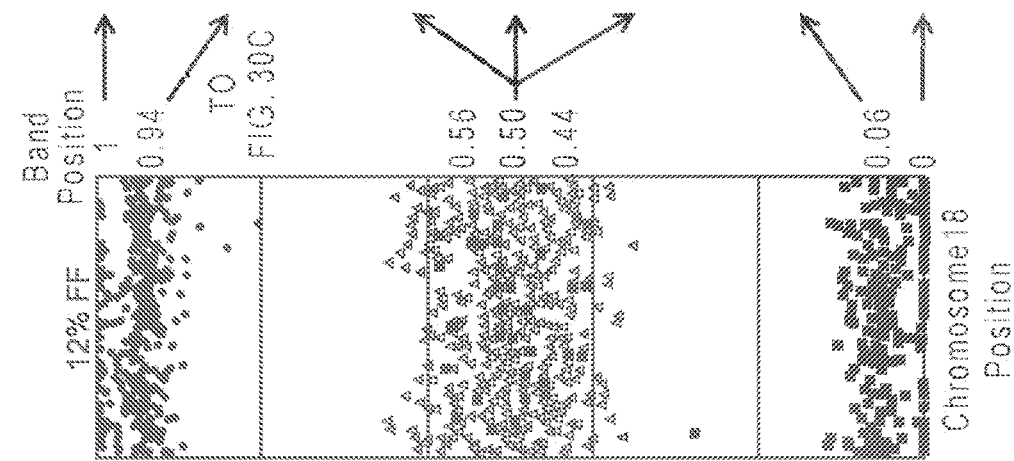
Figure 30C:
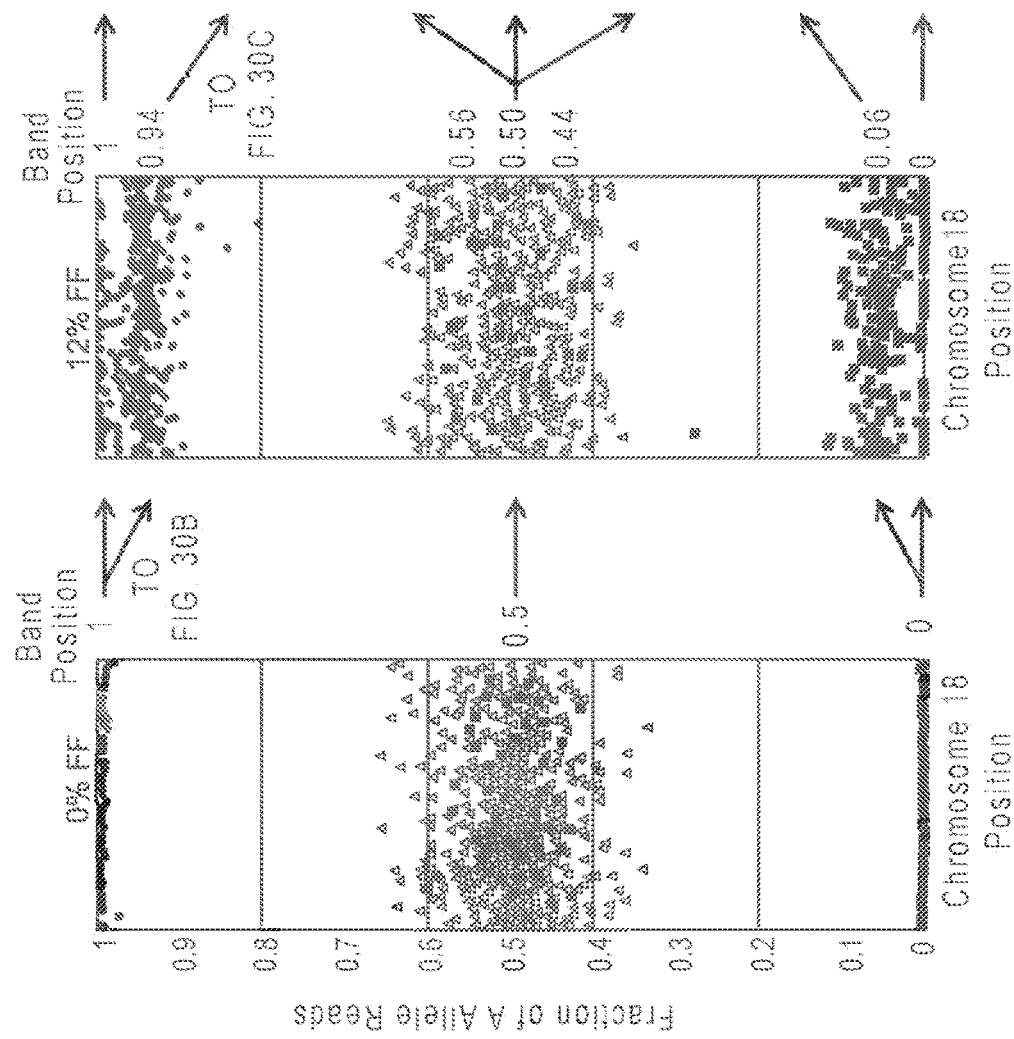
Figure 30E:
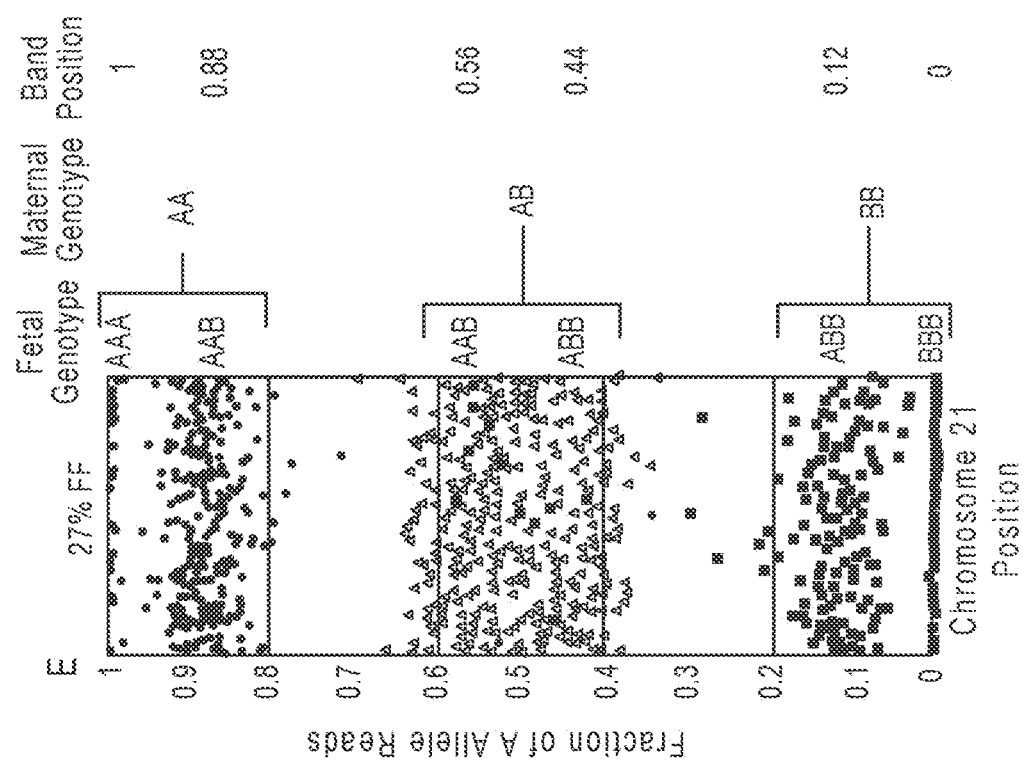

FIGS. 30A-30C depict data that indicate the presence of two chromosomes when the sample is entirely maternal (no fetal cfDNA present, FIG. 30A), contains a moderate fetal cfDNA fraction (FIG. 30B), or contains a high fetal cfDNA fraction (FIG. 30C).

FIG. 30A shows data obtained from cfDNA isolated from the blood of a non-pregnant woman. When there is no fetal cfDNA present and the sample contains only maternal cfDNA, the plots represent purely the euploid maternal genotype; the hallmark pattern includes "clusters" of spots: a red cluster tightly associated with the top of the plot (SNPs where the maternal genotype is AA), a blue cluster tightly associated with the bottom of the plot (SNPs where the maternal genotype is BB), and a single, centered green cluster (SNPs where the maternal genotype is AB).

When fetal cfDNA is present, the location of the spots shifts such that the clusters segregate into discrete "bands". Note that for samples with a fetal fraction of 0%, the groupings of spots are referred to as "clusters" (as in FIG. 30A), and for all samples with a fetal fraction of >0%, the groupings of spots are referred to as "bands" (as in FIGS. 30B-30J). If the fetal fraction is high enough, these discrete bands will be readily visible. Specifically, FIGS. 30B and 30C demonstrate the characteristic pattern associated with two fetal chromosomes present at moderate and high fetal fractions, respectively. This pattern includes three central green bands that correspond to SNPs that are heterozygous in the mother, and two "peripheral" bands each at both the top (red) and bottom (blue) of the plots that correspond to SNPs that are homozygous in the mother.

FIG. 30B shows data obtained from cfDNA isolated from a plasma sample from a woman carrying a euploid fetus and with a 12% fetal cfDNA fraction. Here, the clusters of spots tightly associated with the top and bottom of the plot segregate into two discrete bands each: one red and one blue external peripheral band that remains tightly associated with the upper or lower limit of the plots, and one red and one blue internal peripheral band that has separated from the limits of the plots. These internal peripheral bands, centered around 0.92 and 0.08, represent SNPs for which the maternal genotype is AA and the fetal genotype is AB (indicated in red), and SNPs for which the maternal genotype is BB and the fetal genotype is AB (indicated in blue), respectively. The center cluster of green spots broadens, but at this fetal fraction the segregation into distinct bands is not readily visible.

At a high fetal cfDNA fraction, the typical pattern that indicates the presence of two chromosomes (a trio of green bands as well as two red and two blue peripheral bands) is readily apparent. FIG. 30C displays data obtained from a plasma sample from a woman carrying a euploid fetus at a fetal cfDNA fraction of 26%. Here, the peripheral bands have separated such that the internal band has shifted towards the center of the plot due to the altered levels of B alleles from the increased fetal cfDNA fraction. Significantly, at higher fetal fractions, the separation of the center green cluster into three distinct bands is now readily apparent. This central trio of bands, in this case clustering around 0.37, 0.50 and 0.63, corresponds to those SNPs where the maternal genotype is AB, and the fetal genotype is AA (top), AB (middle) and BB (bottom).

These hallmark patterns, namely three green bands and four peripheral bands (two red and two blue), indicate the presence of two chromosomes, as in autosomal euploidy or for the X chromosome in a female (XX) fetus.

One Chromosome Present

Figure 30D:
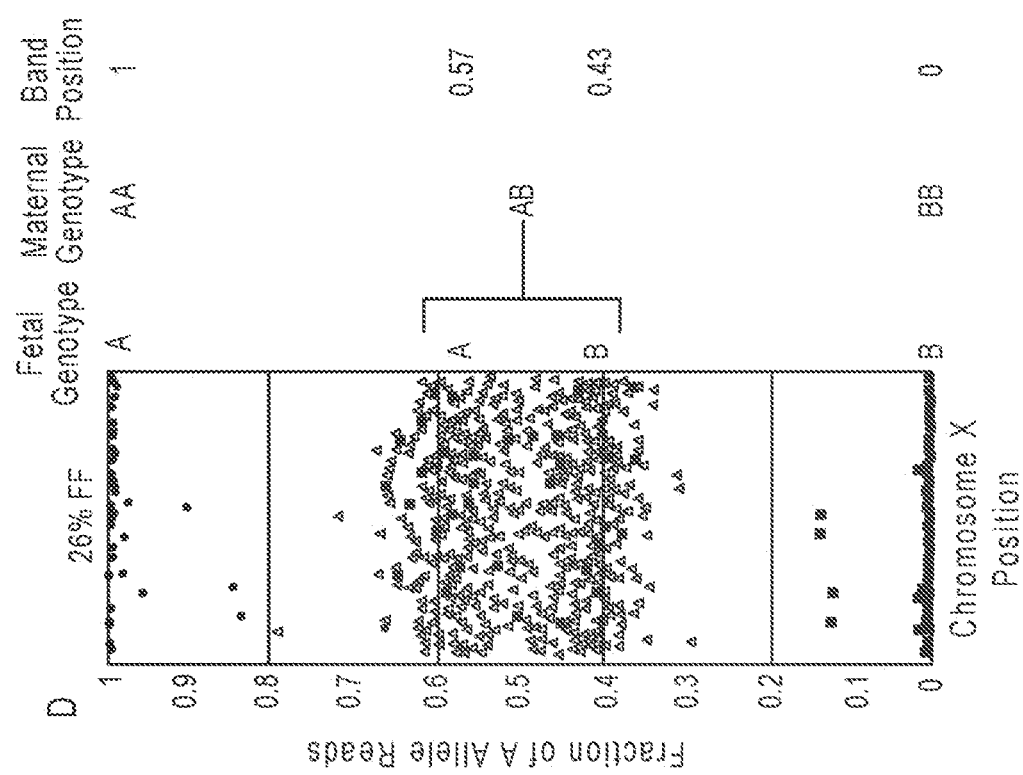
Figure 30G:
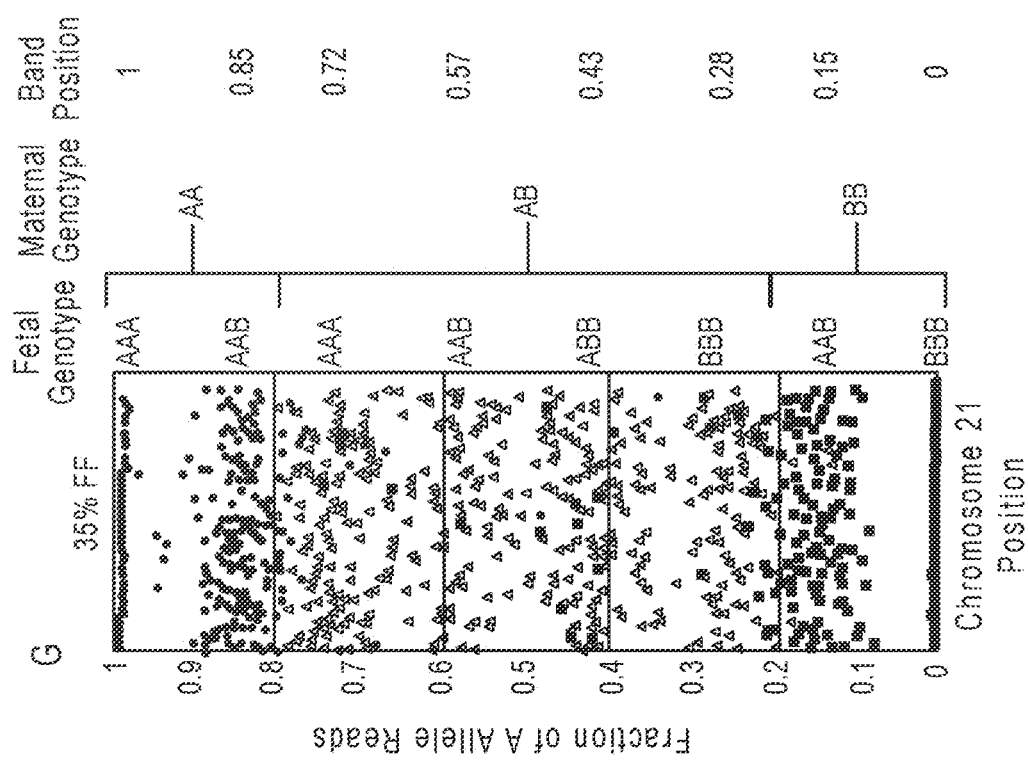
Figure 30F:
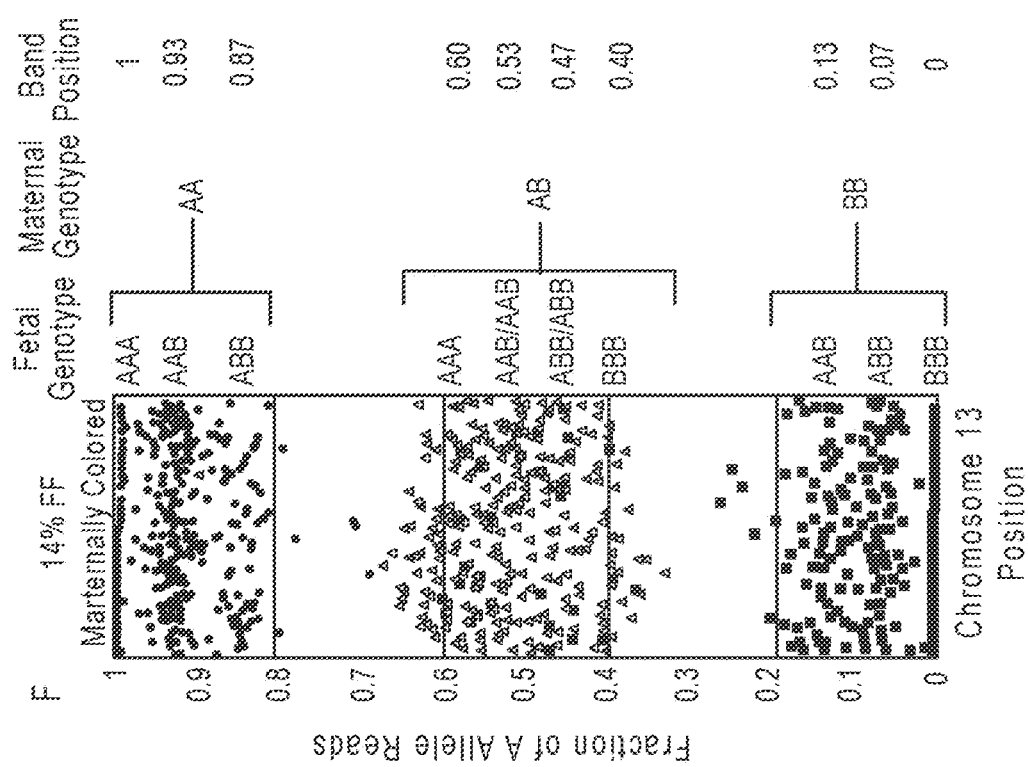
Figure 30H:
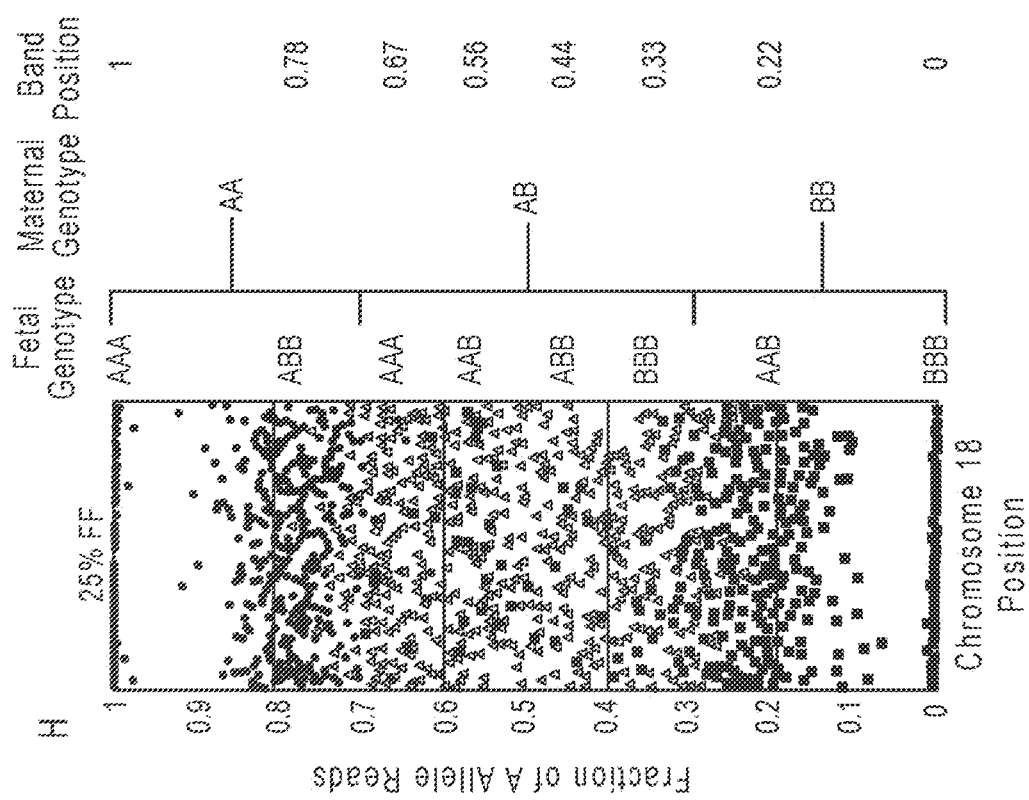

When the fetus only inherits a single chromosome, and thus only inherits a single allele, heterozygosity of the fetus is not possible. As such, the only possible fetal SNP identities are A or B. Thus, maternally-inherited monosomic chromosomes have a characteristic pattern of two central green bands that represent SNPs for which the mother is heterozygous, and only have single peripheral red and blue bands that represent SNPs for which the mother is homozygous, and which remain tightly associated with the upper and lower limits of the plots (1 and 0), respectively (FIG. 30D). Note the absence of internal peripheral bands. This pattern indicates the presence of one chromosome, as in maternally-inherited autosomal monosomy, or for the X chromosome in a male (XY) fetus.

Three Chromosomes Present

Trisomic chromosomes have three characteristic patterns. The first pattern indicates maternally-inherited meiotic trisomy, a meiotic error where the fetus inherited two homologous, non-identical chromosomes from the mother (FIG. 30E); this pattern includes two central green bands with two each of the peripheral red and blue bands. The second pattern indicates paternally-inherited meiotic trisomy, where the fetus inherited two homologous, non-identical chromosomes from the father (FIG. 30F); this pattern includes four central green bands and three each of the peripheral red and blue bands. The third pattern indicates either maternally— (FIG. 30G) or paternally-inherited (FIG. 30H) mitotic trisomy, a mitotic error where the fetus inherited two identical chromosomes from either the mother or the father; this pattern includes four central green bands with two each of the peripheral red and blue bands. Maternally- and paternally-inherited mitotic trisomies can be distinguished by the placement of the flanking red and blue bands, such that the red and blue internal peripheral bands (those not associated with the limits of the plots) are closer to the center in paternally-inherited mitotic trisomy. This is due to the paternal contribution of identical chromosomes. Note that our previous results indicate that at the blastomere stage, 66.7% of maternally-inherited trisomies are meiotic, and that only 10.2% of trisomies are paternally-inherited.

For the Y chromosome, the PS method considers a different set of hypotheses: zero, one, or two chromosomes present. As there is no maternal contribution to the sequence reads at each locus and because heterozygous loci are not possible (cases of two Y chromosomes necessarily involve two identical chromosomes), the bands remain tightly associated with the top (A alleles) or the bottom (B alleles) of the plot (data not shown), and analysis is greatly simplified, relying on quantitative allele count data. Note that since the method interrogates SNPs, it uses homologous non-recombinant SNPs from the Y chromosome, thus obtaining data on both X and Y for one probe pair.

Identifying Aneuploidies

Identification of autosomal aneuploidies using this plot-based visualization method is straightforward given a sufficient fetal fraction, and requires only identifying plots for which there are an abnormal number of chromosomes present, as described above. Combining the knowledge of copy number of the X and Y chromosomes identifies whether sex chromosome aneuploidies are present. Specifically, plots representing a fetus with a 47,XXX genotype will have a typical "three-chromosome" pattern, and plots representing a fetus with a 47,XXY genotype will have the typical "two-chromosome" pattern for the X chromosome, but will also have allele reads indicating the presence of one Y chromosome. The method is similarly able to call 47,XYY, where a "one chromosome" pattern indicates the presence of a single X chromosome, and allele reads indicate the presence of two Y chromosomes. A fetus with a 45,X genotype will have the typical "one-chromosome" pattern for the X chromosome, and data indicating zero Y chromosomes.

Effects of Fetal Fraction

As discussed above, the number of sequence reads from the fetus contributes to the precise location of each spot along the y-axis in the plots. As fetal fraction will affect the proportion of reads that originate from the fetus and the mother, it will also affect the positioning of each spot. At a high fraction of fetal cfDNA (generally above ~20%), as in FIGS. 30C-30E and FIGS. 30G and 30H, it is readily apparent that although the spots cluster based mainly on maternal genotype, the presence of fetal DNA from alleles whose genotype is distinct from the maternal genotype shift the clusters into multiple, distinct bands. However, as the fetal fraction decreases (as in FIGS. 30B and 30F), the spots regress towards the poles and center of the plot, resulting in tighter clusters. Specifically, the set of peripheral red bands, where the maternal genotype is AA, regress towards the top of the plot; the set of peripheral blue bands, where the maternal genotype is BB, regress towards the bottom; the set of central green bands, where the mother is heterozygous, condense into a single cluster at the center of the plot (compare FIGS. 30B and 30C). Although aneuploidy is not readily apparent by eye using this visualization technique for low fetal fraction cases, the algorithm is able to identify ploidy states with a very low fetal fraction, such as 3% fetal fraction. It is able to do this because the statistical technique compares the observed data to very precise data models that predict the allele distributions for a given sample parameter set (including copy number, parental genotypes, and fetal fraction, for example). Data model precision is critical in low fetal fraction cases, as the differences between the allele distributions for different ploidy states are proportional to the fetal fraction. In addition, the algorithm is able to determine when a data set does not contain enough data to make a confident fetal ploidy determination.

Results

Figure 31A:
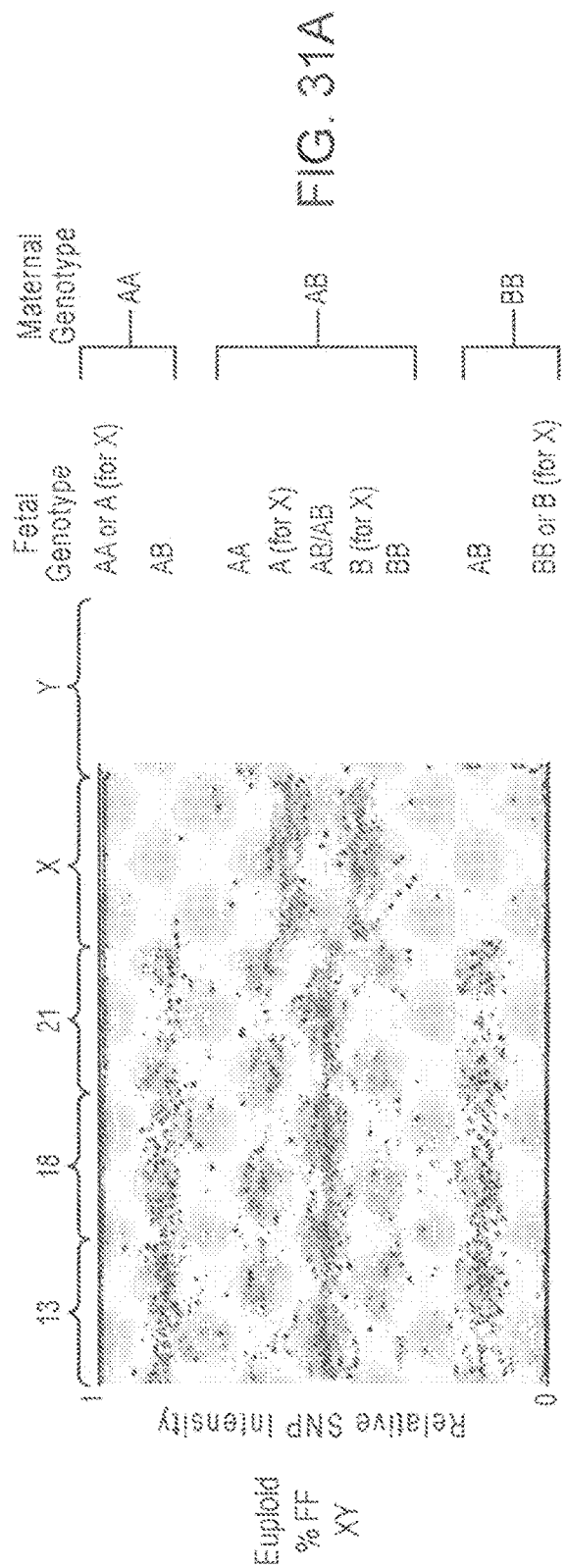
FIG. 31: Graphical representations of (FIG. 31A) euploid, (FIG. 31B) T13, (FIG. 31C) T18, (FIG. 31D) T21, (FIG. 31E) 45,X, (FIG. 31F) 47,XXY, and (FIG. 31G) 47,XYY test samples as indicated. Each chromosome is indicated at the top of the plot, fetal and maternal genotypes are indicated to the right of the plots, the x-axis represents the linear position of the SNPs along each chromosome, and the y-axis indicates the number of A allele reads as a fraction of the total reads. Note the altered cluster positioning based on fetal fraction, as described herein. Each spot represents a single SNP locus. Fetal and maternal genotypes are indicated to the right of the plot, and chromosome identities are indicated at the top of the plots.

Sequencing reads that mapped to targeted SNPs were deemed to be informative and were used by the algorithm. More than 95% of targeted loci were observed in the sequencing results. The plots for visualizing key ploidy calls are depicted in FIG. 31A-31G. FIG. 31A indicates a euploid sample. Here, chromosomes 13, 18, and 21 have the typical "two chromosome" pattern (as described herein). This includes a trio of center green bands, and two red and two blue peripheral bands. This, together with the two center green bands for the X chromosome and the presence of Y chromosome bands along the plots' peripheries, indicate a euploid XY genotype.

Figure 31B:
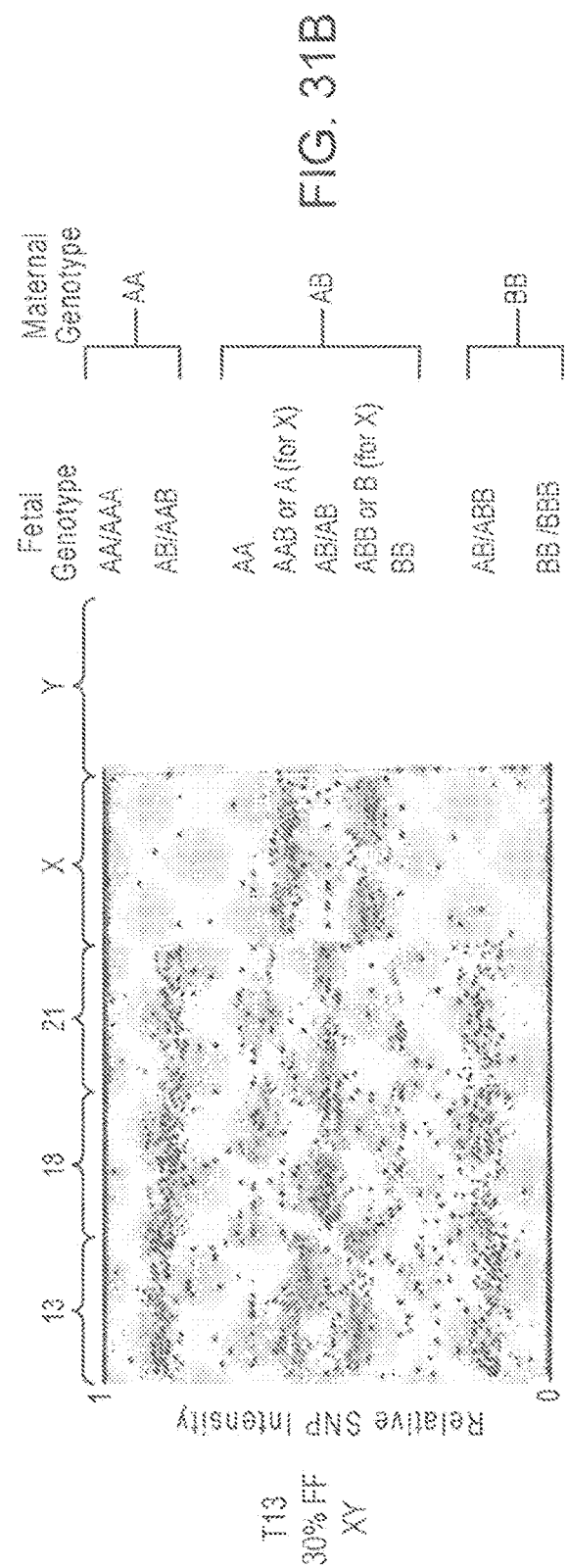
Figure 31E:
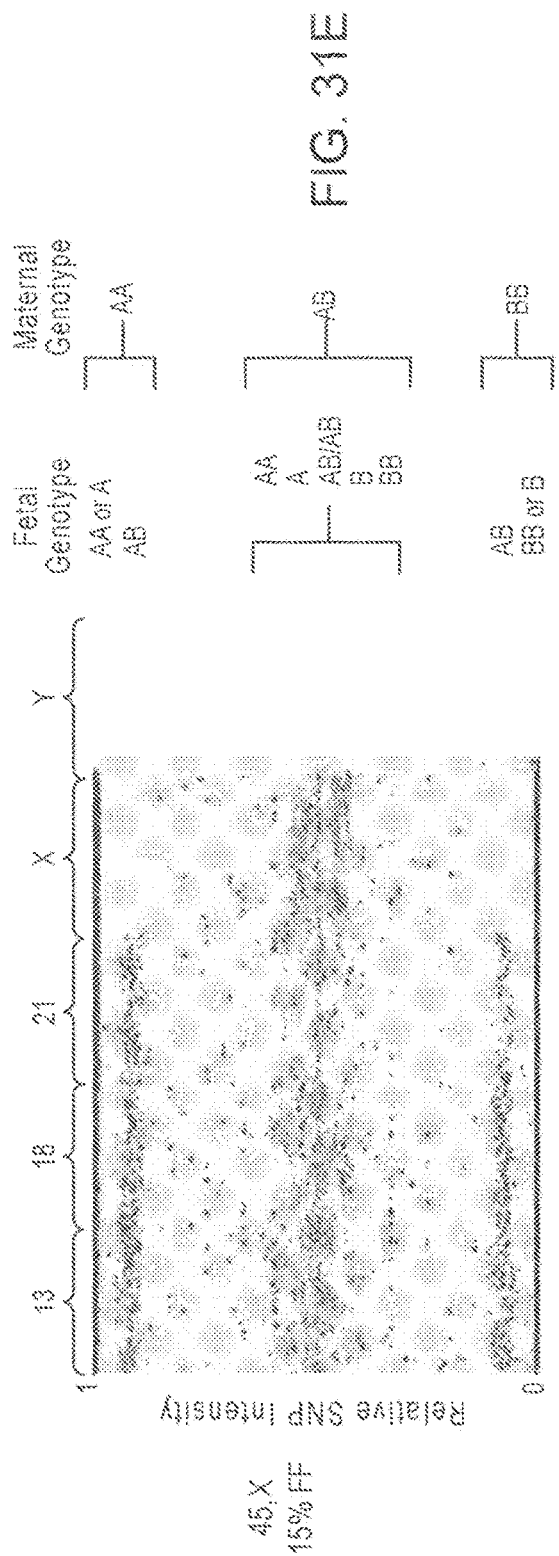
Figure 31F:
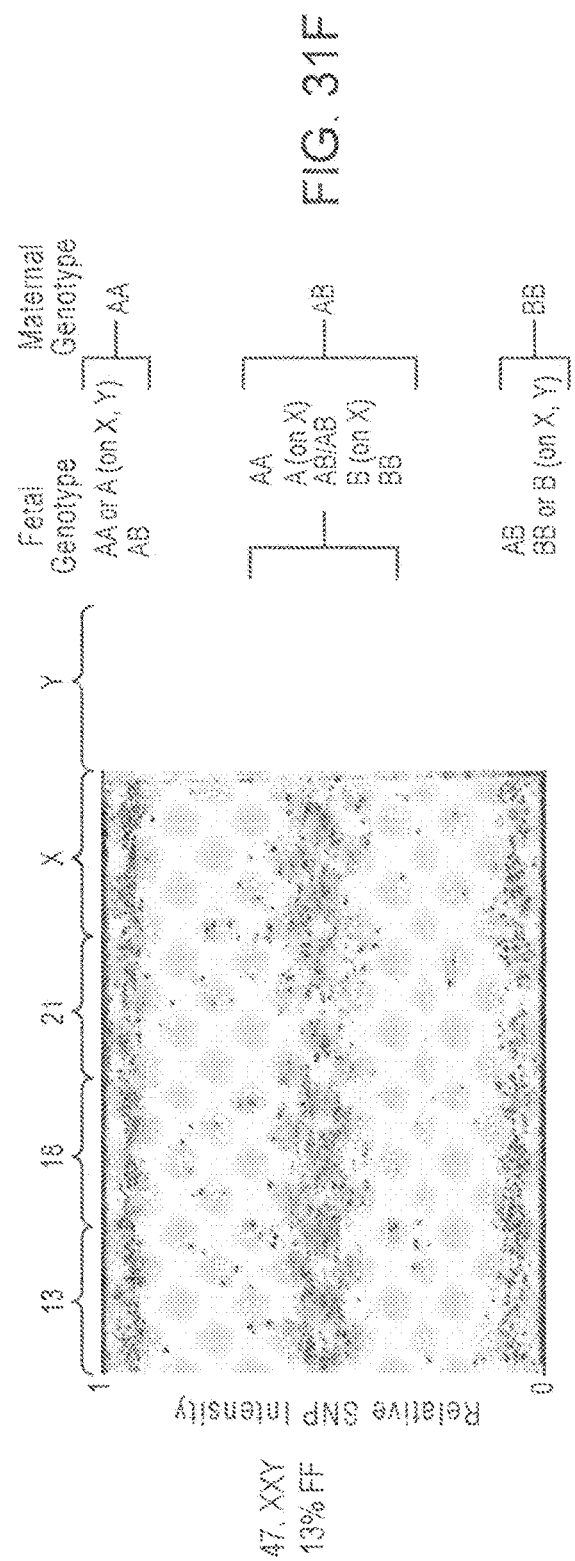

The most prevalent autosomal trisomies, T13, T18, and T21, are indicated by the plots in FIGS. 31B, 31C, and 31D, respectively. Specifically, FIG. 31B depicts a T13 sample. Here, chromosomes 18 and 21 display the typical "two chromosome" pattern, chromosome X displays the typical "one chromosome" pattern, and there are reads from the Y chromosome. Together, this indicates disomy at chromosomes 18 and 21, and identifies a fetal XY genotype. However, chromosome 13 depicts a typical "three chromosome" pattern—specifically. Similarly, FIG. 31C depicts a T18 sample, and FIG. 31D depicts a T21 sample.

Figure 31G:
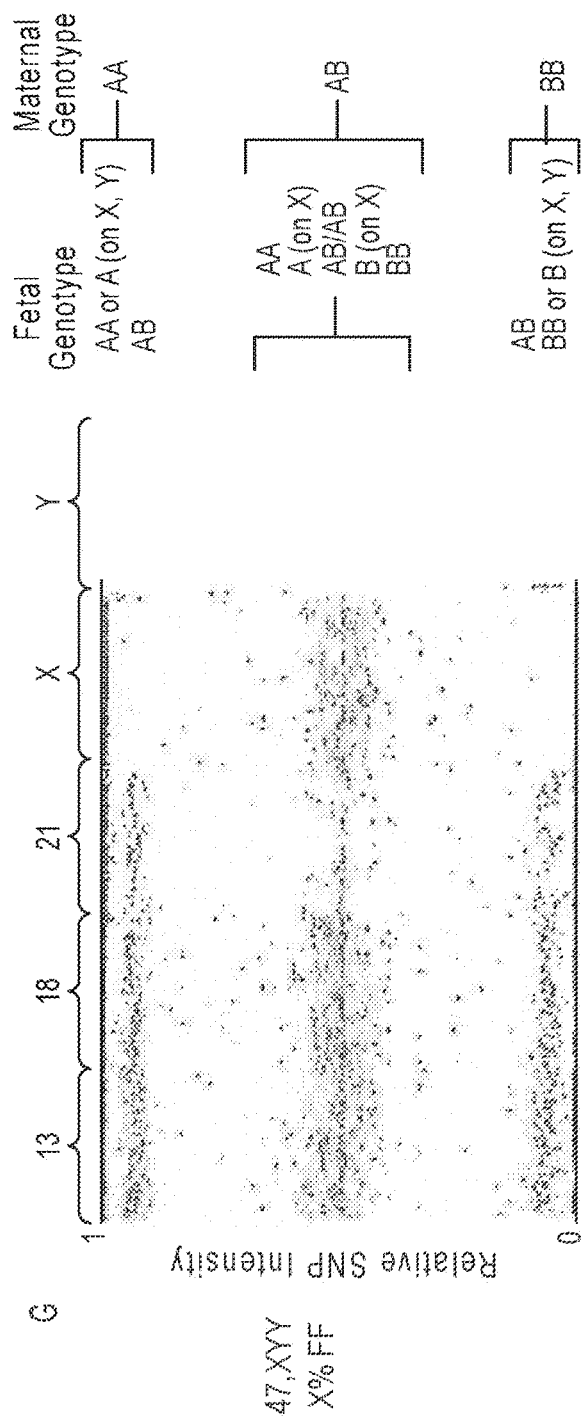

The method is also able to detect sex chromosome aneuploidies, including 45,X (FIG. 31E), 47,XXY (FIG. 31F), and 47,XYY (FIG. 31G). Note that the method is calling copy number at chromosomes 13, 18, 21, X, and Y; the overall chromosome number is reported assuming disomy at the remaining chromosomes. The X chromosome regions of the plot depicting a 45,X sample reveals the presence of a single chromosome. However, the lack of reads from the Y chromosome, coupled with the "two chromosome" pattern for chromosomes 13, 18, and 21, indicate a 45,X genotype. Conversely, the 47,X×Y samples generate a plot revealing the presence of two X chromosomes. The data also revealed reads for alleles from the Y chromosome. Together with the presence of two copies of chromosomes 13, 18, and 21, this indicates a 47,XXY genotype. A 47,XYY genotype is indicated by the presence of a "one chromosome" pattern for the X chromosome, and reads indicating the presence of two Y chromosomes.

Discussion

This method detected T13, T18, T21, 45,X, 47,XXY, and 47,XYY non-invasively from maternal blood. This method interrogates cfDNA from maternal plasma by targeted multiplex PCR amplification and high-throughput sequencing of 19,488 SNPs. This, coupled with the method's sophisticated informatics analyses that take into account parental genotypic information and numerous sample parameters, including fetal fraction and DNA quality, more robustly detects the fetal signal and makes highly accurate ploidy calls at all of the five chromosomes implicated in the seven most common types of at-birth aneuploidy (T13, T18, T21, 45,X, 47,XXX, 47,XXY, and 47,XYY). This method offers a number of clinical advantages over previous methods, including and most significantly greater clinical coverage and sample-specific calculated accuracies (analogous to a personalized risk score).

Increased Clinical Coverage

This method offers approximately a two-fold increase in aneuploidy coverage compared to clinically available NIPT methodologies, given its ability to accurately detect autosomal trisomies and sex chromosome aneuploidies. The method presented here is the only noninvasive test that calls ploidy at the sex chromosomes with high accuracy. Prior DNA mixing experiments and separate plasma samples analyzed in our experimental assays suggest that this method will detect a larger cohort of sex chromosome anomalies, including 47,XXX. The method presented here also detects aneuploidies at chromosomes 13, 18, and 21 with high sensitivities and specificities, and with appropriate primer design is expected to be able to detect copy number at the remaining chromosomes as well.

Sample-Specific Calculated Accuracies

Significantly, this method calculates a sample-specific accuracy for ploidy calls on each chromosome in each sample. Accuracies calculated by this method are expected to significantly lower the rate of incorrect calls by identifying and flagging individual samples that have poor quality DNA or low fetal fractions that are likely to result in a poor accuracy test result. By contrast, massively parallel shotgun sequencing (MPSS)-based methods produce a positive or negative call using a single-hypothesis rejection test, and their accuracy estimate is based on a published study cohort rather than on the characteristics of the individual sample, which are assumed to have the same accuracy as the cohort. However, individual accuracies for samples with parameters in the tail of the cohort distribution may differ significantly. This is exacerbated at low fetal fractions, as in early gestational age, or for samples with low DNA quality. These samples are generally not identified and flagged for follow-up, which can result in missed calls. The present method, however, takes into account many parameters, including fetal fraction and a number of DNA quality metrics, to make each chromosome copy number call, calculating a sample-specific accuracy for that call. This allows the method to identify individual samples with low accuracy and flag them for follow-up. This is expected to nearly eliminate missed calls, especially at the early stages of pregnancy when fetal fractions are typically low. The presumption is that a no call is much preferred to a missed call, since a no call simply requires a redraw and reanalysis.

Converting Calculated Accuracies to Traditional Risk Scores

This method can offer an adjusted risk of aneuploidy for high-risk pregnant women, where the adjusted risk takes into account an a priori risk (Benn P, Cuckle H, Pergament E. Non-invasive prenatal diagnosis for Down syndrome: the paradigm will shift, but slowly. Ultrasound Obstet Gynecol 2012; 39:127-130, which is hereby incorporated by reference in its entirety). Although the present method offers each patient a customized calculated accuracy, for clinical use these accuracies can be converted to traditional risk scores, which also denote the risk of an aneuploid pregnancy but are expressed as fractions. Traditional risk scores take into account various parameters, including maternal age-related risk and serum levels of biochemical markers, to offer a risk score above which a mother is considered high-risk and for whom follow-up invasive diagnostic procedures are recommended. This method significantly refines this risk score, thus reducing both the false positive and false negative rates, and offering a more accurate assessment of individual maternal risk. A calculated accuracy as used here is the likelihood that the ploidy call is correct, and is expressed as a percentage, but the calculated accuracies used in Experiment 19 do not include an age-related risk. Because calculation of a risk score typically includes an age-related risk, the calculated accuracies and traditional risk scores are not interchangeable; they must be combined to convert into a traditional risk score. The formula to combine the age-related risk with the calculated accuracy is:

$$\frac{R_1 R_2}{R_1 R_2 + [1 - R_1][1 - R_2]}$$

where $R_1$ is the risk score as calculated by the present method and $R_2$ is the risk score as calculated by first trimester screening.

SNP-Based Methods Negate Issues with Amplification Variation

An inherent drawback to the counting methods used by some other methods is that they determine fetal ploidy state by measuring the ratio of the number of reads mapping to the chromosome of interest (e.g., chromosome 21) to those mapping to a reference chromosome. Chromosomes with high or low GC content, including chromosomes 13, X, and Y, amplify with high variability. This can result in signal variation that is comparable in magnitude to the fetal cfDNA signal, which can confound copy number calls by altering the ratio of allele reads from the chromosome-of-interest to those from the reference chromosome. This can result in low accuracy for chromosomes 13, X, and Y. Significantly, this problem is exacerbated at low fetal cfDNA fractions, as tends to be the case at early gestational ages.

In contrast, SNP-based methods do not rely on consistent amplification levels between chromosomes, and are thus expected to provide results that are equally accurate across all chromosomes. Because the present method looks, in part, at relative counts of different alleles at polymorphic loci, which by definition differ only by a single nucleotide, it does not require the use of reference chromosomes, and this obviates the problems with chromosome-to-chromosome amplification variation that are inherent to methods that rely on quantitating read counts. Unlike quantitative methods that require reference chromosomes that are euploid, the present method is expected to be able to detect triploidy as well as copy-number neutral anomalies like uniparental disomy.

The Importance of Early Detection

Figure 32:
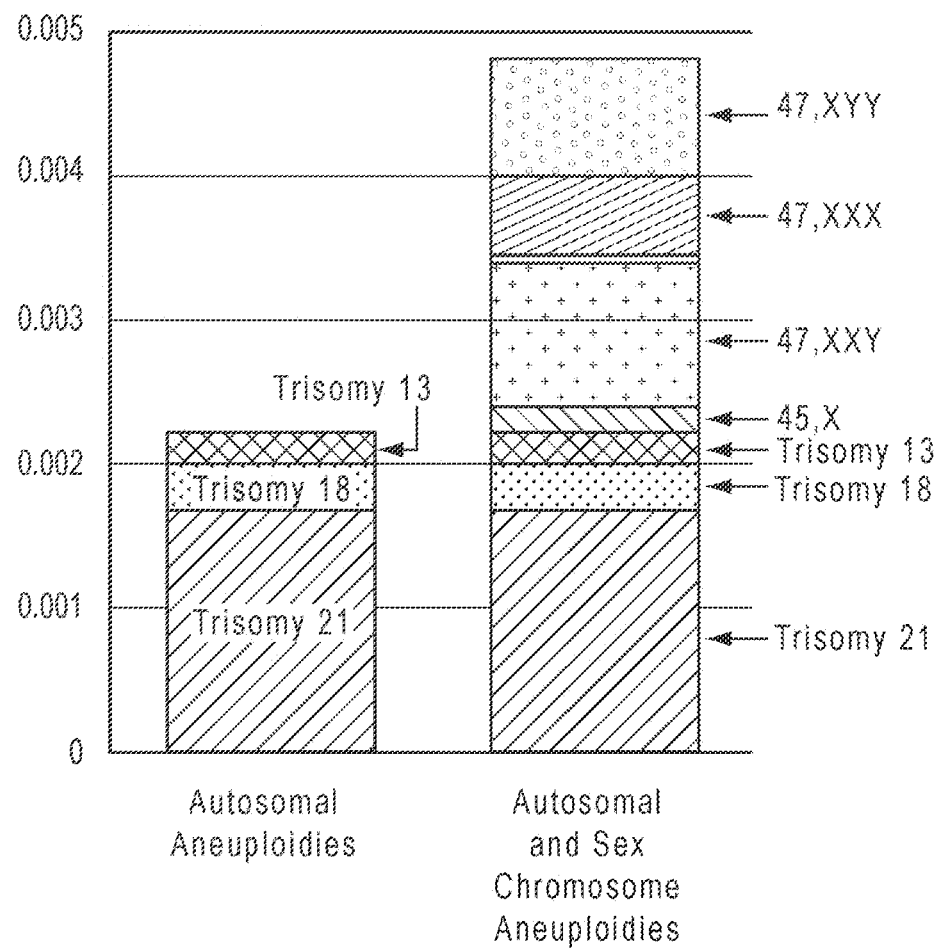
FIG. 32: The combined at-birth prevalence of sex chromosome aneuploidies is greater than that of autosomal aneuploidies.

Significantly, the combined at-birth prevalence of sex chromosome aneuploidies is higher than that of the most common autosomal aneuploidies (FIG. 32). However, there are currently no routine non-invasive screening methods that reliably detect sex chromosome abnormalities. Thus, sex chromosome anomalies are generally detected prenatally as a side-effect of routine testing for Down syndrome or other autosomal aneuploidies; a large proportion of cases are missed entirely. Early and accurate detection is crucial for many of these disorders where early therapeutic intervention improves clinical outcomes. For example, Turner syndrome is often not diagnosed until adolescence, although its overall at-birth prevalence is 1 in 2,500 females. Growth hormone therapy is known to prevent short stature that results from the disorder, but treatments are significantly more effective when initiated prior to the age of 4. Additionally, estrogen replacement therapy can stimulate secondary sexual characteristics in patients with Turner syndrome, but again therapy must be initiated in the pre-teen years, before the syndrome is usually detected. Together, this underscores the importance of early, routine, and safe detection of sex chromosome aneuploidies. This method offers the first approach with the potential to serve as a routine screen for sex chromosome anomalies.

Experiment 20

The following experiment illustrates an exemplary method for designing and selecting primers that can be used in any of the multiplexed PCR methods of the invention. In some embodiments, primers from an initial library of candidate primers are selected so that they can be used to simultaneously amplify a large number of target loci (or a subset of target loci) in a single reaction. In some embodiments, primers from an initial library of candidate primers are selected to form multiple primer pools such that each pool can be used to simultaneously amplify a subset of target loci in a single reaction. Preferably, primers are designed and selected for a large portion or all of the most desirable target loci. Preferably, the minimum number of pools needed to amplify the target loci are created.

Step 1

Calculate a first score for each primer pair design using one or more of the following parameters: number of SNPs within the primers, location of SNPs within the primers, distance from an end of the amplicon to the target bases within the amplicon, number of target loci in an amplicon, heterozygosity rate of the target locus, disease prevalence associated with a sequence (e.g., a polymorphism) at the target locus, disease penetrance associated with a sequence (e.g., a polymorphism) at the target locus, specificity of the candidate primer for the target locus, size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, and size of the target amplicon.

Step 2

Compare each primer pair to every other primer pair, and calculate a second score for the pair using one or more of the following parameters: likelihood of dimer formation, amplicon overlap, number of primer designs for a particular target locus, and distance between amplicons. In some embodiments, the score is infinite if amplicons overlap so that two different primer pairs that generate overlapping amplicons are not included in the same primer pool.

Step 3

Aggregate the first score and the second score together (such as by using a weighted average of the scores).

Step 4

If desired, order all target loci into one contiguous list based upon their genomic location in ascending order.

Step 5

Build a minimum priority queue data structure that prioritizes the pairs of designs (in which each design is one primer pair so that a pair of designs includes two primer pairs with a total of 4 primers) based on their score (such as the aggregate score from step 3). In some embodiments, the score for a pair of designs is the worse score (such as the worse aggregate score from step 3) out of the scores for all 4 primers in the pair of designs. The pair of designs with the best (most desirable) score is first in the queue, and the pair of designs with the worst (least desirable) score is last in the queue. If desired, pairs of designs with a score above a threshold (least desirable) are removed from the library of candidate primers such that they are not included in the final pool(s) (for example, these primers may be omitted from the queue). In some embodiments, pairs of design with an interaction score above (worse than) 20, 18, 16, 14, 12, 10, 9, 8, 7, 6, 5, 4, 3, 2, or 1 kcal/mol are removed from the library of candidate primers. In some embodiments, pairs of design with a ΔG value below (worse than) −20, −18, −16, −14, −12, −10, −9, −8, −7, −6, −5, −4, −3, −2, or −1 kcal/mol are removed from the library of candidate primers.

Each design pair can be stored as a node of a doubly linked list with initial "next" and "previous" pointers set to NULL.

Step 6

Begin forming all pools simultaneously by doing the following steps. Take the design pair with the best (most desirable) score from the priority queue and add it to "the potential pools." Begin storing designs in N number of doubly linked list data structures with the design pairs. N represents the current number of different primer pools. Initially, N=1, since there is only one primer pool. In some embodiments, a second pool is only created if necessary to include the desired target loci or the desired level of coverage of target loci. Check to see if the design pair removed from the queue is "connected" to any other existing design pair. By "connected" for purposes of this step is meant that a single design in one pair is the same as a single design in another pair. If two pairs are connected, then assign the appropriate next and previous pointers to one another. If two pairs are not connected, then add them to the "potential pools" In some embodiments, a design pair is only placed in a particular pool if it would be connected to at most two other design pairs in that pool (otherwise it can be assigned to a different pool).

Check to see if (i) any linked list spans from the first target to the last target (such that all the desired target loci are included) or (ii) if a pool meets the cutoff for the desired minimum pool level. If it does, that list now forms a pool and can be added to the "final pools" list.

Step 7

If desired, check to see if the desired level of coverage (such as all the bases in the target loci being included in amplicons from 4 different primer pairs) that is desired for each location. Repeat step 6 until achieving the desired level of coverage.

The resulting primer pool(s) can be used in any of the methods of the invention.

Experiment 21

The following experiment illustrates an exemplary method for designing and selecting primers that can be used in any of the multiplexed PCR methods of the invention. In some embodiments, the primers are divided into different pools (e.g., 2, 3, 4, 5, 6, or more different pools) such that each pool is used to amplify target loci in a different reaction volume. Each pool is used to simultaneously amplify a large number of target loci (or a subset of target loci) in a single reaction volume. Preferably, primers are designed and selected for a large portion of the most desirable target loci or for all of the target loci. A set of candidate target loci can be selected as described in Experiments 16 or 20 based on the particular polymorphisms or mutations of interest. In some embodiments, one or more of the following type of target loci are included: SNPs, short indels, long indels, exons, and combinations thereof. In some embodiments for target loci that are short indels, the PCR primer or primer pair targets a sequence of adjacent base pairs; and the indel is completely covered by one sequencing read. In some embodiments for target loci that are large indels, two primer pairs are used to target a pair of breakpoints at the boundaries of the indel. In this case, the two primer pairs are designed such that when the deletion is present there is a PCR product and the two primer pairs are selected together for inclusion in the same pool (the four primers are treated by the algorithm as a single assay rather than two assays). In some embodiments for target loci that are exons, a set of primers pairs are designed to tile the full exon.

For each candidate locus, one or more PCR primer pairs are designed using the Primer3 program (available at the worldwide web at primer3.sourceforge.net; libprimer3 release 2.2.3, which is hereby incorporated by reference in its entirety). If there are no feasible designs for PCR primers for a particular target locus, then that target locus is eliminated from further consideration. In some embodiments, each target base is covered by at least two independent PCR assays (such as two independent primer pairs that will amplify the target base) and preferably by four assays, although not all of the available assays for a target must be used. In some embodiments, no targets are omitted. Desirably, the algorithm produces as few pools as possible but may produce more than one pool. In some embodiments, two different primer pairs that are in close proximity in the genome (such as within 2 kbases or 1 kbase) and whose forward primers are on the same strand are not be assigned to the same pool. This constraint avoids primer interference in the extension-and-ligation amplification method In some embodiments in which the PCR will be performed using a polymerase with low 5'→3' exonuclease and/or low strand displacement activity, different primer pairs that are in close proximity in the genome and whose forward primers are on the same strand can be assigned to the same pool since the with low 5'→3' exonuclease and/or low strand displacement activity of the polymerase will reduce or prevent primer interference and allow nearby or adjacent amplicons to be produced.

Step 1

Build an interaction graph. Each node represents one assay (such as one primer pair). Each edge represents a conflict between two assays. There are three types. Interaction edges represent a potential primer dimer and have a score indicating the interaction strength. Proximity edges represent physical proximity of the primer binding sites which may result in interference. Target edges represent redundant designs associated with the same target (a special case of a proximity edge).

Step 2

Select an initial value for the maximum interaction score (e.g., 95% of the maximum score).

Step 3

Compute a score such as a utility score for each assay as follows using steps 3A and 3B.

Step 3A

Calculate a score for each assay based on one or more of its intrinsic characteristics. For example, favor assays with amplicons close to the optimal length (such as 300 bp); favor assays with a shorter distance from the beginning of the amplicon to the target; and/or penalize assays with primers overlapping known SNPs. Any other parameter, such as the parameters disclosed herein can also be included.

Step 3B

Multiply the score for each assay by a factor that varies from 0 to 1 according to the current coverage of the assay's target bases. This factor gives lower weight to targets that are already covered by assays. At the beginning of the algorithm this factor is 1 for all assays because none have been covered. Calculate the factor as follows. For each base in the target, compute a coverage score as $1/(2^c)$ where c is the number of previously-selected assays (in other pools) that cover that base. For instance, if three assays cover the base then the coverage score is $1/(2^3)=0.125$. The factor for the target is the maximum value of the coverage score for all bases in the target. For instance, if the target contains 10 bases, 3 bases are covered by 1 target, and 7 bases are covered by 3 targets, then the factor is $MAX(1/(2^1), 1/(2^3))=0.5$. The score in step 3A is then multiplied by this factor.

Step 4

Use a single iteration of the algorithm in Experiment 16 to design a pool given the current maximum interaction score: Construct a new graph with the assays that have not been assigned to a pool yet and with the edges that have weights exceeding the maximum interaction score. Remove nodes (assays) according to the algorithm in Experiment 16 until there are no edges left. The assay utility scores come from step 3 in this experiment rather than the calculation used for Experiment 16

Step 5

Save the assays selected in step 4 as a new pool and remove them from consideration. Then repeat steps 3 and 4 with the remaining assays, and iterate until all targets have sufficient coverage.

Step 6

If desired, evaluate the result. If the total number of pools meets the design goal then reduce the maximum interaction score; otherwise increase the maximum interaction score. Then go back to step 3. Iterate, using a binary search strategy to find the lowest maximum interaction score that produces the desired number of pools.

Step 7

Output the pools from the final iteration. After the selection process, the primers remaining in the pools may be used in any of the methods of the invention.

Experiment 22

The following experiment illustrates an exemplary method for designing and selecting primers that can be used in any of the multiplexed PCR methods of the invention. In some embodiments, the primers are divided into different pools (e.g., 2, 3, 4, 5, 6, or more different pools) such that each pool is used to amplify target loci in a different reaction volume. Any of the embodiments listed in Experiment 21 can be used for this experiment as well. This method uses a graph coloring algorithm.

Step 1

Select 2, 3 or 4 of the best assays (such as primer pairs) for each target locus from all of the available assays.

Step 2

Select an initial maximum interaction score.

Step 3

Build an interaction graph containing only edges that exceed the maximum interaction score.

Step 4

Color the graph such that no adjacent nodes have the same color (this is a standard problem with many heuristic solutions). Each color represents a different pool.

Step 5

Go back to step 3 and iterate, refining the maximum interaction score until the desired number of pools is achieved. In some embodiments, after the primers are selected in step 1, the algorithm assumes all assays must be included in a pool.

After the primers are divided into different pools, the pools may be used in any of the methods of the invention.

Experiment 23

This example illustrates there exemplary methods for calculating the limit of detection for any of the methods of the invention. These methods were used to calculate the limit of detection for single nucleotide variants (SNVs) in a tumor biopsy (FIG. 41) and a plasma sample (FIG. 42).

The first method (denoted "LOD-mr5" in FIGS. 41 and 42) calculates the limit of detection based on a minimum of 5 reads being chosen as the minimum number of times a SNV is observed in the sequencing data to have sufficient confidence the SNV is actually present. The limit of detection is based on whether the observed the depth of read (DOR) is above this minimum of 5. The gray lines in FIGS. 41 and 42 indicate SNVs for which the limit of detection is limited by the DOR. In these cases, not enough reads were measured to reach the error limit of the assay. If desired, the limit of detection can be improved (resulting in a lower numerical value) for these SNVs by increasing the DOR.

The second method (denoted "LOD-zs5.0" in FIGS. 41 and 42) calculates the limit of detection based on the z-score. The Z-score is the number of standard deviations an observed error percentage is away from the background mean error. If desired, outliers can be removed and the z-score can be recalculated and this process can be repeated. The final weighted mean and the standard deviation of the error rate are used to calculate the z-score. The mean is weighted by the DOR since the accuracy is higher when the DOR is higher.

For the exemplary z-score calculation used for this example, the background mean error and standard deviation were calculated from all the other samples of the same sequencing run weighted by their depth of read, for each genomic loci and substitution type. Samples were not considered in the background distribution if they were 5 standard deviations away from the background mean. The orange lines in FIGS. 41 and 42 indicate SNVs for which the limit of detection is limited by the error rate. For these SNV's enough reads were taken to reach the 5 read minimum, and the limit of detection was limited by the error rate. If desired, the limit of detection can be improved by optimizing the assay to reduce the error rate.

The third method (denoted "LOD-zs5.0-mr5" in FIGS. 41 and 42) calculates the limit of detection based on the maximum value of the above two metrics.

Figure 41:
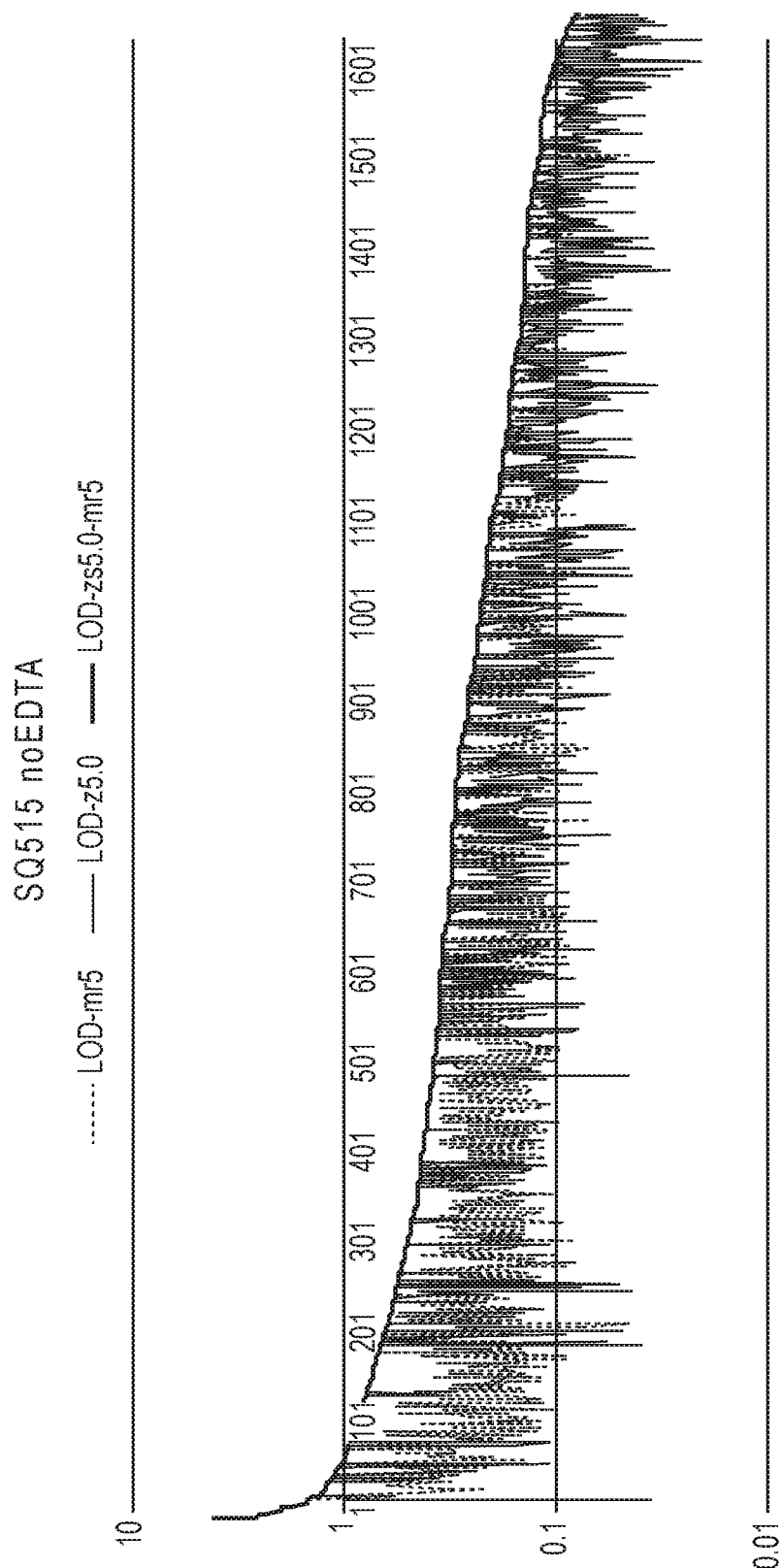
FIG. 41 is a graph showing the limit of detection for single nucleotide variants in a tumor biopsy using three different methods described in Experiment 23.
Figure 42:
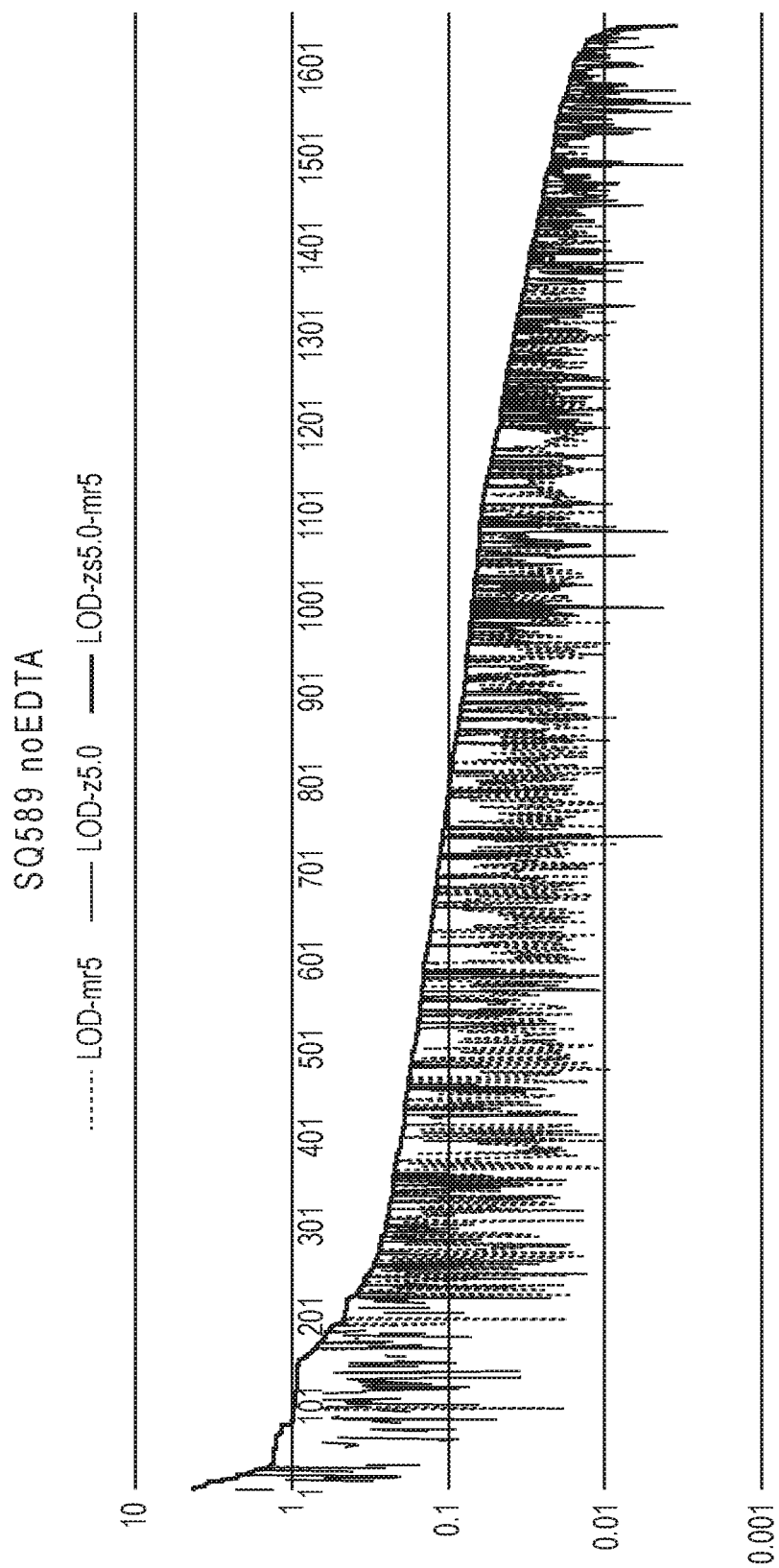
FIG. 42 is a graph showing the limit of detection for single nucleotide variants in a plasma sample using three different methods described in Experiment 23.

For the analysis of a tumor sample shown in FIG. 41, the mean limit of detection was 0.36%, and the median limit of detection was 0.28%. The number of DOR limited (gray lines) SNVs was 934. The number of error rate limited (orange lines) SNVs was 738. For the analysis of cDNA in a plasma sample shown in FIG. 42, the mean limit of detection was 0.24%, and the median limit of detection was 0.09%. The number of DOR limited (gray lines) SNVs was 732. The number of error rate limited (orange lines) SNVs was 921.

Experiment 24

This example illustrates the detection of CNVs and SNVs from the same single cell. The following primer libraries were used a library of ~28,000 primers for detecting CNVs, a library of ~3,000 primers for detecting CNVs, and library of primers for detecting SNVs. For analysis of a single cell, cells were serial diluted until there were 3 or 4 cells per droplet. An individual cell was pipetted and placed into a PCR tube. The cell was lysed using Protease K, salt, and DTT using the following thermocycling conditions: 56° C. for 20 minutes, 95° C. for 10 minutes, and then a 4° C. hold. For analysis of genomic DNA, DNA from the same cell line as the analyzed single cell was either purchased or obtained by growing the cells and extracting the DNA.

For amplification with the library of ~28,000 primers, the following PCR conditions were used a 40 uL reaction volume, 7.5 nM of each primer, and 2× master mix (MM). In some embodiments QIAGEN Multiplex PCR Kit is used for the master mix (QIAGEN catalog No. 206143; see, e.g., information available at the world wide web at qiagen.com/products/catalog/assay-technologies/end-point-pcr-and-rt-pcr-reagents/qiagen-multiplex-pcr-kit, is which is hereby incorporated by reference in its entirety). The kit includes 2× QIAGEN Multiplex PCR Master Mix (providing a final concentration of 3 mM $MgCl_2$, 3×0.85 ml), 5× Q-Solution (1×2.0 ml), and RNase-Free Water (2×1.7 ml). The QIAGEN Multiplex PCR Master Mix (MM) contains a combination of KCl and $(NH_4)_2SO_4$ as well as the PCR additive, Factor MP, which increases the local concentration of primers at the template. Factor MP stabilizes specifically bound primers, allowing efficient primer extension by, e.g., HotStarTaq DNA Polymerase. HotStarTaq DNA Polymerase is a modified form of Taq DNA polymerase and has no polymerase activity at ambient temperatures. The following thermocycling conditions were used for the first round of PCR: 95° C. for 10 minutes; 25 cycles of 96° C. for 30 seconds, 65° C. for 29 minutes, and 72° C. for 30 seconds; and then 72° C. for 2 minutes, and a 4° C. hold. For the second round of PCR a 10 ul reaction volume, 1×MM, and 5 nM of each primer was used. The following thermocycling conditions were used: 95° C. for 15 minutes; 25 cycles of 94° C. for 30 seconds, 65° C. for 1 minute, 60° C. for 5 minutes, 65° C. for 5 minutes, and 72° C. for 30 seconds; and then 72° C. for 2 minutes, and a 4° C. hold.

For the library of ~3,000 primers, exemplary reaction conditions include a 10 ul reaction volume, 2×MM, 70 mM TMAC, and 2 nM primer of each primer. For the library of primers for detecting SNVs, exemplary reaction conditions include a 10 ul reaction volume, 2×MM, 4 mM EDTA, and 7.5 nM primer of each primer. Exemplary thermocycling conditions include 95° C. for 15 minutes, 20 cycles of 94° C. for 30 seconds, 65° C. for 15 minutes, and 72° C. for 30 seconds; and then 72° C. for 2 minutes, and a 4° C. hold. The amplified products were barcoded. One run of sequencing was performed with an approximately equal number of reads per sample.

Figure 43A:
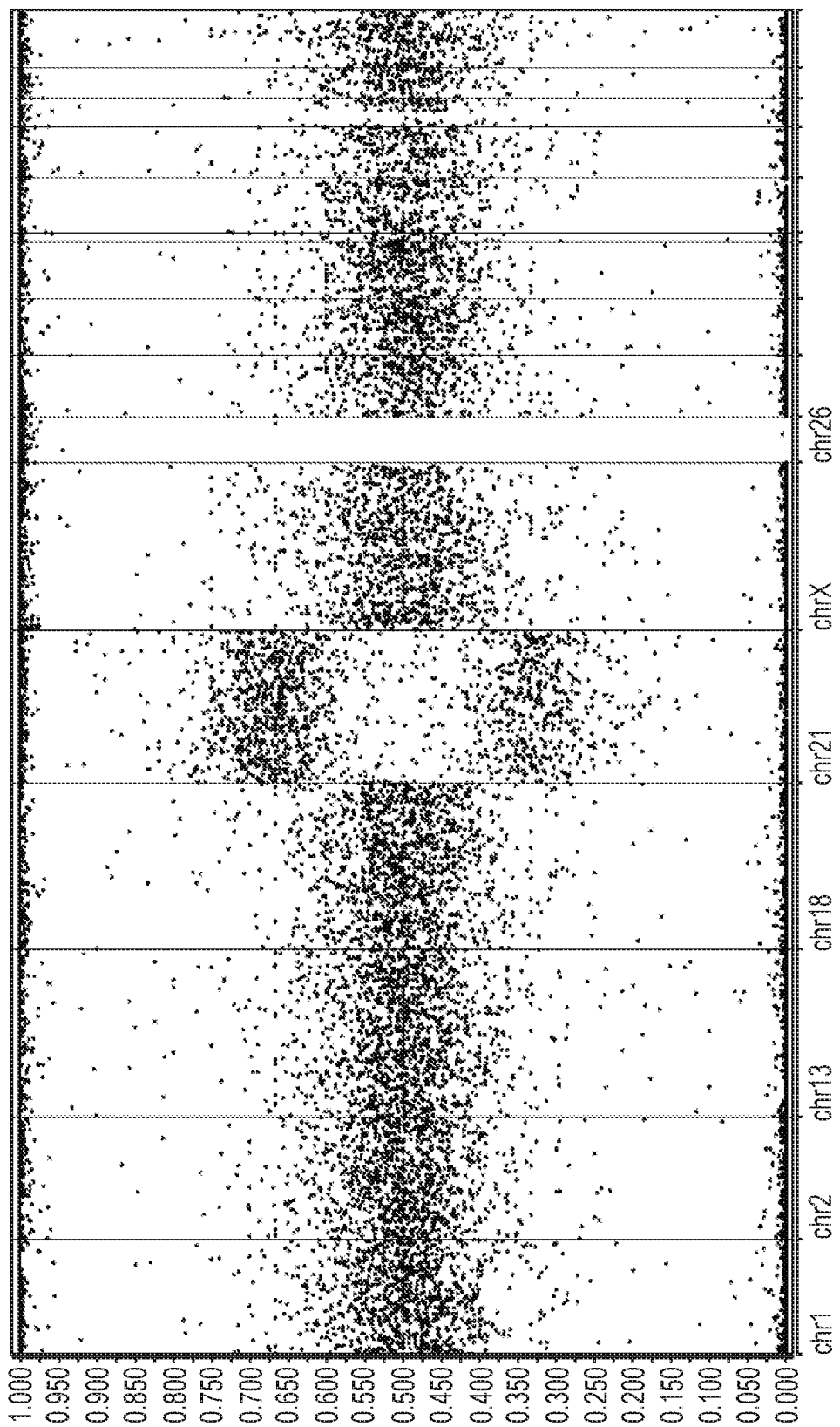
FIGS. 43A and 43B are graphs of the analysis of genomic DNA (FIG. 43A) or DNA from a single cell (FIG. 43B) using a library of approximately 28,000 primers designed to detect CNVs. The presence of two central bands instead of one central band indicates the presence of a CNV. The x-axis represents the linear position of the SNPs, and the y-axis indicates the fraction of A allele reads out of the total reads.
Figure 43B:
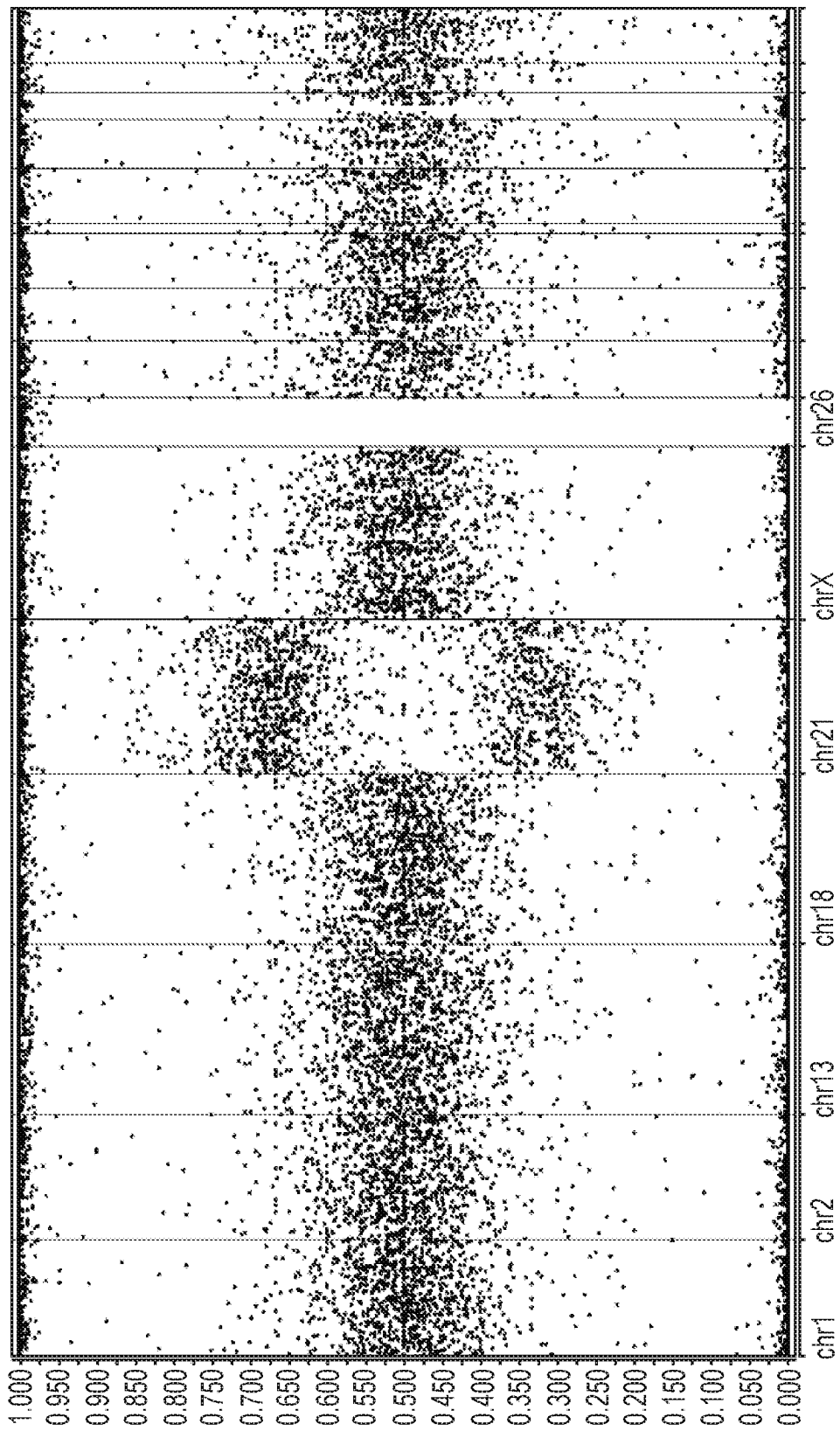

FIGS. 43A and 43B show results from analysis of genomic DNA (FIG. 43A) or DNA from a single cell (FIG. 43B) using a library of approximately 28,000 primers designed to detect CNVs. Approximately 4 million reads were measured per sample. The presence of two central bands instead of one central band indicates the presence of a CNV. For three samples of DNA from a single cell, the percent of mapped reads was 89.9%, 94.0%, and 93.4%, respectively. For two samples of genomic DNA the percent of mapped reads was 99.1% for each sample.

Figure 44A:
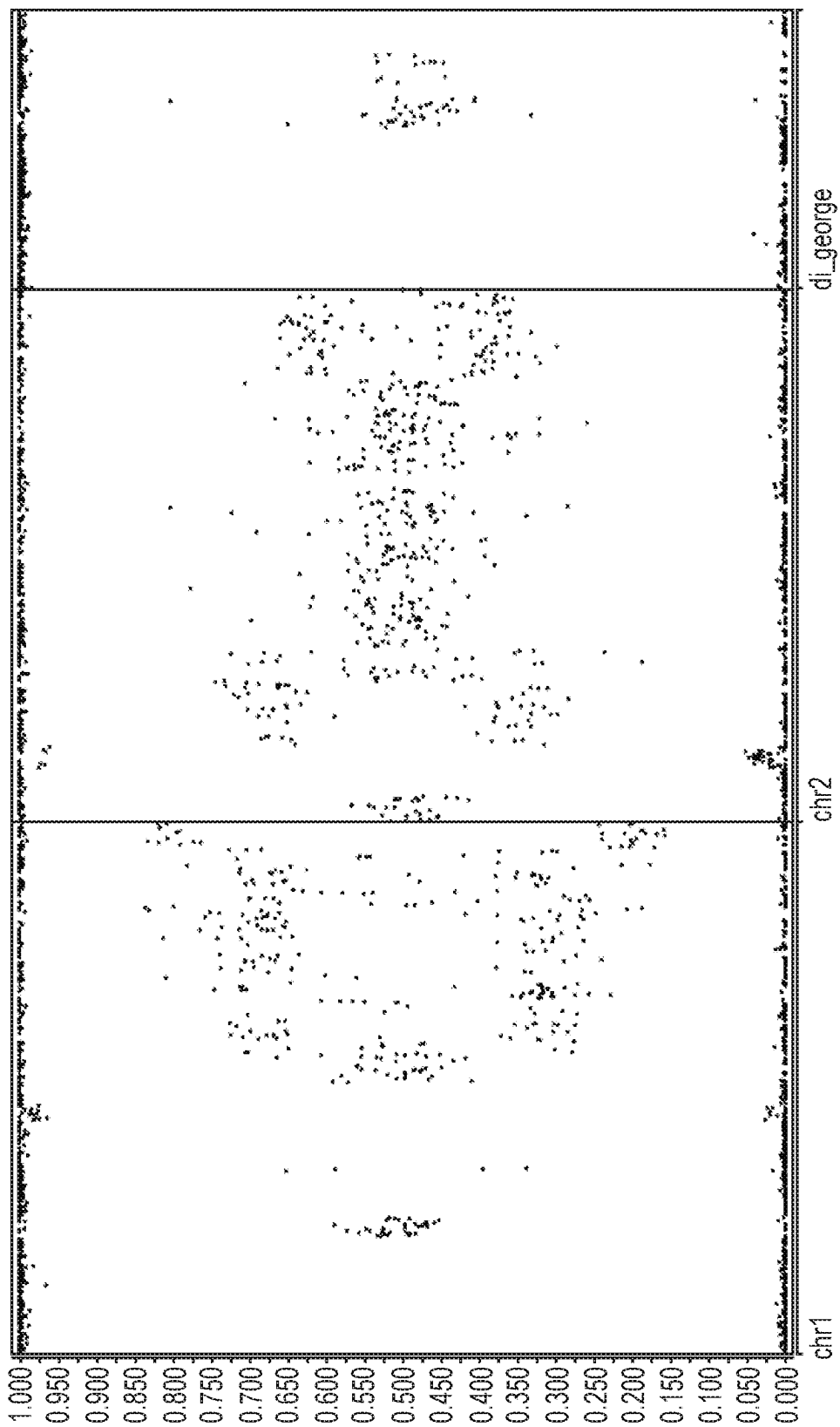
FIGS. 44A and 44B are graphs of the analysis of genomic DNA (FIG. 44A) or DNA from a single cell (FIG. 44B) using a library of approximately 3,000 primers designed to detect CNVs. The presence of two central bands instead of one central band indicates the presence of a CNV. The x-axis represents the linear position of the SNPs, and the y-axis indicates the fraction of A allele reads out of the total reads.
Figure 44B:
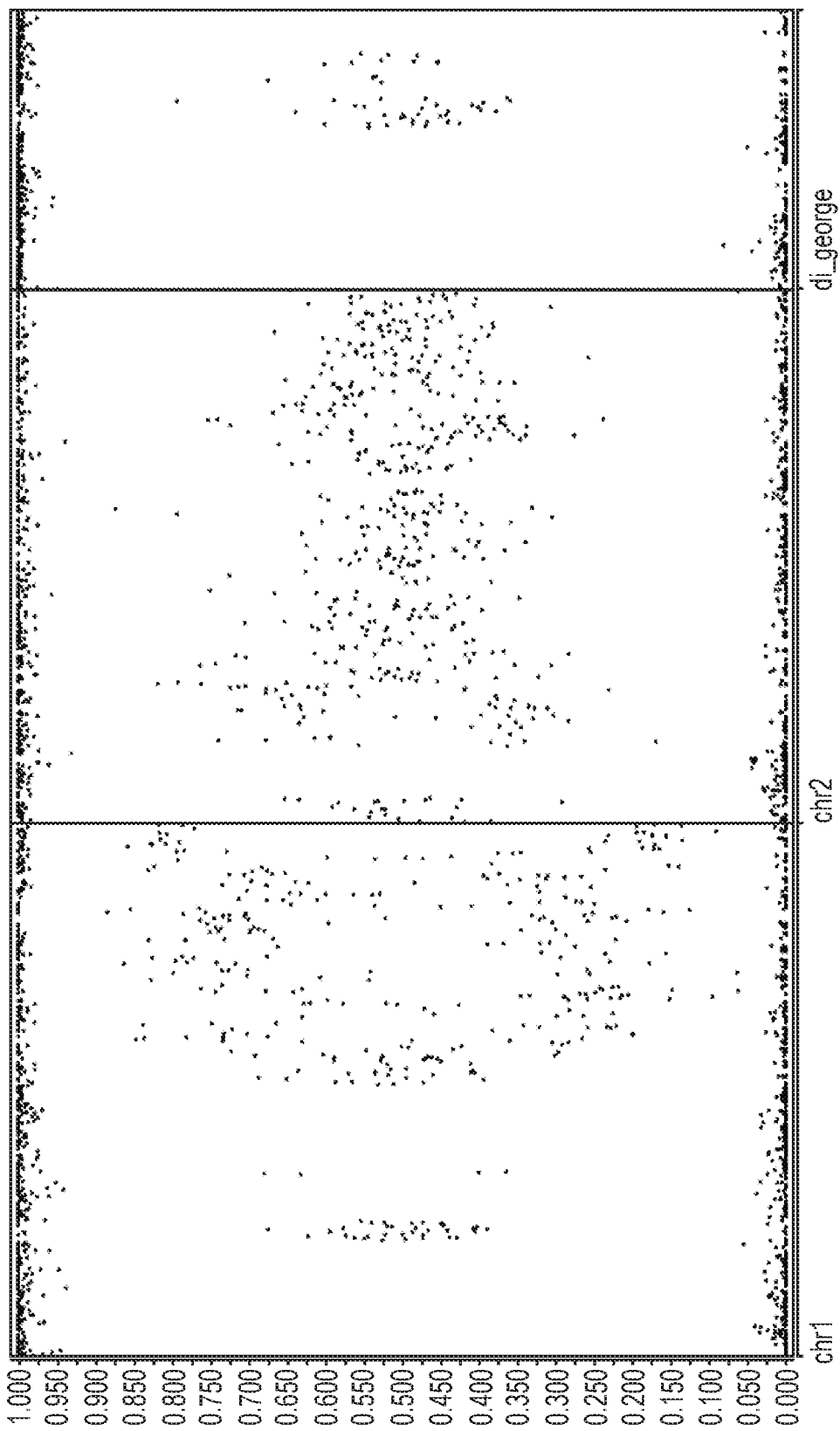
Figure 45:
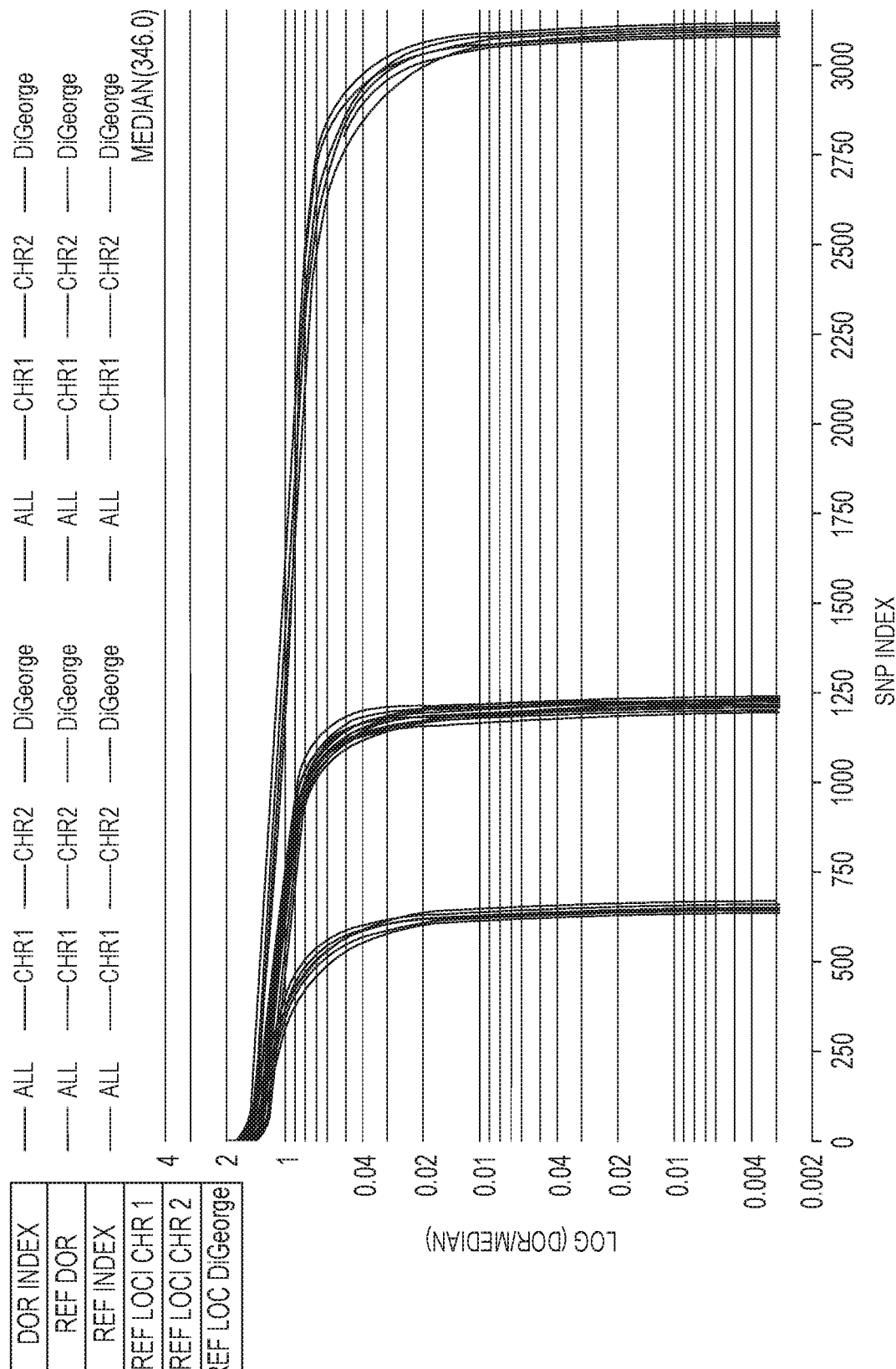
FIG. 45 is a graph illustrating the uniformity in depth of read (DOR) for these ~3,000 loci.

FIGS. 44A and 44B show results from analysis of genomic DNA (FIG. 44A) or DNA from a single cell (FIG. 44B) using a library of approximately 3,000 primers designed to detect CNVs. Approximately 1.2 million reads were measured per sample. The presence of two central bands instead of one central band indicates the presence of a CNV. For three samples of DNA from a single cell, the percent of mapped reads was 98.2%, 98.2%, and 97.9%, respectively. For two samples of genomic DNA the percent of mapped reads was 98.8% for each sample. FIG. 45 illustrates the uniformity in DOR for these ~3,000 loci.

Figure 47:
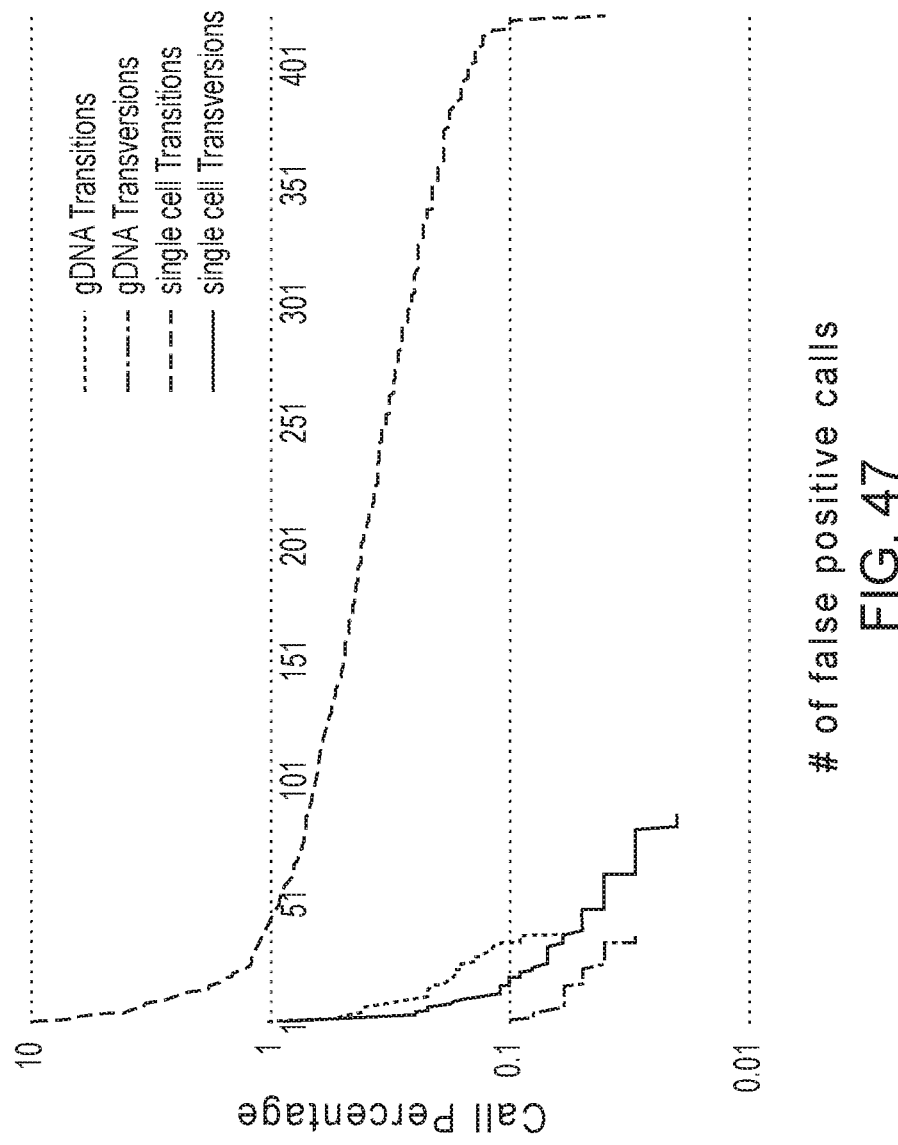
FIG. 47 is a graph of error rates for transition mutations and transversion mutations.

For calling SNVs, the call percent for true positive mutations was similar for DNA from a single cell and genomic DNA. A graph of call percent for true positive mutations for single cells on the y-axis versus that for genomic DNA on the x-axis yielded a curve fit of y=1.0076x−0.3088 with $R^2$=0.9834. FIG. 46 shows similar error call metrics for genomic DNA and DNA from a single cell. FIG. 47 shows that the error rate for detecting transition mutations was greater than for detecting transversion mutations, indicating it may be desirable to select transversion mutations for detection rather than transition mutations when possible. In some embodiments, at least 50, 60, 70, 80, 90, 95, 96, 98, 99, or 100% of the SNVs tested for are transversion mutations rather than transition mutations.

Experiment 25

The following is an example of multiplex PCR conditions in which the annealing temperature is significantly higher than the average or maximum melting ($T_m$) of the primers in the library. A 3,168-plex reaction was performed with 3,168 primer pairs to 3,168 different target loci. For the PCR amplification a 20 ul total volume was used with 2 nM of each primer (3,168 pairs of forward and reverse primers), 70 mM TMAC (tetra-methyl ammonium chloride), and 7 ul library DNA or genomic DNA. The following thermocycling conditions were used: 95° C. for 10 minutes and then 25 cycles of 96° C. for 30 seconds, 65° C. for 20 minutes (this annealing temperature is higher than the $T_m$ of the primers, listed above), and 72° C. for 30 seconds. Then, 72° C. for 2 minutes and a 4° C. hold were used.

The minimum $T_m$ (the lowest numerical value for the $T_m$ for any of the primers) for this primer library is 54.0° C. The maximum $T_m$ (the highest numerical value for the $T_m$ for any of the primers) for this primer library is 60.36° C. The average $T_m$ (average value of the $T_m$ values of the primers) for this primer library is 55.25° C. These $T_m$ values were calculated using the following exemplary method for calculating $T_m$ values. This method is used by the Primer3 program (the worldwide web at primer3.sourceforge.net, which is hereby incorporated by reference in its entirety) to calculate $T_m$ values. In some embodiments, one or more of the following conditions are assumed for this calculation: temperature: of 60.0° C., primer concentration of 100 nM, and/or salt concentration of 100 mM. In some embodiments, other conditions are assumed for this calculation, such as the conditions that will be used for multiplex PCR with the library.

$$Tm = \text{delta}H/(\text{delta}S + R^* \ln(C/4))$$

Below is documentation from the Primer3 program for its Tm calculations; PRIMER_TM_FORMULA (int; default 0) specifies details of melting temperature calculation. This is new in version 1.1.0, and added by Maido Remm and Triinu Koressaar (the world wide web at primer3.ut.ee/primer3web_help.htm#PRIMER_TM_FORMULA, which is hereby incorporated by reference in its entirety). A value of 0 directs primer3 to a backward compatible calculation (in other words, the only calculation available in previous version of primer3). This backward compatible calculation uses the table of thermodynamic parameters in the paper (Breslauer K J et al. (1986) "Predicting DNA duplex stability from the base sequence" Proc Natl Acad Sci 83:4746-50, dx.doi.org/10.1073/pnas.83.11.3746, which is hereby incorporated by reference in its entirety), and the method in the paper (Rychlik W, Spencer W J and Rhoads R E (1990) "Optimization of the annealing temperature for DNA amplification in vitro", Nucleic Acids Res 18:6409-12, dx.doi.org/10.1093/nar/18.21.6409, which is hereby incorporated by reference in its entirety).

A value of 1 (which is recommended) directs primer3 to use the table of thermodynamic values and the method for melting temperature calculation suggested in the following paper (SantaLucia JR (1998) "A unified view of polymer, dumbbell and oligonucleotide DNA nearest-neighbor thermodynamics", Proc Natl Acad Sci 95:1460-65, dx.doi.org/10.1073/pnas.95.4.1460, which is hereby incorporated by reference in its entirety). The tag PRIMER_SALT_CORRECTIONS can be used to specify the salt correction method for melting temperature calculation.

The following is an example of calculating the melting temperature of an oligo with PRIMER_TM_FORMULA=1 and PRIMER_SALT_CORRECTIONS=1 recommended values for primer=CGTGACGTGACGGACT.

Using default salt and DNA concentrations gives $$Tm = \text{delta}H/(\text{delta}S + R^* \ln(C/4))$$

where R is the gas constant (1.987 cal/K mol) and C is the DNA concentration.

$$deltaH(\text{predicted}) = dH(CG) + dH(GT) + dH(TG) + \ldots +$$
$$dH(CT) + dH(init.w.term.GC) + dH(init.w.term.AT) =$$
$$-10.6 + (-8.4) + (-8.5) + \ldots + (-7.8) + 0.1 + 2.3 = -128.8 \text{ kcal/mol}$$

where 'init.w.term GC' and 'init.w.term AT' are two initiation parameters for duplex formation: 'initiation with terminal GC' and 'initiation with terminal AT.'

$$deltaS(\text{predicted}) =$$
$$dS(CG) + dS(GT) + dS(TG) + \ldots + dS(CT) + dS(init.w.term.GC) +$$
$$dS(init.w.term.AT) = -27.2 + (-22.4) + (-22.7) + .;.$$
$$+ (-21.0) + (-2.8) + 4.1 = -345.2 \text{ cal/k}^*\text{mol}$$

$$deltaS(\text{salt corrected}) = deltaS(\text{predicted}) +$$
$$0.368 * 15(NN \text{ pairs}) * \ln(0.05M \text{ monovalent cations}) = -361.736$$
$$Tm = -128.800/(-361.736 + 1.987 * \ln((5 * 10^\wedge(-8))/4)) = 323.704K$$
$$Tm(C) = 323.704 - 273.15 = 50.554C$$

ADDITIONAL APPLICATIONS

Because this method utilizes targeted amplification, it is uniquely poised to detect submicroscopic anomalies, such as microdeletions and microduplications. Although non-targeted methods like MPSS have been shown to detect the DiGeorge microdeletion syndrome, this required a sufficiently high level of genomic coverage so as to make the approach unfeasible. This is because non-targeted amplification will be several orders of magnitude less efficient on submicroscopic regions, as very small fraction of the sequencing reads will be informative. Additionally, the fact that the currently available methods have trouble accurately identifying ploidy state for the sex chromosomes suggests that they will also encounter variable amplification problems on smaller chromosomal segments.

Similarly, SNP based methods can detect UPD disorders, which are copy number-neutral anomalies that will not be detected by either the current noninvasive methods that rely on counting or the traditional invasive methods like amniocentesis and CVS that rely on cytogenetic karyotyping and/or fluorescence in situ hybridization. This is because SNP-based methods are uniquely able to distinguish individual haplotypes, whereas the clinically available MPSS-based and targeted methods amplify non-polymorphic loci and are thus unable to determine, for example, whether the chromosomes-of-interest originate from the same parent.

This means that these microdeletion/microduplication and UPD syndromes, including Prader-Willi, Angelman, and Beckwith-Wiedemann syndromes, are generally not diagnosed prenatally, and are often initially misdiagnosed postnatally. This significantly delays therapeutic intervention. Additionally, because this method targets SNPs, this method will also facilitate parental haplotype reconstruction, allowing for detection of fetal inheritance of individual disease-linked loci (Kitzman J O, Snyder M W, Ventura M, et al. Noninvasive whole-genome sequencing of a human fetus. Sci Transl Med 2012; 4:137ra76, which is hereby incorporated by reference in its entirety).

The results presented here confirm the expanded scope of this method for identifying prenatal aneuploidy. Specifically, by amplifying and sequencing 19,488 SNPs, this method is able to determine copy number at chromosomes 13, 18, 21, X, and Y, and is uniquely expected to detect other chromosomal abnormalities, such as triploidy and UPD, that are not detected by any other clinically available non-invasive method. The increased clinical coverage and powerful sample-specific calculated accuracies suggest that this method may offer a viable adjunct to invasive testing for detecting fetal chromosomal aneuploidies.

All patents, patent applications, and published references cited herein are hereby incorporated by reference in their entirety. While the methods of the present disclosure have been described in connection with the specific embodiments thereof, it will be understood that it is capable of further modification. Furthermore, this application is intended to cover any variations, uses, or adaptations of the methods of the present disclosure, including such departures from the present disclosure as come within known or customary practice in the art to which the methods of the present disclosure pertain, and as fall within the scope of the appended claims. For example, any of the methods disclosed herein for DNA can be readily adapted for RNA by including a reverse transcription step to convert the RNA into DNA. Examples that use polymorphic loci for illustration can be readily adapted for the amplification of nonpolymorphic loci if desired. Any of the methods disclosed herein can be used with a low level of multiplexing if desired (such as with less than 1,000, 750, 500, 250, 100, 75, 50, 25, or 10 different primers or different primer pairs to different target loci).

SEQUENCE LISTING (44623 sequences)

SEQ ID NO: 1 - DNA, 22 bp, Artificial Sequence
  Synthetic Construct
ggcacaacatttgggagacaaa

SEQ ID NO: 2 - DNA, 26 bp, Artificial Sequence
  Synthetic Construct
cctggaacctgaaagcttgcaaaaag

SEQ ID NO: 3 - DNA, 20 bp, Artificial Sequence
  Synthetic Construct
acagggtgctctcctcttga

SEQ ID NO: 4 - DNA, 25 bp, Artificial Sequence
  Synthetic Construct
ggaagcaaacaggtagagcctggta

SEQ ID NO: 5 - DNA, 23 bp, Artificial Sequence
  Synthetic Construct
ctacaacaacagagctccaggat

SEQ ID NO: 6 - DNA, 23 bp, Artificial Sequence
  Synthetic Construct
tgtccttggtcgtatgtgagaga

SEQ ID NO: 7 - DNA, 20 bp, Artificial Sequence
  Synthetic Construct
gcaggaactggcttgccttt

SEQ ID NO: 8 - DNA, 23 bp, Artificial Sequence
  Synthetic Construct
aggtttcggctttagttgtgtga

SEQ ID NO: 9 - DNA, 21 bp, Artificial Sequence
  Synthetic Construct
tgtctgcttctgccggcattc

SEQ ID NO: 10 - DNA, 25 bp, Artificial Sequence
  Synthetic Construct
gtccctcacacctttctaccagaag

SEQ ID NO: 11 - DNA, 25 bp, Artificial Sequence
  Synthetic Construct
ggctgcaggagtagaggtctaaatg

SEQ ID NO: 12 - DNA, 25 bp, Artificial Sequence
  Synthetic Construct
ggcaagaagaaaactggagccaaga

SEQ ID NO: 13 - DNA, 24 bp, Artificial Sequence
  Synthetic Construct
gagcctgagttcttgatcactaca

SEQ ID NO: 14 - DNA, 21 bp, Artificial Sequence
  Synthetic Construct
cctggaaaaagccccggtaga

SEQ ID NO: 15 - DNA, 21 bp, Artificial Sequence
  Synthetic Construct
gcaatggtcccagtgagagtt

SEQ ID NO: 16 - DNA, 20 bp, Artificial Sequence
  Synthetic Construct
gccctttggaacctgaccaa

SEQ ID NO: 17 - DNA, 24 bp, Artificial Sequence
  Synthetic Construct
ggccttgatttgacccttcttttc

SEQ ID NO: 18 - DNA, 22 bp, Artificial Sequence
  Synthetic Construct
ccacccgcttctgaaacacatc

SEQ ID NO: 19 - DNA, 18 bp, Artificial Sequence
  Synthetic Construct
tggcgctaaagcccaaca

SEQ ID NO: 20 - DNA, 24 bp, Artificial Sequence
  Synthetic Construct
ccttccccgcttctggatatgaaa

SEQ ID NO: 21 - DNA, 23 bp, Artificial Sequence
  Synthetic Construct
gtcagcgtttacggctattgagt

SEQ ID NO: 22 - DNA, 20 bp, Artificial Sequence
  Synthetic Construct
gcatctccagtgccctctgt

SEQ ID NO: 23 - DNA, 24 bp, Artificial Sequence
  Synthetic Construct
catcttcctagacatgcacacaac

SEQ ID NO: 24 - DNA, 21 bp, Artificial Sequence
  Synthetic Construct
gtcccaagtcaactgccatct

SEQ ID NO: 25 - DNA, 20 bp, Artificial Sequence
  Synthetic Construct
gcgtcagcacagctaacaca

SEQ ID NO: 26 - DNA, 23 bp, Artificial Sequence
  Synthetic Construct
tcacaatgggagggaacattcaa

SEQ ID NO: 27 - DNA, 27 bp, Artificial Sequence
  Synthetic Construct
ggtaaaggctggttgtaaagtccacat

SEQ ID NO: 28 - DNA, 24 bp, Artificial Sequence
  Synthetic Construct
ccgactcaatggggaactcctact

SEQ ID NO: 29 - DNA, 22 bp, Artificial Sequence
  Synthetic Construct
tccttacaccttggggcgtcta

SEQ ID NO: 30 - DNA, 26 bp, Artificial Sequence
  Synthetic Construct
gggcatttctaagacacttggacagt

SEQ ID NO: 31 - DNA, 25 bp, Artificial Sequence
  Synthetic Construct
cactgtatctcaaagggcaaaacaa

SEQ ID NO: 32 - DNA, 23 bp, Artificial Sequence
  Synthetic Construct
acttgtctctgcagacagtttca

SEQ ID NO: 33 - DNA, 20 bp, Artificial Sequence
  Synthetic Construct
ggcctcttggtgcctctgtt

SEQ ID NO: 34 - DNA, 29 bp, Artificial Sequence
  Synthetic Construct
gctagagaaacaagacaacatccaagttc

SEQ ID NO: 35 - DNA, 22 bp, Artificial Sequence
  Synthetic Construct
gcgggcatagagagaaggaaat

SEQ ID NO: 36 - DNA, 23 bp, Artificial Sequence
  Synthetic Construct
ggcttcagtccttcacctctttc

SEQ ID NO: 37 - DNA, 20 bp, Artificial Sequence
  Synthetic Construct
tcagagtcctaggccagcat

SEQ ID NO: 38 - DNA, 24 bp, Artificial Sequence
  Synthetic Construct
ggttcctcatggaagactggtttg

SEQ ID NO: 39 - DNA, 26 bp, Artificial Sequence
  Synthetic Construct
gttgagaagggagtaagatcagacaa

SEQ ID NO: 40 - DNA, 23 bp, Artificial Sequence
  Synthetic Construct
ctcccgcctctaaatgaatggat

SEQ ID NO: 41 - DNA, 23 bp, Artificial Sequence
  Synthetic Construct
cattccctcccctaccctggaaa

SEQ ID NO: 42 - DNA, 22 bp, Artificial Sequence
  Synthetic Construct
gagactcaatcctggcacttgt

SEQ ID NO: 43 - DNA, 22 bp, Artificial Sequence
  Synthetic Construct
cccggctgccatttaagaccat

SEQ ID NO: 44 - DNA, 23 bp, Artificial Sequence
  Synthetic Construct
gatgagggctgagtatggtcaag

SEQ ID NO: 45 - DNA, 22 bp, Artificial Sequence
  Synthetic Construct
ccctttcctgaaccccttcatt

SEQ ID NO: 46 - DNA, 22 bp, Artificial Sequence
  Synthetic Construct
ggggcaccaaagaaaagacaag

SEQ ID NO: 47 - DNA, 26 bp, Artificial Sequence
  Synthetic Construct
catcagtaccccacataggtttaact

SEQ ID NO: 48 - DNA, 26 bp, Artificial Sequence
  Synthetic Construct
ggagctcagtatgagtagaggggaaa

SEQ ID NO: 49 - DNA, 20 bp, Artificial Sequence
  Synthetic Construct
ttgtgcacgacgctggaatg

SEQ ID NO: 50 - DNA, 22 bp, Artificial Sequence
  Synthetic Construct
tcgctaggccattcctcctgtt

SEQ ID NO: 51 - DNA, 26 bp, Artificial Sequence
  Synthetic Construct
cacgacacccttagataatgttggat

SEQ ID NO: 52 - DNA, 19 bp, Artificial Sequence
  Synthetic Construct
tggcacaagcccaggtcat

SEQ ID NO: 53 - DNA, 24 bp, Artificial Sequence
  Synthetic Construct
gcctcctctgcatctctgaaccaa

SEQ ID NO: 54 - DNA, 20 bp, Artificial Sequence
  Synthetic Construct
tgcagcgatcccttcacctt

SEQ ID NO: 55 - DNA, 22 bp, Artificial Sequence
  Synthetic Construct
tggtagtcaggcctagtgactt

SEQ ID NO: 56 - DNA, 24 bp, Artificial Sequence
  Synthetic Construct
gaggtcttccaaaggctattcaga

SEQ ID NO: 57 - DNA, 23 bp, Artificial Sequence
  Synthetic Construct
cctgagcctgtcacactatttct

SEQ ID NO: 58 - DNA, 20 bp, Artificial Sequence
  Synthetic Construct
gagagcaacaggcgttgaga

SEQ ID NO: 59 - DNA, 23 bp, Artificial Sequence
  Synthetic Construct
agccctacaaggtcaagttttca

SEQ ID NO: 60 - DNA, 21 bp, Artificial Sequence
  Synthetic Construct
ggaggcacttcactcctccta

SEQ ID NO: 61 - DNA, 23 bp, Artificial Sequence
  Synthetic Construct
gttggggtcaactttccctgaag

SEQ ID NO: 62 - DNA, 22 bp, Artificial Sequence
  Synthetic Construct
gaggtttggctccatcatcaga

SEQ ID NO: 63 - DNA, 25 bp, Artificial Sequence
  Synthetic Construct
gaggctcatgtctcttcagccttag

SEQ ID NO: 64 - DNA, 22 bp, Artificial Sequence
  Synthetic Construct
gttgcttcccgttatcctcact

SEQ ID NO: 65 - DNA, 24 bp, Artificial Sequence
  Synthetic Construct
gggcctgttcttgttgatagtgtt

SEQ ID NO: 66 - DNA, 26 bp, Artificial Sequence
  Synthetic Construct
gtttgctgttactgaatcccgaatct

SEQ ID NO: 67 - DNA, 26 bp, Artificial Sequence
  Synthetic Construct
gcacatgtaaaaatcctccctactgt

SEQ ID NO: 68 - DNA, 25 bp, Artificial Sequence
  Synthetic Construct
cctctggtaatagcacccaggatac

SEQ ID NO: 69 - DNA, 25 bp, Artificial Sequence
  Synthetic Construct
ctgaggtccagaatccagatgttct

SEQ ID NO: 70 - DNA, 21 bp, Artificial Sequence
  Synthetic Construct
ggacaacaggatcggggatga

SEQ ID NO: 71 - DNA, 22 bp, Artificial Sequence
  Synthetic Construct
ccatgtgtaggaagccctgtga

SEQ ID NO: 72 - DNA, 22 bp, Artificial Sequence
  Synthetic Construct
gcgacctcacttttccagtcat

SEQ ID NO: 73 - DNA, 25 bp, Artificial Sequence
  Synthetic Construct
gtgctattgtggctctgtaggttga

SEQ ID NO: 74 - DNA, 21 bp, Artificial Sequence
  Synthetic Construct
gtttcagcctgagaggcaaga

SEQ ID NO: 75 - DNA, 23 bp, Artificial Sequence
  Synthetic Construct
gagatgaagcgtgtgacccaagt

SEQ ID NO: 76 - DNA, 22 bp, Artificial Sequence
  Synthetic Construct
tgcctcatctctgcccctcttt

SEQ ID NO: 77 - DNA, 22 bp, Artificial Sequence
  Synthetic Construct
tctcagtgcgtttggaaggaaa

SEQ ID NO: 78 - DNA, 22 bp, Artificial Sequence
  Synthetic Construct
aggtttccctggacacacattc

SEQ ID NO: 79 - DNA, 23 bp, Artificial Sequence
  Synthetic Construct
aggagacagggacagtttcaatg

SEQ ID NO: 80 - DNA, 22 bp, Artificial Sequence
  Synthetic Construct
tgggttggaaacacgtccttta

SEQ ID NO: 81 - DNA, 20 bp, Artificial Sequence
  Synthetic Construct
gcccttagcaacagctgcat

SEQ ID NO: 82 - DNA, 21 bp, Artificial Sequence
  Synthetic Construct
gcagacacgcctctggcaaat

SEQ ID NO: 83 - DNA, 21 bp, Artificial Sequence
  Synthetic Construct
gccaaaagtgacagcaacaca

SEQ ID NO: 84 - DNA, 26 bp, Artificial Sequence
  Synthetic Construct
gcacacatccaatccttcagtaaatc

SEQ ID NO: 85 - DNA, 22 bp, Artificial Sequence
  Synthetic Construct
tcctcatccaagctccttctct

SEQ ID NO: 86 - DNA, 24 bp, Artificial Sequence
  Synthetic Construct
ggcactttccacccagaacttaac

SEQ ID NO: 87 - DNA, 20 bp, Artificial Sequence
  Synthetic Construct
aagcccacgttgtgctcttg

SEQ ID NO: 88 - DNA, 26 bp, Artificial Sequence
  Synthetic Construct
ctcagtagggtgaaaaggatggaagt

SEQ ID NO: 89 - DNA, 24 bp, Artificial Sequence
  Synthetic Construct
gctggatctacagaaaccagcaaa

SEQ ID NO: 90 - DNA, 19 bp, Artificial Sequence
  Synthetic Construct
tggctgcagatgcttgtca

SEQ ID NO: 91 - DNA, 22 bp, Artificial Sequence
  Synthetic Construct
gcctctcagcctcacgttctta

SEQ ID NO: 92 - DNA, 20 bp, Artificial Sequence
  Synthetic Construct
tccttgactcacgcctctga

SEQ ID NO: 93 - DNA, 22 bp, Artificial Sequence
  Synthetic Construct
ggaggacatggtgtttgaggat

SEQ ID NO: 94 - DNA, 24 bp, Artificial Sequence
  Synthetic Construct
ctacagttagagtcacacgtcaca

SEQ ID NO: 95 - DNA, 20 bp, Artificial Sequence
  Synthetic Construct
catgcggagggacttagcaa

SEQ ID NO: 96 - DNA, 23 bp, Artificial Sequence
  Synthetic Construct
gctttccagagtagaggcgtttc

SEQ ID NO: 97 - DNA, 24 bp, Artificial Sequence
  Synthetic Construct
tgatggtgcagaattgctacgata

SEQ ID NO: 98 - DNA, 21 bp, Artificial Sequence
  Synthetic Construct
gctgaaatggacccacagaga

SEQ ID NO: 99 - DNA, 20 bp, Artificial Sequence
  Synthetic Construct
tgctccaacgatggctcttc

SEQ ID NO: 100 - DNA, 23 bp, Artificial Sequence
  Synthetic Construct
aggtgaaagcgatgtctgcttag

SEQ ID NO: 101 - DNA, 21 bp, Artificial Sequence
  Synthetic Construct
gccctgacctcaccattggaa

SEQ ID NO: 102 - DNA, 19 bp, Artificial Sequence
  Synthetic Construct
tggggcaattgcgggtatt

SEQ ID NO: 103 - DNA, 25 bp, Artificial Sequence
  Synthetic Construct
gcattacaggagagtgaagatggat

SEQ ID NO: 104 - DNA, 23 bp, Artificial Sequence
  Synthetic Construct
ggaggagaaaggtggtacacttg

SEQ ID NO: 105 - DNA, 24 bp, Artificial Sequence
  Synthetic Construct
ggagacaatacaggttgggtggtt

SEQ ID NO: 106 - DNA, 24 bp, Artificial Sequence
  Synthetic Construct
gcggatcttccttacctagtctga

SEQ ID NO: 107 - DNA, 25 bp, Artificial Sequence
  Synthetic Construct
ggatactgtgtaggaaggcaataca

SEQ ID NO: 108 - DNA, 22 bp, Artificial Sequence
  Synthetic Construct
caactccaaccccagccttttg

SEQ ID NO: 109 - DNA, 24 bp, Artificial Sequence
  Synthetic Construct
caggccaagaatgacatacgactt

SEQ ID NO: 110 - DNA, 22 bp, Artificial Sequence
  Synthetic Construct
ggcgaaaatgagcactgtggaa

SEQ ID NO: 111 - DNA, 23 bp, Artificial Sequence
  Synthetic Construct
ggaaggcagtacaagagcttact

SEQ ID NO: 112 - DNA, 25 bp, Artificial Sequence
  Synthetic Construct
ggcgattcctgacatttgattgcat

SEQ ID NO: 113 - DNA, 21 bp, Artificial Sequence
  Synthetic Construct
ggggtttgtttgggtcagaga

SEQ ID NO: 114 - DNA, 25 bp, Artificial Sequence
  Synthetic Construct
ctgcaatattggccatttctcttca

SEQ ID NO: 115 - DNA, 20 bp, Artificial Sequence
  Synthetic Construct
agtgtgcacgcctggttgaa

SEQ ID NO: 116 - DNA, 22 bp, Artificial Sequence
  Synthetic Construct
ccccagctccttcacaaagact

SEQ ID NO: 117 - DNA, 22 bp, Artificial Sequence
  Synthetic Construct
tggagctgaggaggaaagaaca

SEQ ID NO: 118 - DNA, 27 bp, Artificial Sequence
  Synthetic Construct
tgggtcataaagtgactctgtaacatc

SEQ ID NO: 119 - DNA, 24 bp, Artificial Sequence
  Synthetic Construct
gctgtgaatgttacatggcaggat

SEQ ID NO: 120 - DNA, 22 bp, Artificial Sequence
  Synthetic Construct
cgtcccttaccggagcaacttt

SEQ ID NO: 121 - DNA, 24 bp, Artificial Sequence
  Synthetic Construct
agtgagctagaggctaggacttac

SEQ ID NO: 122 - DNA, 22 bp, Artificial Sequence
  Synthetic Construct
tcctttcctctcatcgcctttg

SEQ ID NO: 123 - DNA, 22 bp, Artificial Sequence
  Synthetic Construct
gggcacagaagggtgttccaaa

SEQ ID NO: 124 - DNA, 21 bp, Artificial Sequence
  Synthetic Construct
ggccctcattgcagtcagcat

SEQ ID NO: 125 - DNA, 24 bp, Artificial Sequence
  Synthetic Construct
tcctgagatgggaaagagtgaaga

SEQ ID NO: 126 - DNA, 25 bp, Artificial Sequence
  Synthetic Construct
gaaactgcacaaacttcctctccta

SEQ ID NO: 127 - DNA, 22 bp, Artificial Sequence
  Synthetic Construct
cgcctgtggttgttgatgaaag

SEQ ID NO: 128 - DNA, 22 bp, Artificial Sequence
  Synthetic Construct
tccccaagagcacagactcaac

SEQ ID NO: 129 - DNA, 22 bp, Artificial Sequence
  Synthetic Construct
cctcttcgcagaccttgaggat

SEQ ID NO: 130 - DNA, 24 bp, Artificial Sequence
  Synthetic Construct
tccacactctaccatttgctgaat

SEQ ID NO: 131 - DNA, 25 bp, Artificial Sequence
  Synthetic Construct
tgaattgtgcagtgaggctatatct

SEQ ID NO: 132 - DNA, 26 bp, Artificial Sequence
  Synthetic Construct
tgtgagtaggatctaggcatgttagt

SEQ ID NO: 133 - DNA, 24 bp, Artificial Sequence
  Synthetic Construct
ggtcacacagagttaatggagaca

SEQ ID NO: 134 - DNA, 21 bp, Artificial Sequence
  Synthetic Construct
ggacccaagaggctgagaaag

SEQ ID NO: 135 - DNA, 22 bp, Artificial Sequence
  Synthetic Construct
ctcgtgggtgtgatggaacaga

SEQ ID NO: 136 - DNA, 20 bp, Artificial Sequence
  Synthetic Construct
tgttgagcgtggaccagtga

SEQ ID NO: 137 - DNA, 21 bp, Artificial Sequence
  Synthetic Construct
ggctgaggctgtagccttgat

SEQ ID NO: 138 - DNA, 24 bp, Artificial Sequence
  Synthetic Construct
gatgggctcaagtcagaggttaag

SEQ ID NO: 139 - DNA, 22 bp, Artificial Sequence
  Synthetic Construct
gacagctgcttctcggctacaa

SEQ ID NO: 140 - DNA, 19 bp, Artificial Sequence
  Synthetic Construct
atcgcacgtactgccatgt

SEQ ID NO: 141 - DNA, 23 bp, Artificial Sequence
  Synthetic Construct
ccagaccatgcatccatccacat

SEQ ID NO: 142 - DNA, 25 bp, Artificial Sequence
  Synthetic Construct
gcaaagaaccatcagggtagacatc

SEQ ID NO: 143 - DNA, 22 bp, Artificial Sequence
  Synthetic Construct
aagggaggccttccactgtcat

SEQ ID NO: 144 - DNA, 22 bp, Artificial Sequence
  Synthetic Construct
aagaggccattgccatagttca

SEQ ID NO: 145 - DNA, 19 bp, Artificial Sequence
  Synthetic Construct
tggggttcaaccggacagt

SEQ ID NO: 146 - DNA, 21 bp, Artificial Sequence
  Synthetic Construct
cgtgccttaagcccaggtatt

SEQ ID NO: 147 - DNA, 22 bp, Artificial Sequence
  Synthetic Construct
ggtctcaggaatccacctccaa

SEQ ID NO: 148 - DNA, 23 bp, Artificial Sequence
  Synthetic Construct
acacagggaacgctctgtaaatg

SEQ ID NO: 149 - DNA, 24 bp, Artificial Sequence
  Synthetic Construct
cctgtccctctttggttgaaggtt

SEQ ID NO: 150 - DNA, 28 bp, Artificial Sequence
  Synthetic Construct
caggcattatctacatgtctgcttgtct

SEQ ID NO: 151 - DNA, 22 bp, Artificial Sequence
  Synthetic Construct
cgtccaagcctcagctgtgtaa

SEQ ID NO: 152 - DNA, 24 bp, Artificial Sequence
  Synthetic Construct
ctagccaaaagccattctggtagt

SEQ ID NO: 153 - DNA, 24 bp, Artificial Sequence
  Synthetic Construct
tgttatctgccttctcccaacaaa

SEQ ID NO: 154 - DNA, 26 bp, Artificial Sequence
  Synthetic Construct
cctcactgccaaatctgatacagaca

SEQ ID NO: 155 - DNA, 29 bp, Artificial Sequence
  Synthetic Construct
cgagaattacacccatctgatcctctttc

SEQ ID NO: 156 - DNA, 22 bp, Artificial Sequence
  Synthetic Construct
ggcaagggctaagacgtttgaa

SEQ ID NO: 157 - DNA, 26 bp, Artificial Sequence
  Synthetic Construct
tcctaactcctacctcatacctcaac

SEQ ID NO: 158 - DNA, 21 bp, Artificial Sequence
  Synthetic Construct
ccgggactagggtggaagtca

SEQ ID NO: 159 - DNA, 22 bp, Artificial Sequence
  Synthetic Construct
tgctacacactagctcctcaca

SEQ ID NO: 160 - DNA, 22 bp, Artificial Sequence
  Synthetic Construct
gcacagacatccagaactgctt

SEQ ID NO: 161 - DNA, 22 bp, Artificial Sequence
  Synthetic Construct
gtgtgcccacagagacttggaa

SEQ ID NO: 162 - DNA, 24 bp, Artificial Sequence
  Synthetic Construct
aagccgcctaataatggaaaccta

SEQ ID NO: 163 - DNA, 24 bp, Artificial Sequence
  Synthetic Construct
atgttctgtagtcgttaggcttgt

SEQ ID NO: 164 - DNA, 23 bp, Artificial Sequence
  Synthetic Construct
tgaaagaggcaggaaaaggttgt

SEQ ID NO: 165 - DNA, 22 bp, Artificial Sequence
  Synthetic Construct
agccagataccgtgagccaaga

SEQ ID NO: 166 - DNA, 27 bp, Artificial Sequence
  Synthetic Construct
cagaagtgggattcaaatccacagaga

SEQ ID NO: 167 - DNA, 22 bp, Artificial Sequence
  Synthetic Construct
ggcccaaagtgctttgagaaca

SEQ ID NO: 168 - DNA, 23 bp, Artificial Sequence
  Synthetic Construct
gtcacggaagaactggtggatca

SEQ ID NO: 169 - DNA, 22 bp, Artificial Sequence
  Synthetic Construct
gcttaataggcgccaaccattt

SEQ ID NO: 170 - DNA, 24 bp, Artificial Sequence
  Synthetic Construct
cagcttccctgtggaattgtcttc

SEQ ID NO: 171 - DNA, 21 bp, Artificial Sequence
  Synthetic Construct
tgaaggctcaccagccagaga

SEQ ID NO: 172 - DNA, 22 bp, Artificial Sequence
  Synthetic Construct
gctgcctcctagagccactaca

SEQ ID NO: 173 - DNA, 20 bp, Artificial Sequence
  Synthetic Construct
tttacgggcctcccaagtca

SEQ ID NO: 174 - DNA, 25 bp, Artificial Sequence
  Synthetic Construct
cgtcagccgataatagctgttgctt

SEQ ID NO: 175 - DNA, 23 bp, Artificial Sequence
  Synthetic Construct
tcttccctaccctgagcctgatg

SEQ ID NO: 176 - DNA, 23 bp, Artificial Sequence
  Synthetic Construct
gccatgtttcacctgctgcttac

SEQ ID NO: 177 - DNA, 23 bp, Artificial Sequence
  Synthetic Construct
cagggctttgtgacctagacaga

SEQ ID NO: 178 - DNA, 19 bp, Artificial Sequence
  Synthetic Construct
tcttgcgcgacaggagaga

SEQ ID NO: 179 - DNA, 22 bp, Artificial Sequence
  Synthetic Construct
ccttccctccttcgtgtcttct

SEQ ID NO: 180 - DNA, 24 bp, Artificial Sequence
  Synthetic Construct
gcacttgaggtaggattggaggaa

SEQ ID NO: 181 - DNA, 21 bp, Artificial Sequence
  Synthetic Construct
gttgtcttggttgccgtgttc

SEQ ID NO: 182 - DNA, 21 bp, Artificial Sequence
  Synthetic Construct
tgcttctgtctggctgagaag

SEQ ID NO: 183 - DNA, 24 bp, Artificial Sequence
  Synthetic Construct
ctccttcgtgtatatgagcagctt

SEQ ID NO: 184 - DNA, 25 bp, Artificial Sequence
  Synthetic Construct
gcccttttccttaaaagcaggaaga

SEQ ID NO: 185 - DNA, 22 bp, Artificial Sequence
  Synthetic Construct
gcgcaggaagagcagtttgatg

SEQ ID NO: 186 - DNA, 23 bp, Artificial Sequence
  Synthetic Construct
ggttccccagattggctcaaaag

SEQ ID NO: 187 - DNA, 19 bp, Artificial Sequence
  Synthetic Construct
atccgccagccgcccaata

SEQ ID NO: 188 - DNA, 25 bp, Artificial Sequence
  Synthetic Construct
ccaagtctcaggtgtgaggagttac

SEQ ID NO: 189 - DNA, 24 bp, Artificial Sequence
  Synthetic Construct
cacactgggttttctggtttcagt

SEQ ID NO: 190 - DNA, 22 bp, Artificial Sequence
  Synthetic Construct
cagggcaactcaacggcaaaag

SEQ ID NO: 191 - DNA, 22 bp, Artificial Sequence
  Synthetic Construct
agctggtcactgtgggagaaga

SEQ ID NO: 192 - DNA, 20 bp, Artificial Sequence
  Synthetic Construct
aggctcagctctggggattg

SEQ ID NO: 193 - DNA, 22 bp, Artificial Sequence
  Synthetic Construct
ggctggctccatcgtttgagat

SEQ ID NO: 194 - DNA, 25 bp, Artificial Sequence
  Synthetic Construct
cagggaagctttgacagaagagata

SEQ ID NO: 195 - DNA, 25 bp, Artificial Sequence
  Synthetic Construct
aggatacaggttggaaagcaagatt

SEQ ID NO: 196 - DNA, 24 bp, Artificial Sequence
  Synthetic Construct
gtgcggctgtcatcaacattcaac

SEQ ID NO: 197 - DNA, 22 bp, Artificial Sequence
  Synthetic Construct
ggaacgggagtcaggtcaaaca

SEQ ID NO: 198 - DNA, 22 bp, Artificial Sequence
  Synthetic Construct
tccctctgtcagtctgggtcta

SEQ ID NO: 199 - DNA, 18 bp, Artificial Sequence
  Synthetic Construct
acgcgcagtccacaaaca

SEQ ID NO: 200 - DNA, 22 bp, Artificial Sequence
  Synthetic Construct
tgcatattgtccaaggctgctt

SEQ ID NO: 201 - DNA, 20 bp, Artificial Sequence
  Synthetic Construct
gccctctgcatctagccaat

SEQ ID NO: 202 - DNA, 22 bp, Artificial Sequence
  Synthetic Construct
tggtccatccaaatcaggcaat

SEQ ID NO: 203 - DNA, 27 bp, Artificial Sequence
  Synthetic Construct
gccgctcctctttctgttccttaaaaa

SEQ ID NO: 204 - DNA, 23 bp, Artificial Sequence
  Synthetic Construct
gcaaaccaggcttttcttgcata

SEQ ID NO: 205 - DNA, 23 bp, Artificial Sequence
  Synthetic Construct
ccatctggctatgtgacggatgt

SEQ ID NO: 206 - DNA, 26 bp, Artificial Sequence
  Synthetic Construct
cagtaaaggaagctttgcaggtttgt

SEQ ID NO: 207 - DNA, 23 bp, Artificial Sequence
  Synthetic Construct
ttaaatactcccatgcccggaaa

SEQ ID NO: 208 - DNA, 23 bp, Artificial Sequence
  Synthetic Construct
ggttgtggagacaaggcttccta

SEQ ID NO: 209 - DNA, 23 bp, Artificial Sequence
  Synthetic Construct
gctgtctctccctaggtcaggtt

SEQ ID NO: 210 - DNA, 24 bp, Artificial Sequence
  Synthetic Construct
atgtgttcctgagagtccctttac

SEQ ID NO: 211 - DNA, 22 bp, Artificial Sequence
  Synthetic Construct
gggacatagcacaggactggat

SEQ ID NO: 212 - DNA, 26 bp, Artificial Sequence
  Synthetic Construct
cagctctacaaattgttgccatcttc

SEQ ID NO: 213 - DNA, 21 bp, Artificial Sequence
  Synthetic Construct
ggctctggaagttgccagtca

SEQ ID NO: 214 - DNA, 24 bp, Artificial Sequence
  Synthetic Construct
ccaagatttggaagagctgaggat

SEQ ID NO: 215 - DNA, 22 bp, Artificial Sequence
  Synthetic Construct
ggctgaagctgtaatccacaca

SEQ ID NO: 216 - DNA, 22 bp, Artificial Sequence
  Synthetic Construct
caaccaggatcgccctagaaaa

SEQ ID NO: 217 - DNA, 22 bp, Artificial Sequence
  Synthetic Construct
aacccagctacggagaggatga

SEQ ID NO: 218 - DNA, 25 bp, Artificial Sequence
  Synthetic Construct
acccagcttaatggttccaaatagt

SEQ ID NO: 219 - DNA, 23 bp, Artificial Sequence
  Synthetic Construct
tgctctgctttcttccagtttca

SEQ ID NO: 220 - DNA, 25 bp, Artificial Sequence
  Synthetic Construct
ccttccaaaagggagggatgttttc

SEQ ID NO: 221 - DNA, 25 bp, Artificial Sequence
  Synthetic Construct
gcattgaaacacctggtttacttca

SEQ ID NO: 222 - DNA, 23 bp, Artificial Sequence
  Synthetic Construct
tgcttgacagctctgttgattgt

SEQ ID NO: 223 - DNA, 25 bp, Artificial Sequence
  Synthetic Construct
gccagctagaaccctatacccagaa

SEQ ID NO: 224 - DNA, 24 bp, Artificial Sequence
  Synthetic Construct
gtgaaatgtcttgcccttgtcatc

SEQ ID NO: 225 - DNA, 20 bp, Artificial Sequence
  Synthetic Construct
caccagctacccaagctcaa

SEQ ID NO: 226 - DNA, 22 bp, Artificial Sequence
  Synthetic Construct
gatgactggaccgcatgtctct

SEQ ID NO: 227 - DNA, 22 bp, Artificial Sequence
  Synthetic Construct
ctcgttcctgctgtgcttgtag

SEQ ID NO: 228 - DNA, 22 bp, Artificial Sequence
  Synthetic Construct
tgcctttggtccctcacacaag

SEQ ID NO: 229 - DNA, 22 bp, Artificial Sequence
  Synthetic Construct
gagaaccacggagagaggaagt

SEQ ID NO: 230 - DNA, 26 bp, Artificial Sequence
  Synthetic Construct
cccacagttagtacatggcagagttt

SEQ ID NO: 231 - DNA, 22 bp, Artificial Sequence
  Synthetic Construct
cctgggagccatgtctgaaact

SEQ ID NO: 232 - DNA, 22 bp, Artificial Sequence
  Synthetic Construct
gggcaccttcacattgctgaga

SEQ ID NO: 233 - DNA, 24 bp, Artificial Sequence
  Synthetic Construct
ggaccctggtctttagttccgatt

SEQ ID NO: 234 - DNA, 22 bp, Artificial Sequence
  Synthetic Construct
agcaccaagggctgaaggaaag

SEQ ID NO: 235 - DNA, 23 bp, Artificial Sequence
  Synthetic Construct
gcaacacagatccactgaagaca

SEQ ID NO: 236 - DNA, 24 bp, Artificial Sequence
  Synthetic Construct
ggctctccataaccagatgctgta

SEQ ID NO: 237 - DNA, 20 bp, Artificial Sequence
  Synthetic Construct
ttccactggcccactgtact

SEQ ID NO: 238 - DNA, 21 bp, Artificial Sequence
  Synthetic Construct
gcccatcagtctcccctgcta

SEQ ID NO: 239 - DNA, 19 bp, Artificial Sequence
  Synthetic Construct
ccagtcatccggggcactt

SEQ ID NO: 240 - DNA, 25 bp, Artificial Sequence
  Synthetic Construct
gtggaatccaatcactcagccttca

SEQ ID NO: 241 - DNA, 24 bp, Artificial Sequence
  Synthetic Construct
cgcccactgctatctctaccattc

SEQ ID NO: 242 - DNA, 21 bp, Artificial Sequence
  Synthetic Construct
agtgcctggccatctgctgta

SEQ ID NO: 243 - DNA, 23 bp, Artificial Sequence
  Synthetic Construct
gtgttcatccatcagggccaatg

SEQ ID NO: 244 - DNA, 21 bp, Artificial Sequence
  Synthetic Construct
gctaaccttggcactgtggat

SEQ ID NO: 245 - DNA, 22 bp, Artificial Sequence
  Synthetic Construct
gctgtcatccatggtccagaca

SEQ ID NO: 246 - DNA, 23 bp, Artificial Sequence
  Synthetic Construct
ccatggaagagggagatggaagt

SEQ ID NO: 247 - DNA, 19 bp, Artificial Sequence
  Synthetic Construct
ccacctcttgggccctttg

SEQ ID NO: 248 - DNA, 27 bp, Artificial Sequence
  Synthetic Construct
cacagaatatgggctgagaatccaaga

SEQ ID NO: 249 - DNA, 20 bp, Artificial Sequence
  Synthetic Construct
gagtccccaccagcaagaag

SEQ ID NO: 250 - DNA, 22 bp, Artificial Sequence
  Synthetic Construct
gtgatgtggctactgcttcact

SEQ ID NO: 251 - DNA, 20 bp, Artificial Sequence
  Synthetic Construct
gcttccctcttccagtgctt

SEQ ID NO: 252 - DNA, 23 bp, Artificial Sequence
  Synthetic Construct
ctgcactgtgattctggcatagt

SEQ ID NO: 253 - DNA, 22 bp, Artificial Sequence
  Synthetic Construct
cccctccactaacggtgcatta

SEQ ID NO: 254 - DNA, 26 bp, Artificial Sequence
  Synthetic Construct
cagggatgaaagacagagagcatttg

SEQ ID NO: 255 - DNA, 22 bp, Artificial Sequence
  Synthetic Construct
cccctcgaggctgttttagtga

SEQ ID NO: 256 - DNA, 20 bp, Artificial Sequence
  Synthetic Construct
ccagtgtcagggccgagtag

SEQ ID NO: 257 - DNA, 20 bp, Artificial Sequence
  Synthetic Construct
tgctgctttacgcccagtga

SEQ ID NO: 258 - DNA, 20 bp, Artificial Sequence
  Synthetic Construct
gaccaatggggtgtcagctt

SEQ ID NO: 259 - DNA, 21 bp, Artificial Sequence
  Synthetic Construct
aggctatgggaggtgggaaca

SEQ ID NO: 260 - DNA, 25 bp, Artificial Sequence
  Synthetic Construct
ctgtgtatgtgggtctgaagctcaa

SEQ ID NO: 261 - DNA, 20 bp, Artificial Sequence
  Synthetic Construct
ggggctcagatcccttggtt

SEQ ID NO: 262 - DNA, 22 bp, Artificial Sequence
  Synthetic Construct
agcatccgtggaggcttttaat

SEQ ID NO: 263 - DNA, 24 bp, Artificial Sequence
  Synthetic Construct
acgatttctgaagcagtcttggta

SEQ ID NO: 264 - DNA, 21 bp, Artificial Sequence
  Synthetic Construct
gggcattagctggccttcaca

SEQ ID NO: 265 - DNA, 21 bp, Artificial Sequence
  Synthetic Construct
tcccacttacaggcccgttct

SEQ ID NO: 266 - DNA, 23 bp, Artificial Sequence
  Synthetic Construct
tttcagaagtgctggaaccaaga

SEQ ID NO: 267 - DNA, 22 bp, Artificial Sequence
  Synthetic Construct
catgaaagcactggggttctct

SEQ ID NO: 268 - DNA, 25 bp, Artificial Sequence
  Synthetic Construct
cgagagaggaagacactggagtgaa

SEQ ID NO: 269 - DNA, 27 bp, Artificial Sequence
  Synthetic Construct
ccttcctccacactaagtgactggaaa

SEQ ID NO: 270 - DNA, 19 bp, Artificial Sequence
  Synthetic Construct
cagcccatcctgggcatct

SEQ ID NO: 271 - DNA, 20 bp, Artificial Sequence
  Synthetic Construct
aggctggcaaatgggctcaa

SEQ ID NO: 272 - DNA, 18 bp, Artificial Sequence
  Synthetic Construct
gctgagcccagcagtgtt

SEQ ID NO: 273 - DNA, 24 bp, Artificial Sequence
  Synthetic Construct
cctggctgggctacatcttacctt

SEQ ID NO: 274 - DNA, 22 bp, Artificial Sequence
  Synthetic Construct
gcatggggacctgagactttct

SEQ ID NO: 275 - DNA, 21 bp, Artificial Sequence
  Synthetic Construct
gggccgatgagcaagtcagtt

SEQ ID NO: 276 - DNA, 24 bp, Artificial Sequence
  Synthetic Construct
cctccccgaaaggaaacagagcat

SEQ ID NO: 277 - DNA, 22 bp, Artificial Sequence
  Synthetic Construct
tggatggtgagaagagccaatg

SEQ ID NO: 278 - DNA, 20 bp, Artificial Sequence
  Synthetic Construct
gcctggtcaccatccgcttt

SEQ ID NO: 279 - DNA, 22 bp, Artificial Sequence
  Synthetic Construct
gacactcacaggctcagagaac

SEQ ID NO: 280 - DNA, 20 bp, Artificial Sequence
  Synthetic Construct
tgagcactcctgggtcaaga

SEQ ID NO: 281 - DNA, 21 bp, Artificial Sequence
  Synthetic Construct
cttggctcgattggtccaaca

SEQ ID NO: 282 - DNA, 20 bp, Artificial Sequence
  Synthetic Construct
ccagagcagccaggtcttca

SEQ ID NO: 283 - DNA, 20 bp, Artificial Sequence
  Synthetic Construct
tctcctcgcccaagatcaga

SEQ ID NO: 284 - DNA, 24 bp, Artificial Sequence
  Synthetic Construct
cctcagcccaggactcacttttag

SEQ ID NO: 285 - DNA, 19 bp, Artificial Sequence
  Synthetic Construct
tccatgacgggcagctgta

SEQ ID NO: 286 - DNA, 22 bp, Artificial Sequence
  Synthetic Construct
caccctgggatcaagtccaagt

SEQ ID NO: 287 - DNA, 20 bp, Artificial Sequence
  Synthetic Construct
tgcatgctgggacacagaga

SEQ ID NO: 288 - DNA, 20 bp, Artificial Sequence
  Synthetic Construct
aggggctgctggggcttgta

SEQ ID NO: 289 - DNA, 22 bp, Artificial Sequence
  Synthetic Construct
gcgctgcctagtgacattggtt

SEQ ID NO: 290 - DNA, 22 bp, Artificial Sequence
  Synthetic Construct
tggtggtggtccccagtaatgt

SEQ ID NO: 291 - DNA, 21 bp, Artificial Sequence
  Synthetic Construct
ccctggtgggttttgagtgaa

SEQ ID NO: 292 - DNA, 21 bp, Artificial Sequence
  Synthetic Construct
cccacttagagccccaggaaa

SEQ ID NO: 293 - DNA, 20 bp, Artificial Sequence
  Synthetic Construct
cgatcggctttgcaggcttt

SEQ ID NO: 294 - DNA, 22 bp, Artificial Sequence
  Synthetic Construct
aaccagatcgtgtctccctagt

SEQ ID NO: 295 - DNA, 21 bp, Artificial Sequence
  Synthetic Construct
ccaacagcgtgaggcttctga

SEQ ID NO: 296 - DNA, 23 bp, Artificial Sequence
  Synthetic Construct
gcctggaacacactgtactctga

SEQ ID NO: 297 - DNA, 18 bp, Artificial Sequence
  Synthetic Construct
tcctgcccgtctgctcaa

SEQ ID NO: 298 - DNA, 24 bp, Artificial Sequence
  Synthetic Construct
tgaaaccagaagctttcacctcat

SEQ ID NO: 299 - DNA, 22 bp, Artificial Sequence
  Synthetic Construct
agtcagggtgtctcttccatga

SEQ ID NO: 300 - DNA, 24 bp, Artificial Sequence
  Synthetic Construct
gagcaaaagagctgttccagagaa

SEQ ID NO: 301 - DNA, 24 bp, Artificial Sequence
  Synthetic Construct
ccttctacacaggatgggatgagt

SEQ ID NO: 302 - DNA, 21 bp, Artificial Sequence
  Synthetic Construct
tgaagggttcccctccaaagt

SEQ ID NO: 303 - DNA, 23 bp, Artificial Sequence
  Synthetic Construct
gcctacatgtctatcccctgaag

SEQ ID NO: 304 - DNA, 21 bp, Artificial Sequence
  Synthetic Construct
gctggaaaccatggcggagtt

SEQ ID NO: 305 - DNA, 20 bp, Artificial Sequence
  Synthetic Construct
gggccagtacccaggaggaa

SEQ ID NO: 306 - DNA, 21 bp, Artificial Sequence
  Synthetic Construct
cacagggatgagcaccaccat

SEQ ID NO: 307 - DNA, 23 bp, Artificial Sequence
  Synthetic Construct
tggcagagttgtcaggatttcaa

SEQ ID NO: 308 - DNA, 20 bp, Artificial Sequence
  Synthetic Construct
aggcgagtgtcccaagacaa

SEQ ID NO: 309 - DNA, 24 bp, Artificial Sequence
  Synthetic Construct
gtgaaccagggacatctggacaag

SEQ ID NO: 310 - DNA, 21 bp, Artificial Sequence
  Synthetic Construct
tcaggcacaggccaggtatag

SEQ ID NO: 311 - DNA, 21 bp, Artificial Sequence
  Synthetic Construct
ccggacgcagacggaattact

SEQ ID NO: 312 - DNA, 20 bp, Artificial Sequence
  Synthetic Construct
ggcagtttggggagctgtgt

SEQ ID NO: 313 - DNA, 20 bp, Artificial Sequence
  Synthetic Construct
ctgacatttgcgggctgttg

SEQ ID NO: 314 - DNA, 22 bp, Artificial Sequence
  Synthetic Construct
cttcatgggacccaagcctatg

SEQ ID NO: 315 - DNA, 20 bp, Artificial Sequence
  Synthetic Construct
ctggctggacccttcctgat

SEQ ID NO: 316 - DNA, 18 bp, Artificial Sequence
  Synthetic Construct
ggcccttggctgtgtgaa

SEQ ID NO: 317 - DNA, 22 bp, Artificial Sequence
  Synthetic Construct
ttcctcgtggaccctactgtgt

SEQ ID NO: 318 - DNA, 22 bp, Artificial Sequence
  Synthetic Construct
cgttggctcctaaagtcagcta

SEQ ID NO: 319 - DNA, 22 bp, Artificial Sequence
  Synthetic Construct
gtgtaagggcggctctaactga

SEQ ID NO: 320 - DNA, 20 bp, Artificial Sequence
  Synthetic Construct
atcagaggagggcggaccaa

SEQ ID NO: 321 - DNA, 23 bp, Artificial Sequence
  Synthetic Construct
ggagaccatgggaacccttcaac

SEQ ID NO: 322 - DNA, 22 bp, Artificial Sequence
  Synthetic Construct
ggtcctgtcgttgaggtagtca

SEQ ID NO: 323 - DNA, 20 bp, Artificial Sequence
  Synthetic Construct
gggctagcaaacacccaagt

SEQ ID NO: 324 - DNA, 22 bp, Artificial Sequence
  Synthetic Construct
gccaaatgaacctggccctgta

SEQ ID NO: 325 - DNA, 21 bp, Artificial Sequence
  Synthetic Construct
gccacaaaggcccactacaga

SEQ ID NO: 326 - DNA, 22 bp, Artificial Sequence
  Synthetic Construct
gtcttccaggtcagcaatccaa

SEQ ID NO: 327 - DNA, 23 bp, Artificial Sequence
  Synthetic Construct
catgcccagcaattgtcccttag

SEQ ID NO: 328 - DNA, 22 bp, Artificial Sequence
  Synthetic Construct
gcagtcttggcagagctttact

SEQ ID NO: 329 - DNA, 22 bp, Artificial Sequence
  Synthetic Construct
gaagagtcagtggccttgaaga

SEQ ID NO: 330 - DNA, 25 bp, Artificial Sequence
  Synthetic Construct
gtggtgtatgttgtagtcccagcta

SEQ ID NO: 331 - DNA, 24 bp, Artificial Sequence
  Synthetic Construct
gtggggtagtggtaaagtaagcat

SEQ ID NO: 332 - DNA, 22 bp, Artificial Sequence
  Synthetic Construct
gggtccctgctccatctcattt

SEQ ID NO: 333 - DNA, 20 bp, Artificial Sequence
  Synthetic Construct
agggccctcccgcaattaga

SEQ ID NO: 334 - DNA, 22 bp, Artificial Sequence
  Synthetic Construct
cctgaggtcttggcccacaata

SEQ ID NO: 335 - DNA, 20 bp, Artificial Sequence
  Synthetic Construct
ttcagcgggaaccaccatgt

SEQ ID NO: 336 - DNA, 29 bp, Artificial Sequence
  Synthetic Construct
ctgacttcctagtcttcccttctatgaaa

SEQ ID NO: 337 - DNA, 23 bp, Artificial Sequence
  Synthetic Construct
ggtttacaggttagggcatggat

SEQ ID NO: 338 - DNA, 22 bp, Artificial Sequence
  Synthetic Construct
aggaccggaggactgctctatt

SEQ ID NO: 339 - DNA, 22 bp, Artificial Sequence
  Synthetic Construct
aagggcagcgtatccctctaca

SEQ ID NO: 340 - DNA, 23 bp, Artificial Sequence
  Synthetic Construct
gtggcccagtttttgctcagaga

SEQ ID NO: 341 - DNA, 26 bp, Artificial Sequence
  Synthetic Construct
ggtgcaggatttttctcgacctcttt

SEQ ID NO: 342 - DNA, 22 bp, Artificial Sequence
  Synthetic Construct
tctctgtgtctcctcaccagtt

SEQ ID NO: 343 - DNA, 22 bp, Artificial Sequence
  Synthetic Construct
ccaactggtccctgcattcttg

SEQ ID NO: 344 - DNA, 23 bp, Artificial Sequence
  Synthetic Construct
gtgtgaggatcctgcagcattta

SEQ ID NO: 345 - DNA, 21 bp, Artificial Sequence
  Synthetic Construct
agtccctcagctcagcccata

SEQ ID NO: 346 - DNA, 23 bp, Artificial Sequence
  Synthetic Construct
gccaaggggtaaccctaaaggta

SEQ ID NO: 347 - DNA, 20 bp, Artificial Sequence
  Synthetic Construct
ggttggaaggtgacgctaca

SEQ ID NO: 348 - DNA, 19 bp, Artificial Sequence
  Synthetic Construct
cctgcacttgcccggttct

SEQ ID NO: 349 - DNA, 23 bp, Artificial Sequence
  Synthetic Construct
gctccaagaagtgcatccaggtt

SEQ ID NO: 350 - DNA, 21 bp, Artificial Sequence
  Synthetic Construct
gtgctgggtcacactcaaact

SEQ ID NO: 351 - DNA, 21 bp, Artificial Sequence
  Synthetic Construct
tgtcgtccccactgtggaact

SEQ ID NO: 352 - DNA, 21 bp, Artificial Sequence
  Synthetic Construct
ccccaggcaactcacttcaca

SEQ ID NO: 353 - DNA, 20 bp, Artificial Sequence
  Synthetic Construct
agagtagacgcgccctggaa

SEQ ID NO: 354 - DNA, 21 bp, Artificial Sequence
  Synthetic Construct
gctagcaggacttgggcaaca

SEQ ID NO: 355 - DNA, 23 bp, Artificial Sequence
  Synthetic Construct
ctgaaccagctcggacagagaag

SEQ ID NO: 356 - DNA, 22 bp, Artificial Sequence
  Synthetic Construct
caccacgttgatgcagagtttc

SEQ ID NO: 357 - DNA, 23 bp, Artificial Sequence
  Synthetic Construct
ccaagtgcagaagctggaaaaca

SEQ ID NO: 358 - DNA, 24 bp, Artificial Sequence
  Synthetic Construct
gaccaggccctttgattgttctgt

SEQ ID NO: 359 - DNA, 22 bp, Artificial Sequence
  Synthetic Construct
taagtccccgtgctcacagcat

SEQ ID NO: 360 - DNA, 25 bp, Artificial Sequence
  Synthetic Construct
gctccatcctgtgaatgaagtaagt

SEQ ID NO: 361 - DNA, 24 bp, Artificial Sequence
  Synthetic Construct
gggatccatcaccgttccaaacat

SEQ ID NO: 362 - DNA, 19 bp, Artificial Sequence
  Synthetic Construct
ggagagtccagggcgtctt

SEQ ID NO: 363 - DNA, 22 bp, Artificial Sequence
  Synthetic Construct
cttcacagtgcctgggacattt

SEQ ID NO: 364 - DNA, 23 bp, Artificial Sequence
  Synthetic Construct
tccaggatggggaaggacctaag

SEQ ID NO: 365 - DNA, 24 bp, Artificial Sequence
  Synthetic Construct
ctaagctcaaagtcaagggacaga

SEQ ID NO: 366 - DNA, 25 bp, Artificial Sequence
  Synthetic Construct
gagaagaaagtcgccctgaaaatac

SEQ ID NO: 367 - DNA, 20 bp, Artificial Sequence
  Synthetic Construct
gtgctttcccacagcgaatc

SEQ ID NO: 368 - DNA, 20 bp, Artificial Sequence
  Synthetic Construct
ggtgctgcagagggtggaaa

SEQ ID NO: 369 - DNA, 20 bp, Artificial Sequence
  Synthetic Construct
aactaccctcccacccaaca

SEQ ID NO: 370 - DNA, 28 bp, Artificial Sequence
  Synthetic Construct
gttgggtggacagtctttttcatctttg

SEQ ID NO: 371 - DNA, 23 bp, Artificial Sequence
  Synthetic Construct
gtgctctcccttgaaatgaggat

SEQ ID NO: 372 - DNA, 21 bp, Artificial Sequence
  Synthetic Construct
gatggtggaaaccgaccaact

SEQ ID NO: 373 - DNA, 18 bp, Artificial Sequence
  Synthetic Construct
tgcagggtggcagcatga

SEQ ID NO: 374 - DNA, 24 bp, Artificial Sequence
  Synthetic Construct
gccctctgacttcactgacctact

SEQ ID NO: 375 - DNA, 21 bp, Artificial Sequence
  Synthetic Construct
tggggttgaggtccccttatg

SEQ ID NO: 376 - DNA, 22 bp, Artificial Sequence
  Synthetic Construct
ccccttcatctgccctggtagt

SEQ ID NO: 377 - DNA, 22 bp, Artificial Sequence
  Synthetic Construct
cctctgcaccttggcctacatt

SEQ ID NO: 378 - DNA, 21 bp, Artificial Sequence
  Synthetic Construct
ggcggaaaccaaaccctcaga

SEQ ID NO: 379 - DNA, 20 bp, Artificial Sequence
  Synthetic Construct
gggcccctcccacatacaca

SEQ ID NO: 380 - DNA, 22 bp, Artificial Sequence
  Synthetic Construct
gcccatgctgaggactaacctt

SEQ ID NO: 381 - DNA, 21 bp, Artificial Sequence
  Synthetic Construct
ccctaaggttgggtcgagttg

SEQ ID NO: 382 - DNA, 21 bp, Artificial Sequence
  Synthetic Construct
cagggtcccaacgggtttcta

SEQ ID NO: 383 - DNA, 21 bp, Artificial Sequence
  Synthetic Construct
gccccagcattcacactgcat

SEQ ID NO: 384 - DNA, 21 bp, Artificial Sequence
  Synthetic Construct
gcaagtagctgggccttgtca

SEQ ID NO: 385 - DNA, 22 bp, Artificial Sequence
  Synthetic Construct
gcaccatcaggagatgcagact

SEQ ID NO: 386 - DNA, 25 bp, Artificial Sequence
  Synthetic Construct
ctctgtcagtttctgagtgggatga

SEQ ID NO: 387 - DNA, 21 bp, Artificial Sequence
  Synthetic Construct
gaggcctcactctccccttat

SEQ ID NO: 388 - DNA, 23 bp, Artificial Sequence
  Synthetic Construct
tcatgctgcttgggtaatgttct

SEQ ID NO: 389 - DNA, 19 bp, Artificial Sequence
  Synthetic Construct
ctgggccatcctcctgtct

SEQ ID NO: 390 - DNA, 20 bp, Artificial Sequence
  Synthetic Construct
tggagagtggggaggagctt

SEQ ID NO: 391 - DNA, 21 bp, Artificial Sequence
  Synthetic Construct
ggagcatgccgccttgttact

SEQ ID NO: 392 - DNA, 24 bp, Artificial Sequence
  Synthetic Construct
gtctcttccctgaagtagggttgt

SEQ ID NO: 393 - DNA, 24 bp, Artificial Sequence
  Synthetic Construct
tcactcacatcatcatggttggat

SEQ ID NO: 394 - DNA, 20 bp, Artificial Sequence
  Synthetic Construct
ggagcagcattgccttcgtt

SEQ ID NO: 395 - DNA, 20 bp, Artificial Sequence
  Synthetic Construct
gcctcgcatcacgcagtttt

SEQ ID NO: 396 - DNA, 26 bp, Artificial Sequence
  Synthetic Construct
cccgtttgaagaaatgatagctcgaa

SEQ ID NO: 397 - DNA, 20 bp, Artificial Sequence
  Synthetic Construct
gggtgctgttctggctttga

SEQ ID NO: 398 - DNA, 21 bp, Artificial Sequence
  Synthetic Construct
ggctgtggttgttgacagagt

SEQ ID NO: 399 - DNA, 23 bp, Artificial Sequence
  Synthetic Construct
ccctgtggaacaaagtgggaact

SEQ ID NO: 400 - DNA, 22 bp, Artificial Sequence
  Synthetic Construct
gcaaaggcttgtctgacagtga

SEQ ID NO: 401 - DNA, 24 bp, Artificial Sequence
  Synthetic Construct
caagaggaccttcggaaactttga

SEQ ID NO: 402 - DNA, 20 bp, Artificial Sequence
  Synthetic Construct
aggcacacgcaggtctcatc

SEQ ID NO: 403 - DNA, 25 bp, Artificial Sequence
  Synthetic Construct
gtgtagaggggcaactcctatcttg

SEQ ID NO: 404 - DNA, 27 bp, Artificial Sequence
  Synthetic Construct
cagactacaaaggtgtttgctgtttgt

SEQ ID NO: 405 - DNA, 20 bp, Artificial Sequence
  Synthetic Construct
ctgcgttgtgcctactctgt

SEQ ID NO: 406 - DNA, 20 bp, Artificial Sequence
  Synthetic Construct
ggtgtccccgcacttagcat

SEQ ID NO: 407 - DNA, 23 bp, Artificial Sequence
  Synthetic Construct
gtgaagccagacagcagtaatca

SEQ ID NO: 408 - DNA, 23 bp, Artificial Sequence
  Synthetic Construct
ggagggtgaacaaggcaaagatg

SEQ ID NO: 409 - DNA, 22 bp, Artificial Sequence
  Synthetic Construct
acctgcaggagctagttagaga

SEQ ID NO: 410 - DNA, 21 bp, Artificial Sequence
  Synthetic Construct
gctttcagtccccacttgtga

SEQ ID NO: 411 - DNA, 22 bp, Artificial Sequence
  Synthetic Construct
gtgaggcaggaaggatgagttt

SEQ ID NO: 412 - DNA, 24 bp, Artificial Sequence
  Synthetic Construct
gagctttggagacagtggggtaac

SEQ ID NO: 413 - DNA, 22 bp, Artificial Sequence
  Synthetic Construct
ccagcatcaggtcacaatgaac

SEQ ID NO: 414 - DNA, 20 bp, Artificial Sequence
  Synthetic Construct
actgagggcggcattgctta

SEQ ID NO: 415 - DNA, 20 bp, Artificial Sequence
  Synthetic Construct
gcggcaaggagggtttctaa

SEQ ID NO: 416 - DNA, 25 bp, Artificial Sequence
  Synthetic Construct
tcagagttctgtcctaatggaggaa

SEQ ID NO: 417 - DNA, 26 bp, Artificial Sequence
  Synthetic Construct
cactagtctggaaaaaccagcaccaa

SEQ ID NO: 418 - DNA, 24 bp, Artificial Sequence
  Synthetic Construct
aatcctggaacactcttgcctaaa

SEQ ID NO: 419 - DNA, 26 bp, Artificial Sequence
  Synthetic Construct
gtgtgagctagttccttctgctcttc

SEQ ID NO: 420 - DNA, 22 bp, Artificial Sequence
  Synthetic Construct
caactgcagcgtgctgatttta

SEQ ID NO: 421 - DNA, 21 bp, Artificial Sequence
  Synthetic Construct
aatcggccacagccccagaga

SEQ ID NO: 422 - DNA, 24 bp, Artificial Sequence
  Synthetic Construct
ggatcttctgaacaccacatcctt

SEQ ID NO: 423 - DNA, 22 bp, Artificial Sequence
  Synthetic Construct
atccagttccctgggtgactct

SEQ ID NO: 424 - DNA, 25 bp, Artificial Sequence
  Synthetic Construct
gttttctccaccaacacacctttct

SEQ ID NO: 425 - DNA, 21 bp, Artificial Sequence
  Synthetic Construct
aaggggactcggaggacaaga

SEQ ID NO: 426 - DNA, 22 bp, Artificial Sequence
  Synthetic Construct
gggccaatgtgtcctggtttgt

SEQ ID NO: 427 - DNA, 21 bp, Artificial Sequence
  Synthetic Construct
tgccatggcctttgcctatac

SEQ ID NO: 428 - DNA, 24 bp, Artificial Sequence
  Synthetic Construct
gctctcagggaaatcatccatttg

SEQ ID NO: 429 - DNA, 24 bp, Artificial Sequence
  Synthetic Construct
cctgggatttaccatgtcccataa

SEQ ID NO: 430 - DNA, 21 bp, Artificial Sequence
  Synthetic Construct
cgtgctccactttcctgacaa

SEQ ID NO: 431 - DNA, 22 bp, Artificial Sequence
  Synthetic Construct
cagggatgagccgctgtttcta

SEQ ID NO: 432 - DNA, 21 bp, Artificial Sequence
  Synthetic Construct
agatcttcggggctccagaca

SEQ ID NO: 433 - DNA, 27 bp, Artificial Sequence
  Synthetic Construct
gcatagtccacagtaggaaaaatgcaa

SEQ ID NO: 434 - DNA, 21 bp, Artificial Sequence
  Synthetic Construct
ggcagctgcaacagtatgtct

SEQ ID NO: 435 - DNA, 24 bp, Artificial Sequence
  Synthetic Construct
ggtctgtctgattccagctgatac

SEQ ID NO: 436 - DNA, 27 bp, Artificial Sequence
  Synthetic Construct
ctcagtgggcttagaataaacctgaat

SEQ ID NO: 437 - DNA, 20 bp, Artificial Sequence
  Synthetic Construct
ggaggtttggctgggtcttt

SEQ ID NO: 438 - DNA, 20 bp, Artificial Sequence
  Synthetic Construct
aggcgggtccccaggaaaca

SEQ ID NO: 439 - DNA, 21 bp, Artificial Sequence
  Synthetic Construct
acaaggggcctgactcagctt

SEQ ID NO: 440 - DNA, 21 bp, Artificial Sequence
  Synthetic Construct
cctggtgtgctctgccttgaa

SEQ ID NO: 441 - DNA, 22 bp, Artificial Sequence
  Synthetic Construct
cctcggtggacacttggtcttg

SEQ ID NO: 442 - DNA, 27 bp, Artificial Sequence
  Synthetic Construct
ggagataggaaaagtcatggagggtaa

SEQ ID NO: 443 - DNA, 20 bp, Artificial Sequence
  Synthetic Construct
agtctcatggcaggctgctt

SEQ ID NO: 444 - DNA, 22 bp, Artificial Sequence
  Synthetic Construct
agaacccctgcaccctctttct

SEQ ID NO: 445 - DNA, 26 bp, Artificial Sequence
  Synthetic Construct
ggccttaattgacaccgctaatcttg

SEQ ID NO: 446 - DNA, 22 bp, Artificial Sequence
  Synthetic Construct
ggagaggctaaggggaaacaga

SEQ ID NO: 447 - DNA, 20 bp, Artificial Sequence
  Synthetic Construct
atggtggtggctgtgcgatt

SEQ ID NO: 448 - DNA, 22 bp, Artificial Sequence
  Synthetic Construct
ttgggtcatagggccgagaatg

SEQ ID NO: 449 - DNA, 20 bp, Artificial Sequence
  Synthetic Construct
acacgaaagcggcgtcagaa

SEQ ID NO: 450 - DNA, 22 bp, Artificial Sequence
  Synthetic Construct
tgggcttctgggttctagatgt

SEQ ID NO: 451 - DNA, 25 bp, Artificial Sequence
  Synthetic Construct
ggaaaccatcccatgtctactgtgt

SEQ ID NO: 452 - DNA, 22 bp, Artificial Sequence
  Synthetic Construct
tcccacttactacgctccaaga

SEQ ID NO: 453 - DNA, 21 bp, Artificial Sequence
  Synthetic Construct
tcctgccctagctgtggcttt

SEQ ID NO: 454 - DNA, 20 bp, Artificial Sequence
  Synthetic Construct
ccgcaaatagccccagaact

SEQ ID NO: 455 - DNA, 20 bp, Artificial Sequence
  Synthetic Construct
tttggttagcggggctctct

SEQ ID NO: 456 - DNA, 25 bp, Artificial Sequence
  Synthetic Construct
ccaggataagaatgttggcctcctt

SEQ ID NO: 457 - DNA, 23 bp, Artificial Sequence
  Synthetic Construct
ctgttgcccgtgggattaaaatg

SEQ ID NO: 458 - DNA, 22 bp, Artificial Sequence
  Synthetic Construct
tgtgctacctggagagggtttc

SEQ ID NO: 459 - DNA, 22 bp, Artificial Sequence
  Synthetic Construct
cccttctgcagcatgtgcattt

SEQ ID NO: 460 - DNA, 25 bp, Artificial Sequence
  Synthetic Construct
gctaggaatgggaacattggcatct

SEQ ID NO: 461 - DNA, 24 bp, Artificial Sequence
  Synthetic Construct
gtctttacaagcaggccccatttg

SEQ ID NO: 462 - DNA, 21 bp, Artificial Sequence
  Synthetic Construct
agaccacctgcctaagaccaa

SEQ ID NO: 463 - DNA, 19 bp, Artificial Sequence
  Synthetic Construct
accccatccccaccagctt

SEQ ID NO: 464 - DNA, 22 bp, Artificial Sequence
  Synthetic Construct
gattggctcctgtgctctgagt

SEQ ID NO: 465 - DNA, 22 bp, Artificial Sequence
  Synthetic Construct
cctgcagggaaaacctgcaact

SEQ ID NO: 466 - DNA, 23 bp, Artificial Sequence
  Synthetic Construct
ctttacagcattgcctcctccta

SEQ ID NO: 467 - DNA, 21 bp, Artificial Sequence
  Synthetic Construct
ggccactagtctgggacaaag

SEQ ID NO: 468 - DNA, 26 bp, Artificial Sequence
  Synthetic Construct
gtaatgtcagtgcgtctaggtaaaga

SEQ ID NO: 469 - DNA, 20 bp, Artificial Sequence
  Synthetic Construct
ggagagggaatgctgcgaat

SEQ ID NO: 470 - DNA, 19 bp, Artificial Sequence
  Synthetic Construct
ggaggcacagcaggtctga

SEQ ID NO: 471 - DNA, 23 bp, Artificial Sequence
  Synthetic Construct
ggacaccaacgatgacacaaaat

SEQ ID NO: 472 - DNA, 19 bp, Artificial Sequence
  Synthetic Construct
agggagccggcatcctttg

SEQ ID NO: 473 - DNA, 21 bp, Artificial Sequence
  Synthetic Construct
tgccaagaggcttctcagttc

SEQ ID NO: 474 - DNA, 22 bp, Artificial Sequence
  Synthetic Construct
cctgggcagtaagctagcaatg

SEQ ID NO: 475 - DNA, 20 bp, Artificial Sequence
  Synthetic Construct
tcacccctcacctgcactct

SEQ ID NO: 476 - DNA, 23 bp, Artificial Sequence
  Synthetic Construct
gctgagaatccagagactgtgtt

SEQ ID NO: 477 - DNA, 23 bp, Artificial Sequence
  Synthetic Construct
ccacaccatacaagggatctcaa

SEQ ID NO: 478 - DNA, 25 bp, Artificial Sequence
  Synthetic Construct
agtggatgagaactatcatggcaaa

SEQ ID NO: 479 - DNA, 21 bp, Artificial Sequence
  Synthetic Construct
cttgaggcagttccgacttca

SEQ ID NO: 480 - DNA, 22 bp, Artificial Sequence
  Synthetic Construct
gccaagaacacgtcaggtctca

SEQ ID NO: 481 - DNA, 25 bp, Artificial Sequence
  Synthetic Construct
tttccactctcccttatttctgcaa

SEQ ID NO: 482 - DNA, 24 bp, Artificial Sequence
  Synthetic Construct
ccacagatgcaaagagagcacttc

SEQ ID NO: 483 - DNA, 22 bp, Artificial Sequence
  Synthetic Construct
gggagtgtctgtggtccagaat

SEQ ID NO: 484 - DNA, 21 bp, Artificial Sequence
  Synthetic Construct
ccaaagctgtttgcggctaga

SEQ ID NO: 485 - DNA, 19 bp, Artificial Sequence
  Synthetic Construct
gctgcggaggccagaaagt

SEQ ID NO: 486 - DNA, 23 bp, Artificial Sequence
  Synthetic Construct
ttgtagacaatggggccactaag

SEQ ID NO: 487 - DNA, 23 bp, Artificial Sequence
  Synthetic Construct
tgtgccagtgtgtaccttcattt

SEQ ID NO: 488 - DNA, 26 bp, Artificial Sequence
  Synthetic Construct
gggttcaggccagtagaatgacctat

SEQ ID NO: 489 - DNA, 26 bp, Artificial Sequence
  Synthetic Construct
ttgaggacaatagagaaggtctgttc

SEQ ID NO: 490 - DNA, 25 bp, Artificial Sequence
  Synthetic Construct
gctggatcctaagacaacactgtat

SEQ ID NO: 491 - DNA, 20 bp, Artificial Sequence
  Synthetic Construct
aggctggcatgttggagtca

SEQ ID NO: 492 - DNA, 21 bp, Artificial Sequence
  Synthetic Construct
tgtgagctgttcttgccatgt

SEQ ID NO: 493 - DNA, 22 bp, Artificial Sequence
  Synthetic Construct
gtgttacctggcgcctgaatgt

SEQ ID NO: 494 - DNA, 22 bp, Artificial Sequence
  Synthetic Construct
agctaagttttccaggcgatgt

SEQ ID NO: 495 - DNA, 24 bp, Artificial Sequence
  Synthetic Construct
gtgaaagagccatgataggtctga

SEQ ID NO: 496 - DNA, 19 bp, Artificial Sequence
  Synthetic Construct
gatgcccgcacctgctaga

SEQ ID NO: 497 - DNA, 20 bp, Artificial Sequence
  Synthetic Construct
tcgcccttgtggatccaagt

SEQ ID NO: 498 - DNA, 19 bp, Artificial Sequence
  Synthetic Construct
aggggacgtctcccaggtt

SEQ ID NO: 499 - DNA, 18 bp, Artificial Sequence
  Synthetic Construct
accctgcatcgggtctca

SEQ ID NO: 500 - DNA, 21 bp, Artificial Sequence
  Synthetic Construct
gtcctgttcccgcaaggttga

SEQ ID NO: 501 - DNA, 24 bp, Artificial Sequence
  Synthetic Construct
gtgttgttcctcttcccaaggaat

SEQ ID NO: 502 - DNA, 24 bp, Artificial Sequence
  Synthetic Construct
gtctcagagattccacagcctaca

SEQ ID NO: 503 - DNA, 23 bp, Artificial Sequence
  Synthetic Construct
acagatgccagatgcagaagaaa

SEQ ID NO: 504 - DNA, 24 bp, Artificial Sequence
  Synthetic Construct
ggctctgaggtcatctctgtatca

SEQ ID NO: 505 - DNA, 20 bp, Artificial Sequence
  Synthetic Construct
caagtccctcccagcaacaa

SEQ ID NO: 506 - DNA, 22 bp, Artificial Sequence
  Synthetic Construct
cgcctctgtcctctgtcacttt

SEQ ID NO: 507 - DNA, 20 bp, Artificial Sequence
  Synthetic Construct
ggataccaaccccgccagaa

SEQ ID NO: 508 - DNA, 25 bp, Artificial Sequence
  Synthetic Construct
ccatcatctggttatgctacagtct

SEQ ID NO: 509 - DNA, 24 bp, Artificial Sequence
  Synthetic Construct
cttgatgactccacttctccatca

SEQ ID NO: 510 - DNA, 22 bp, Artificial Sequence
  Synthetic Construct
gccaaggagtgaaccaggtttg

SEQ ID NO: 511 - DNA, 22 bp, Artificial Sequence
  Synthetic Construct
cgacctgtgttaggggttcagt

SEQ ID NO: 512 - DNA, 19 bp, Artificial Sequence
  Synthetic Construct
gtggcccagaaggctgctt

SEQ ID NO: 513 - DNA, 25 bp, Artificial Sequence
  Synthetic Construct
cacaggaggtcattaaggttcaaca

SEQ ID NO: 514 - DNA, 24 bp, Artificial Sequence
  Synthetic Construct
gcagacattgtatgtcggtgaaca

SEQ ID NO: 515 - DNA, 18 bp, Artificial Sequence
  Synthetic Construct
tgggttcgcacggctgtt

SEQ ID NO: 516 - DNA, 22 bp, Artificial Sequence
  Synthetic Construct
accaccacacctagctgcaaag

SEQ ID NO: 517 - DNA, 19 bp, Artificial Sequence
  Synthetic Construct
tgtccctggggccactgaa

SEQ ID NO: 518 - DNA, 22 bp, Artificial Sequence
  Synthetic Construct
gtggggtaacagccacaggtat

SEQ ID NO: 519 - DNA, 22 bp, Artificial Sequence
  Synthetic Construct
ctgccggagactatgctcagta

SEQ ID NO: 520 - DNA, 22 bp, Artificial Sequence
  Synthetic Construct
gtcacccaggccatgtgaactt

SEQ ID NO: 521 - DNA, 22 bp, Artificial Sequence
  Synthetic Construct
gggccatgtcattgctctgtag

SEQ ID NO: 522 - DNA, 23 bp, Artificial Sequence
  Synthetic Construct
ccccaagatgtctgccatagttc

SEQ ID NO: 523 - DNA, 29 bp, Artificial Sequence
  Synthetic Construct
gcagttggtaaaggcaaagcttaacgaaa

SEQ ID NO: 524 - DNA, 21 bp, Artificial Sequence
  Synthetic Construct
agactaggcagggtacacaca

SEQ ID NO: 525 - DNA, 27 bp, Artificial Sequence
  Synthetic Construct
gtgagcacaaatttggatcgagtgaga

SEQ ID NO: 526 - DNA, 23 bp, Artificial Sequence
  Synthetic Construct
gagtggctagctctcaagacaca

SEQ ID NO: 527 - DNA, 23 bp, Artificial Sequence
  Synthetic Construct
gtgtgggaaggaggattccatgt

SEQ ID NO: 528 - DNA, 22 bp, Artificial Sequence
  Synthetic Construct
atggtaggtcagacccagaagt

SEQ ID NO: 529 - DNA, 25 bp, Artificial Sequence
  Synthetic Construct
cgtccaggagacagttaacctcttg

SEQ ID NO: 530 - DNA, 23 bp, Artificial Sequence
  Synthetic Construct
ttccaagagcattcaggtgtctt

SEQ ID NO: 531 - DNA, 23 bp, Artificial Sequence
  Synthetic Construct
agcagctcaaactatgccaaaga

SEQ ID NO: 532 - DNA, 21 bp, Artificial Sequence
  Synthetic Construct
agtgccagagcccgctagaaa

SEQ ID NO: 533 - DNA, 22 bp, Artificial Sequence
  Synthetic Construct
acccctgtgcctaagctgaagt

SEQ ID NO: 534 - DNA, 20 bp, Artificial Sequence
  Synthetic Construct
ctgtgctggctgctgtttca

SEQ ID NO: 535 - DNA, 21 bp, Artificial Sequence
  Synthetic Construct
gatgggtgttgcaaggcaaag

SEQ ID NO: 536 - DNA, 25 bp, Artificial Sequence
  Synthetic Construct
ggcccatttaccctttctatcatgt

SEQ ID NO: 537 - DNA, 23 bp, Artificial Sequence
  Synthetic Construct
caagtggattgtgggtggacact

SEQ ID NO: 538 - DNA, 23 bp, Artificial Sequence
  Synthetic Construct
tgtgtgacattcctggtgctaaa

SEQ ID NO: 539 - DNA, 20 bp, Artificial Sequence
  Synthetic Construct
aggcaggcgatgagccaaat

SEQ ID NO: 540 - DNA, 24 bp, Artificial Sequence
  Synthetic Construct
gttccaatcacaggacaggggtat

SEQ ID NO: 541 - DNA, 21 bp, Artificial Sequence
  Synthetic Construct
ggagatgcaatcggcccataa

SEQ ID NO: 542 - DNA, 20 bp, Artificial Sequence
  Synthetic Construct
tgttggccaggggttaggtt

SEQ ID NO: 543 - DNA, 22 bp, Artificial Sequence
  Synthetic Construct
gtcatggggacctggattgcta

SEQ ID NO: 544 - DNA, 22 bp, Artificial Sequence
  Synthetic Construct
gccacatggacacctcacactt

SEQ ID NO: 545 - DNA, 28 bp, Artificial Sequence
  Synthetic Construct
ggttttcctatcggtgtttgaggtctac

SEQ ID NO: 546 - DNA, 24 bp, Artificial Sequence
  Synthetic Construct
cagggtgataagtccacagcattc

SEQ ID NO: 547 - DNA, 20 bp, Artificial Sequence
  Synthetic Construct
cagcacccagagagcagctt

SEQ ID NO: 548 - DNA, 19 bp, Artificial Sequence
  Synthetic Construct
gcgcaggcgcagcattatt

SEQ ID NO: 549 - DNA, 20 bp, Artificial Sequence
  Synthetic Construct
cacgacaccacacgcattca

SEQ ID NO: 550 - DNA, 22 bp, Artificial Sequence
  Synthetic Construct
tcccatcagcaccagtggaaac

SEQ ID NO: 551 - DNA, 26 bp, Artificial Sequence
  Synthetic Construct
gggagatcatacacagagaggaggtt

SEQ ID NO: 552 - DNA, 25 bp, Artificial Sequence
  Synthetic Construct
tcaggctaaagacattgctgtagaa

SEQ ID NO: 553 - DNA, 22 bp, Artificial Sequence
  Synthetic Construct
ccctgctcttccatgctgctaa

SEQ ID NO: 554 - DNA, 23 bp, Artificial Sequence
  Synthetic Construct
cctaggagggtaaaggcggagtt

SEQ ID NO: 555 - DNA, 20 bp, Artificial Sequence
  Synthetic Construct
ttgccagctctgccctgcta

SEQ ID NO: 556 - DNA, 22 bp, Artificial Sequence
  Synthetic Construct
gcaccaggagtgtgctgaagtt

SEQ ID NO: 557 - DNA, 26 bp, Artificial Sequence
  Synthetic Construct
gtctctgacaatacattcagccacta

SEQ ID NO: 558 - DNA, 20 bp, Artificial Sequence
  Synthetic Construct
aaggctcgcctgagggtgaa

SEQ ID NO: 559 - DNA, 24 bp, Artificial Sequence
  Synthetic Construct
cgtgattaagtacggctgcctgtt

SEQ ID NO: 560 - DNA, 24 bp, Artificial Sequence
  Synthetic Construct
gaccacagaaattggaaggagcta

SEQ ID NO: 561 - DNA, 20 bp, Artificial Sequence
  Synthetic Construct
ggcagcttcccttcgctctt

SEQ ID NO: 562 - DNA, 24 bp, Artificial Sequence
  Synthetic Construct
gcctgctgttgggtgaattactgt

SEQ ID NO: 563 - DNA, 20 bp, Artificial Sequence
  Synthetic Construct
gtgatgctgctacggaggaa

SEQ ID NO: 564 - DNA, 19 bp, Artificial Sequence
  Synthetic Construct
cccgcaatgcccagtgaca

SEQ ID NO: 565 - DNA, 22 bp, Artificial Sequence
  Synthetic Construct
aggggctgagtgctttttcttc

SEQ ID NO: 566 - DNA, 22 bp, Artificial Sequence
  Synthetic Construct
gcatcagagcagtgggcttaca

SEQ ID NO: 567 - DNA, 19 bp, Artificial Sequence
  Synthetic Construct
tggagggagggagctgttc

SEQ ID NO: 568 - DNA, 21 bp, Artificial Sequence
  Synthetic Construct
tgggagggccagagactcatt

SEQ ID NO: 569 - DNA, 23 bp, Artificial Sequence
  Synthetic Construct
gaagaaagccaggcctccaaaac

SEQ ID NO: 570 - DNA, 19 bp, Artificial Sequence
  Synthetic Construct
acagttggggcaagcacat

SEQ ID NO: 571 - DNA, 19 bp, Artificial Sequence
  Synthetic Construct
tgcaacgcgagggtgagtt

SEQ ID NO: 572 - DNA, 22 bp, Artificial Sequence
  Synthetic Construct
ggagagatgcgtccatcacaga

SEQ ID NO: 573 - DNA, 20 bp, Artificial Sequence
  Synthetic Construct
ggatggcttcaggcagttga

SEQ ID NO: 574 - DNA, 20 bp, Artificial Sequence
  Synthetic Construct
cacttctggggcacttgtgt

SEQ ID NO: 575 - DNA, 25 bp, Artificial Sequence
  Synthetic Construct
ctcttgcaaatcgaggaacgagaga

SEQ ID NO: 576 - DNA, 21 bp, Artificial Sequence
  Synthetic Construct
accttcagggccaccagtgtt

SEQ ID NO: 577 - DNA, 22 bp, Artificial Sequence
  Synthetic Construct
tgcactcactcagggcagaagt

SEQ ID NO: 578 - DNA, 21 bp, Artificial Sequence
  Synthetic Construct
gcagtgcgtgttcttgcatca

SEQ ID NO: 579 - DNA, 21 bp, Artificial Sequence
  Synthetic Construct
tcaggcagggctcagaactgt

SEQ ID NO: 580 - DNA, 20 bp, Artificial Sequence
  Synthetic Construct
tcctctgccttcagcactgt

SEQ ID NO: 581 - DNA, 22 bp, Artificial Sequence
  Synthetic Construct
ggagaagactgcggaacacaca

SEQ ID NO: 582 - DNA, 28 bp, Artificial Sequence
  Synthetic Construct
cacccctaagtttgagatctgttgattc

SEQ ID NO: 583 - DNA, 22 bp, Artificial Sequence
  Synthetic Construct
tgccccttccaatcctgtgtga

SEQ ID NO: 584 - DNA, 27 bp, Artificial Sequence
  Synthetic Construct
gccacaggggatgaataaaaagcagta

SEQ ID NO: 585 - DNA, 24 bp, Artificial Sequence
  Synthetic Construct
caaagatgggtcaagttcctctca

SEQ ID NO: 586 - DNA, 19 bp, Artificial Sequence
  Synthetic Construct
ggtgggcccagaacaaact

SEQ ID NO: 587 - DNA, 20 bp, Artificial Sequence
  Synthetic Construct
aaggctgccctggtcaaaca

SEQ ID NO: 588 - DNA, 23 bp, Artificial Sequence
  Synthetic Construct
gttttaggacagccagtcgagaa

SEQ ID NO: 589 - DNA, 25 bp, Artificial Sequence
  Synthetic Construct
acagttgaagtccaggcttatttga

SEQ ID NO: 590 - DNA, 23 bp, Artificial Sequence
  Synthetic Construct
cagtggacccagatggtgacttc

SEQ ID NO: 591 - DNA, 23 bp, Artificial Sequence
  Synthetic Construct
tgctttagggagcatggagtaca

SEQ ID NO: 592 - DNA, 23 bp, Artificial Sequence
  Synthetic Construct
cctcagtcttagcctgggctctt

SEQ ID NO: 593 - DNA, 20 bp, Artificial Sequence
  Synthetic Construct
acagacccaggacgctgaag

SEQ ID NO: 594 - DNA, 22 bp, Artificial Sequence
  Synthetic Construct
cgaggggctttgtaccagtgtt

SEQ ID NO: 595 - DNA, 21 bp, Artificial Sequence
  Synthetic Construct
ccatctggagcaggggagaag

SEQ ID NO: 596 - DNA, 26 bp, Artificial Sequence
  Synthetic Construct
ggttaccccattccatcttctctgta

SEQ ID NO: 597 - DNA, 19 bp, Artificial Sequence
  Synthetic Construct
gggagagagctggcgttca

SEQ ID NO: 598 - DNA, 22 bp, Artificial Sequence
  Synthetic Construct
cctgcatgtctctggtctcttg

SEQ ID NO: 599 - DNA, 24 bp, Artificial Sequence
  Synthetic Construct
ccgcacaacttactattgctgttg

SEQ ID NO: 600 - DNA, 26 bp, Artificial Sequence
  Synthetic Construct
aggagtgaatcaaaggatggaagtag

SEQ ID NO: 601 - DNA, 24 bp, Artificial Sequence
  Synthetic Construct
gtcttctgcaggggtgaaaacagt

SEQ ID NO: 602 - DNA, 20 bp, Artificial Sequence
  Synthetic Construct
aggccctgaagttgctggaa

SEQ ID NO: 603 - DNA, 26 bp, Artificial Sequence
  Synthetic Construct
gtgagtaagtcaacagtgatgaggaa

SEQ ID NO: 604 - DNA, 21 bp, Artificial Sequence
  Synthetic Construct
ccagcacagaaccgacacgtt

SEQ ID NO: 605 - DNA, 20 bp, Artificial Sequence
  Synthetic Construct
agctgccgcatcttgctttc

SEQ ID NO: 606 - DNA, 22 bp, Artificial Sequence
  Synthetic Construct
gatggtcccaaggagccaatgt

SEQ ID NO: 607 - DNA, 24 bp, Artificial Sequence
  Synthetic Construct
cgtgcagacctcacattactcttg

SEQ ID NO: 608 - DNA, 22 bp, Artificial Sequence
  Synthetic Construct
gcctgagtgtccatgaacttgt

SEQ ID NO: 609 - DNA, 24 bp, Artificial Sequence
  Synthetic Construct
tggatagctacatgcttgcttctt

SEQ ID NO: 610 - DNA, 22 bp, Artificial Sequence
  Synthetic Construct
cggagccactttactcccacaa

SEQ ID NO: 611 - DNA, 24 bp, Artificial Sequence
  Synthetic Construct
cttagcaaagagccttctgactgt

SEQ ID NO: 612 - DNA, 22 bp, Artificial Sequence
  Synthetic Construct
acaagggaaagctgagggttct

SEQ ID NO: 613 - DNA, 23 bp, Artificial Sequence
  Synthetic Construct
caaagcaccaatcctctgtgtga

SEQ ID NO: 614 - DNA, 24 bp, Artificial Sequence
  Synthetic Construct
gggcaaaagaatactctggtcagt

SEQ ID NO: 615 - DNA, 20 bp, Artificial Sequence
  Synthetic Construct
cacttcccaccctccctaca

SEQ ID NO: 616 - DNA, 21 bp, Artificial Sequence
  Synthetic Construct
gcactttgcgtggactgtttc

SEQ ID NO: 617 - DNA, 23 bp, Artificial Sequence
  Synthetic Construct
ctccgccacaaactgaaatctct

SEQ ID NO: 618 - DNA, 20 bp, Artificial Sequence
  Synthetic Construct
tgggcaagagtgtggagtca

SEQ ID NO: 619 - DNA, 26 bp, Artificial Sequence
  Synthetic Construct
ccgaaatcattgaacgagcaggctat

SEQ ID NO: 620 - DNA, 23 bp, Artificial Sequence
  Synthetic Construct
ccacctaagccctaggatcatct

SEQ ID NO: 621 - DNA, 20 bp, Artificial Sequence
  Synthetic Construct
cagcaggaaggggtgagttc

SEQ ID NO: 622 - DNA, 22 bp, Artificial Sequence
  Synthetic Construct
cgcctggagcctcaaattggtt

SEQ ID NO: 623 - DNA, 25 bp, Artificial Sequence
  Synthetic Construct
gtctggaaccaacagaattgtcact

SEQ ID NO: 624 - DNA, 22 bp, Artificial Sequence
  Synthetic Construct
caagaccctggacgctcaagaa

SEQ ID NO: 625 - DNA, 23 bp, Artificial Sequence
  Synthetic Construct
gtcagcaaaggaaggagtaccat

SEQ ID NO: 626 - DNA, 23 bp, Artificial Sequence
  Synthetic Construct
cagaagtcattgctgaggaggaa

SEQ ID NO: 627 - DNA, 24 bp, Artificial Sequence
  Synthetic Construct
ctggagaaagatgcagtcgaccat

SEQ ID NO: 628 - DNA, 25 bp, Artificial Sequence
  Synthetic Construct
agctctacttcacagaaaggagttg

SEQ ID NO: 629 - DNA, 19 bp, Artificial Sequence
  Synthetic Construct
cctgctcctgtggccctta

SEQ ID NO: 630 - DNA, 22 bp, Artificial Sequence
  Synthetic Construct
ccagccttgcttccccttcaat

SEQ ID NO: 631 - DNA, 22 bp, Artificial Sequence
  Synthetic Construct
ggggcagggaatacaggaattt

SEQ ID NO: 632 - DNA, 25 bp, Artificial Sequence
  Synthetic Construct
gaaatactcacaatgccctcagcat

SEQ ID NO: 633 - DNA, 24 bp, Artificial Sequence
  Synthetic Construct
gtgaggtgtggaaacgaaggtttg

SEQ ID NO: 634 - DNA, 21 bp, Artificial Sequence
  Synthetic Construct
ttgattgagcgggagcaaaga

SEQ ID NO: 635 - DNA, 27 bp, Artificial Sequence
  Synthetic Construct
caacccgaagaatctttgttcctcaag

SEQ ID NO: 636 - DNA, 25 bp, Artificial Sequence
  Synthetic Construct
ggcatgggaataaatgccaggtgaa

SEQ ID NO: 637 - DNA, 25 bp, Artificial Sequence
  Synthetic Construct
ggagacttggagggtaaaggcaact

SEQ ID NO: 638 - DNA, 26 bp, Artificial Sequence
  Synthetic Construct
gcagttttgaaggcctagttatgttc

SEQ ID NO: 639 - DNA, 22 bp, Artificial Sequence
  Synthetic Construct
gcaaggtctgagtggagaggat

SEQ ID NO: 640 - DNA, 23 bp, Artificial Sequence
  Synthetic Construct
attgcagctccaggctccgagat

SEQ ID NO: 641 - DNA, 22 bp, Artificial Sequence
  Synthetic Construct
cagccctctcctgttcagtgtt

SEQ ID NO: 642 - DNA, 22 bp, Artificial Sequence
  Synthetic Construct
cgagggtcgttggcacttcaat

SEQ ID NO: 643 - DNA, 22 bp, Artificial Sequence
  Synthetic Construct
tgggaaagagcgagatccaaaa

SEQ ID NO: 644 - DNA, 20 bp, Artificial Sequence
  Synthetic Construct
tctgcccagccgatggagta

SEQ ID NO: 645 - DNA, 23 bp, Artificial Sequence
  Synthetic Construct
gtcagtccctctgttctctgtca

SEQ ID NO: 646 - DNA, 24 bp, Artificial Sequence
  Synthetic Construct
tgacacaagaatcaggttggttga

SEQ ID NO: 647 - DNA, 23 bp, Artificial Sequence
  Synthetic Construct
tttattggctaccccaggtccta

SEQ ID NO: 648 - DNA, 24 bp, Artificial Sequence
  Synthetic Construct
gatgtcttccctgaacagtcagaa

SEQ ID NO: 649 - DNA, 21 bp, Artificial Sequence
  Synthetic Construct
gctgggctggttagggaaaca

SEQ ID NO: 650 - DNA, 24 bp, Artificial Sequence
  Synthetic Construct
caacactgtgctgtatgggaaaat

SEQ ID NO: 651 - DNA, 21 bp, Artificial Sequence
  Synthetic Construct
caacccaggaagacacaccaa

SEQ ID NO: 652 - DNA, 24 bp, Artificial Sequence
  Synthetic Construct
agaaggtagttcacctgaccgtta

SEQ ID NO: 653 - DNA, 24 bp, Artificial Sequence
  Synthetic Construct
gggctggcacatatgtagtagaag

SEQ ID NO: 654 - DNA, 22 bp, Artificial Sequence
  Synthetic Construct
ggcgacaacattgccaggatct

SEQ ID NO: 655 - DNA, 25 bp, Artificial Sequence
  Synthetic Construct
ctcagctcaggtatttgtgctgtta

SEQ ID NO: 656 - DNA, 24 bp, Artificial Sequence
  Synthetic Construct
gctgcactgcatacatacatggaa

SEQ ID NO: 657 - DNA, 22 bp, Artificial Sequence
  Synthetic Construct
ggcaaagtgatggtggcagctt

SEQ ID NO: 658 - DNA, 23 bp, Artificial Sequence
  Synthetic Construct
ggaaatctgagcatgtggagtga

SEQ ID NO: 659 - DNA, 24 bp, Artificial Sequence
  Synthetic Construct
cgatacccaggtaccatgttgaga

SEQ ID NO: 660 - DNA, 22 bp, Artificial Sequence
  Synthetic Construct
ggaaggccatttggcaagaatc

SEQ ID NO: 661 - DNA, 24 bp, Artificial Sequence
  Synthetic Construct
cttggtctgtccccaggttgttag

SEQ ID NO: 662 - DNA, 25 bp, Artificial Sequence
  Synthetic Construct
tcgagagaaagatggggtagaaagt

SEQ ID NO: 663 - DNA, 24 bp, Artificial Sequence
  Synthetic Construct
ccctgcctaacccaacatctgtgt

SEQ ID NO: 664 - DNA, 21 bp, Artificial Sequence
  Synthetic Construct
gtggaaaaggcgtcagactgt

SEQ ID NO: 665 - DNA, 21 bp, Artificial Sequence
  Synthetic Construct
cctgcgagttcctggagcaat

SEQ ID NO: 666 - DNA, 20 bp, Artificial Sequence
  Synthetic Construct
ggactaggtggttggtgcaa

SEQ ID NO: 667 - DNA, 23 bp, Artificial Sequence
  Synthetic Construct
agggcttttcatgtgagtgttgt

SEQ ID NO: 668 - DNA, 22 bp, Artificial Sequence
  Synthetic Construct
agcatctggctcccaagtgcta

SEQ ID NO: 669 - DNA, 24 bp, Artificial Sequence
  Synthetic Construct
ggcaagagacgaagtggaagcatt

SEQ ID NO: 670 - DNA, 27 bp, Artificial Sequence
  Synthetic Construct
gcaagctgggtgaagttatcttgtttc

SEQ ID NO: 671 - DNA, 21 bp, Artificial Sequence
  Synthetic Construct
gccagttgagggaagccatct

SEQ ID NO: 672 - DNA, 20 bp, Artificial Sequence
  Synthetic Construct
gcctccttagtgggcaggtt

SEQ ID NO: 673 - DNA, 26 bp, Artificial Sequence
  Synthetic Construct
cggaaacaaaacaactcttcccagat

SEQ ID NO: 674 - DNA, 19 bp, Artificial Sequence
  Synthetic Construct
tgagccttgctggctgtca

SEQ ID NO: 675 - DNA, 22 bp, Artificial Sequence
  Synthetic Construct
tgggaggcatagtccctgtgat

SEQ ID NO: 676 - DNA, 22 bp, Artificial Sequence
  Synthetic Construct
ttctgtggggcacttgtacttt

SEQ ID NO: 677 - DNA, 26 bp, Artificial Sequence
  Synthetic Construct
caaaggaggttcaaagaccagtttgt

SEQ ID NO: 678 - DNA, 26 bp, Artificial Sequence
  Synthetic Construct
ccttagtcctactttttcccttgcat

SEQ ID NO: 679 - DNA, 21 bp, Artificial Sequence
  Synthetic Construct
gaccttgcaagaacggagtca

SEQ ID NO: 680 - DNA, 23 bp, Artificial Sequence
  Synthetic Construct
gactgccatctggcattgagaac

SEQ ID NO: 681 - DNA, 19 bp, Artificial Sequence
  Synthetic Construct
agccgctcctgctttttga

SEQ ID NO: 682 - DNA, 25 bp, Artificial Sequence
  Synthetic Construct
gccaaaagtgcagagttatttcagt

SEQ ID NO: 683 - DNA, 19 bp, Artificial Sequence
  Synthetic Construct
tattggccgccagcactgt

SEQ ID NO: 684 - DNA, 22 bp, Artificial Sequence
  Synthetic Construct
gagcgcctagtcagtactttgt

SEQ ID NO: 685 - DNA, 21 bp, Artificial Sequence
  Synthetic Construct
gaagccaagttggtggaggat

SEQ ID NO: 686 - DNA, 24 bp, Artificial Sequence
  Synthetic Construct
gagaagggagagatgcatgggttt

SEQ ID NO: 687 - DNA, 21 bp, Artificial Sequence
  Synthetic Construct
ggccacccctgtgcatcttta

SEQ ID NO: 688 - DNA, 21 bp, Artificial Sequence
  Synthetic Construct
tgaatggtggccgaattgtgt

SEQ ID NO: 689 - DNA, 27 bp, Artificial Sequence
  Synthetic Construct
gccctttctggaggtacttgagcttat

SEQ ID NO: 690 - DNA, 22 bp, Artificial Sequence
  Synthetic Construct
gcagtctccagtgctgttcttc

SEQ ID NO: 691 - DNA, 22 bp, Artificial Sequence
  Synthetic Construct
cttcacccacagccagaaatgt

SEQ ID NO: 692 - DNA, 25 bp, Artificial Sequence
  Synthetic Construct
ctggcttggaacagaaaccatgact

SEQ ID NO: 693 - DNA, 20 bp, Artificial Sequence
  Synthetic Construct
aaggcttgagacgtgcttgt

SEQ ID NO: 694 - DNA, 18 bp, Artificial Sequence
  Synthetic Construct
gctgcagtgagccacgat

SEQ ID NO: 695 - DNA, 20 bp, Artificial Sequence
  Synthetic Construct
tggctggagcagagtgaaca

SEQ ID NO: 696 - DNA, 22 bp, Artificial Sequence
  Synthetic Construct
ccgccatcaggggttgatgtaa

SEQ ID NO: 697 - DNA, 20 bp, Artificial Sequence
  Synthetic Construct
agggatcagggccatcttca

SEQ ID NO: 698 - DNA, 21 bp, Artificial Sequence
  Synthetic Construct
agtcagcaggctggaaaaact

SEQ ID NO: 699 - DNA, 22 bp, Artificial Sequence
  Synthetic Construct
ctgtgcaggaagcaaggtagat

SEQ ID NO: 700 - DNA, 25 bp, Artificial Sequence
  Synthetic Construct
tgagtcaaggtgatacttgcttctt

SEQ ID NO: 701 - DNA, 26 bp, Artificial Sequence
  Synthetic Construct
acctataacaaaggggaagtcaggat

SEQ ID NO: 702 - DNA, 22 bp, Artificial Sequence
  Synthetic Construct
accttccccaccatgttctaca

SEQ ID NO: 703 - DNA, 24 bp, Artificial Sequence
  Synthetic Construct
cacatgcccagtaaatggaacaaa

SEQ ID NO: 704 - DNA, 22 bp, Artificial Sequence
  Synthetic Construct
cacctggaagctgaagccaaag

SEQ ID NO: 705 - DNA, 20 bp, Artificial Sequence
  Synthetic Construct
agtgggcgagcgccccttat

SEQ ID NO: 706 - DNA, 19 bp, Artificial Sequence
  Synthetic Construct
agccctgctgcgtggacaa

SEQ ID NO: 707 - DNA, 25 bp, Artificial Sequence
  Synthetic Construct
cttgggaaactaagtgagggcaaag

SEQ ID NO: 708 - DNA, 22 bp, Artificial Sequence
  Synthetic Construct
gcagcttttcctggtgtctttc

SEQ ID NO: 709 - DNA, 25 bp, Artificial Sequence
  Synthetic Construct
ggggtggttaagtatgggctagcaa

SEQ ID NO: 710 - DNA, 25 bp, Artificial Sequence
  Synthetic Construct
agtgagcatacagcttctcagaaat

SEQ ID NO: 711 - DNA, 25 bp, Artificial Sequence
  Synthetic Construct
ggatctaagcagtgcatctctgtgt

SEQ ID NO: 712 - DNA, 21 bp, Artificial Sequence
  Synthetic Construct
ggtgactgtgcacgcgttaat

SEQ ID NO: 713 - DNA, 22 bp, Artificial Sequence
  Synthetic Construct
gctcaagtactccctggcttct

SEQ ID NO: 714 - DNA, 27 bp, Artificial Sequence
  Synthetic Construct
caggatcttctttgtttgaaggagctt

SEQ ID NO: 715 - DNA, 21 bp, Artificial Sequence
  Synthetic Construct
ggcagacaaatcagcccagtt

SEQ ID NO: 716 - DNA, 21 bp, Artificial Sequence
  Synthetic Construct
gtcattgaactgcgcttgcat

SEQ ID NO: 717 - DNA, 24 bp, Artificial Sequence
  Synthetic Construct
gggactacagataagcaccactgt

SEQ ID NO: 718 - DNA, 22 bp, Artificial Sequence
  Synthetic Construct
caaagaggccctcatgctcagt

SEQ ID NO: 719 - DNA, 22 bp, Artificial Sequence
  Synthetic Construct
ttggtcctacaaccaagcaagt

SEQ ID NO: 720 - DNA, 25 bp, Artificial Sequence
  Synthetic Construct
gccagagatgaatggtttgcgaatg

SEQ ID NO: 721 - DNA, 24 bp, Artificial Sequence
  Synthetic Construct
cctgtgctatagaatcagcactct

SEQ ID NO: 722 - DNA, 22 bp, Artificial Sequence
  Synthetic Construct
tgtgtgttgtggagagggagat

SEQ ID NO: 723 - DNA, 26 bp, Artificial Sequence
  Synthetic Construct
gaagctccttacattagtgccaggtt

SEQ ID NO: 724 - DNA, 25 bp, Artificial Sequence
  Synthetic Construct
tgcactcagaggagaagttaaaaca

SEQ ID NO: 725 - DNA, 27 bp, Artificial Sequence
  Synthetic Construct
ggatcaaagttcaaggagttagtgtga

SEQ ID NO: 726 - DNA, 22 bp, Artificial Sequence
  Synthetic Construct
cgccaccagcatttgagtcttg

SEQ ID NO: 727 - DNA, 19 bp, Artificial Sequence
  Synthetic Construct
ccggccaagaaggtagcaa

SEQ ID NO: 728 - DNA, 21 bp, Artificial Sequence
  Synthetic Construct
gggctttctggccgagatgaa

SEQ ID NO: 729 - DNA, 20 bp, Artificial Sequence
  Synthetic Construct
gccacaggttggaggcaaga

SEQ ID NO: 730 - DNA, 21 bp, Artificial Sequence
  Synthetic Construct
agtgccctgctcaaccaatac

SEQ ID NO: 731 - DNA, 24 bp, Artificial Sequence
  Synthetic Construct
tccctcttgtttccaggtttttgt

SEQ ID NO: 732 - DNA, 20 bp, Artificial Sequence
  Synthetic Construct
ggaggctccatccacagtca

SEQ ID NO: 733 - DNA, 24 bp, Artificial Sequence
  Synthetic Construct
gggcaaatctgtgtcctccagata

SEQ ID NO: 734 - DNA, 24 bp, Artificial Sequence
  Synthetic Construct
gggttacaggttgactctgggatt

SEQ ID NO: 735 - DNA, 21 bp, Artificial Sequence
  Synthetic Construct
cctagcctacaagcgcactct

SEQ ID NO: 736 - DNA, 23 bp, Artificial Sequence
  Synthetic Construct
gagtactgaggcagggaaggttt

SEQ ID NO: 737 - DNA, 26 bp, Artificial Sequence
  Synthetic Construct
ccaatgagttgtagagctcagattgt

SEQ ID NO: 738 - DNA, 22 bp, Artificial Sequence
  Synthetic Construct
gaggggtgctagtcaactgtgt

SEQ ID NO: 739 - DNA, 20 bp, Artificial Sequence
  Synthetic Construct
aatgccaagccaccctggaa

SEQ ID NO: 740 - DNA, 22 bp, Artificial Sequence
  Synthetic Construct
aggaacccacagcggtaactga

SEQ ID NO: 741 - DNA, 19 bp, Artificial Sequence
  Synthetic Construct
tgcgagctgagtgcagcat

SEQ ID NO: 742 - DNA, 26 bp, Artificial Sequence
  Synthetic Construct
ctccaagtccaggatatatgaagcaa

SEQ ID NO: 743 - DNA, 24 bp, Artificial Sequence
  Synthetic Construct
gcacagaaataatcgtgcaggaaa

SEQ ID NO: 744 - DNA, 24 bp, Artificial Sequence
  Synthetic Construct
gggagcaaacctcttaggaagaca

SEQ ID NO: 745 - DNA, 24 bp, Artificial Sequence
  Synthetic Construct
tttggggttttgggatgaggataa

SEQ ID NO: 746 - DNA, 21 bp, Artificial Sequence
  Synthetic Construct
ttcctccgcccaaccgtcttt

SEQ ID NO: 747 - DNA, 23 bp, Artificial Sequence
  Synthetic Construct
gctaccctgaagtgctgatggat

SEQ ID NO: 748 - DNA, 26 bp, Artificial Sequence
  Synthetic Construct
cttgatctgtcaagggagaagagaga

SEQ ID NO: 749 - DNA, 23 bp, Artificial Sequence
  Synthetic Construct
gcaaagggagtgatgggagatga

SEQ ID NO: 750 - DNA, 20 bp, Artificial Sequence
  Synthetic Construct
ccgactcttggtgggttgaa

SEQ ID NO: 751 - DNA, 24 bp, Artificial Sequence
  Synthetic Construct
tgtgttcctagagactctggcttt

SEQ ID NO: 752 - DNA, 22 bp, Artificial Sequence
  Synthetic Construct
accagctgtgtgagctaagttg

SEQ ID NO: 753 - DNA, 22 bp, Artificial Sequence
  Synthetic Construct
ttgcctttccctgtctttggaa

SEQ ID NO: 754 - DNA, 22 bp, Artificial Sequence
  Synthetic Construct
gcaggactaacaatggctcaga

SEQ ID NO: 755 - DNA, 19 bp, Artificial Sequence
  Synthetic Construct
caggagccacctgggaact

SEQ ID NO: 756 - DNA, 24 bp, Artificial Sequence
  Synthetic Construct
tggagaagagcaaatccatgttgt

SEQ ID NO: 757 - DNA, 24 bp, Artificial Sequence
  Synthetic Construct
ccaggacccagaagtactccctat

SEQ ID NO: 758 - DNA, 22 bp, Artificial Sequence
  Synthetic Construct
cctaccatatgcaaggcaccat

SEQ ID NO: 759 - DNA, 22 bp, Artificial Sequence
  Synthetic Construct
agaagtccaggcttcccacttg

SEQ ID NO: 760 - DNA, 26 bp, Artificial Sequence
  Synthetic Construct
gggcttgttaaatgaacccgagaagt

SEQ ID NO: 761 - DNA, 25 bp, Artificial Sequence
  Synthetic Construct
gccacagtaaaacaaagtacacagt

SEQ ID NO: 762 - DNA, 23 bp, Artificial Sequence
  Synthetic Construct
tgtgcagtgaatgcagagactat

SEQ ID NO: 763 - DNA, 24 bp, Artificial Sequence
  Synthetic Construct
ctcacaagcctagaagggtatgtt

SEQ ID NO: 764 - DNA, 22 bp, Artificial Sequence
  Synthetic Construct
atgggacacctccctgctgagt

SEQ ID NO: 765 - DNA, 25 bp, Artificial Sequence
  Synthetic Construct
ggtgtagcagggagagagattggtt

SEQ ID NO: 766 - DNA, 22 bp, Artificial Sequence
  Synthetic Construct
ggccttgttgcctctccactta

SEQ ID NO: 767 - DNA, 25 bp, Artificial Sequence
  Synthetic Construct
cacttcatagtgtcaccctggttgt

SEQ ID NO: 768 - DNA, 22 bp, Artificial Sequence
  Synthetic Construct
agaagctgctttctgcttgtca

SEQ ID NO: 769 - DNA, 25 bp, Artificial Sequence
  Synthetic Construct
gattgtttgtgctccagaaagaaga

SEQ ID NO: 770 - DNA, 22 bp, Artificial Sequence
  Synthetic Construct
gaacagttggcgataggctgaa

SEQ ID NO: 771 - DNA, 22 bp, Artificial Sequence
  Synthetic Construct
ggccctatactgccttcagaga

SEQ ID NO: 772 - DNA, 26 bp, Artificial Sequence
  Synthetic Construct
cacaggtgatagcaacaacctaccat

SEQ ID NO: 773 - DNA, 24 bp, Artificial Sequence
  Synthetic Construct
ccttgggtggaacctgtgattcaa

SEQ ID NO: 774 - DNA, 21 bp, Artificial Sequence
  Synthetic Construct
aggcaccatgctcagctccta

SEQ ID NO: 775 - DNA, 22 bp, Artificial Sequence
  Synthetic Construct
gctcaaagccttggggttctac

SEQ ID NO: 776 - DNA, 21 bp, Artificial Sequence
  Synthetic Construct
gctccaatgtcagtcccttca

SEQ ID NO: 777 - DNA, 22 bp, Artificial Sequence
  Synthetic Construct
gctggagttccaggttggactt

SEQ ID NO: 778 - DNA, 19 bp, Artificial Sequence
  Synthetic Construct
gggcaccccaccattggaa

SEQ ID NO: 779 - DNA, 22 bp, Artificial Sequence
  Synthetic Construct
gccagtctgtggtgttcattgt

SEQ ID NO: 780 - DNA, 21 bp, Artificial Sequence
  Synthetic Construct
caccctgggaagctgactgta

SEQ ID NO: 781 - DNA, 22 bp, Artificial Sequence
  Synthetic Construct
gtggcatctgaggtgagctttg

SEQ ID NO: 782 - DNA, 24 bp, Artificial Sequence
  Synthetic Construct
gccggtagttgtgacaataggaaa

SEQ ID NO: 783 - DNA, 25 bp, Artificial Sequence
  Synthetic Construct
gggcgtacttcctttttcattctac

SEQ ID NO: 784 - DNA, 22 bp, Artificial Sequence
  Synthetic Construct
tctaggctggactggacaccaa

SEQ ID NO: 785 - DNA, 26 bp, Artificial Sequence
  Synthetic Construct
gagtttcctgttctgggtatgggttt

SEQ ID NO: 786 - DNA, 22 bp, Artificial Sequence
  Synthetic Construct
gagacacctggaaggacgaaca

SEQ ID NO: 787 - DNA, 23 bp, Artificial Sequence
  Synthetic Construct
gcttgcctgagaaatgcctgtga

SEQ ID NO: 788 - DNA, 20 bp, Artificial Sequence
  Synthetic Construct
cccacacacaactgctcaca

SEQ ID NO: 789 - DNA, 19 bp, Artificial Sequence
  Synthetic Construct
tggcaggacaaggggtttg

SEQ ID NO: 790 - DNA, 24 bp, Artificial Sequence
  Synthetic Construct
cctattcccatggagccattgttg

SEQ ID NO: 791 - DNA, 20 bp, Artificial Sequence
  Synthetic Construct
accttgctgagggagcagta

SEQ ID NO: 792 - DNA, 23 bp, Artificial Sequence
  Synthetic Construct
caaggcagatgggagaagagcaa

SEQ ID NO: 793 - DNA, 19 bp, Artificial Sequence
  Synthetic Construct
ccaccttccagccccttga

SEQ ID NO: 794 - DNA, 20 bp, Artificial Sequence
  Synthetic Construct
gcaacatcctggggcacaga

SEQ ID NO: 795 - DNA, 20 bp, Artificial Sequence
  Synthetic Construct
tcccaacacaggtggctaga

SEQ ID NO: 796 - DNA, 26 bp, Artificial Sequence
  Synthetic Construct
ggagtggatgcagaagtgtttctttc

SEQ ID NO: 797 - DNA, 24 bp, Artificial Sequence
  Synthetic Construct
gtacactagcaagtaccggtgaga

SEQ ID NO: 798 - DNA, 20 bp, Artificial Sequence
  Synthetic Construct
tgaggcttgtttccgcatgt

SEQ ID NO: 799 - DNA, 26 bp, Artificial Sequence
  Synthetic Construct
actggactacactggactactttgat

SEQ ID NO: 800 - DNA, 22 bp, Artificial Sequence
  Synthetic Construct
ccaagagcccacctgattctct

SEQ ID NO: 801 - DNA, 22 bp, Artificial Sequence
  Synthetic Construct
tgataggcaaacagcagacagt

SEQ ID NO: 802 - DNA, 20 bp, Artificial Sequence
  Synthetic Construct
cccgcgttacaatgcaactt

SEQ ID NO: 803 - DNA, 24 bp, Artificial Sequence
  Synthetic Construct
cacttccaaaaggcagctacaatc

SEQ ID NO: 804 - DNA, 20 bp, Artificial Sequence
  Synthetic Construct
tgcctggtgatcctccatca

SEQ ID NO: 805 - DNA, 23 bp, Artificial Sequence
  Synthetic Construct
gctgcaaacgagaagtaaagcat

SEQ ID NO: 806 - DNA, 21 bp, Artificial Sequence
  Synthetic Construct
gccctatgcacattggcttgt

SEQ ID NO: 807 - DNA, 21 bp, Artificial Sequence
  Synthetic Construct
aaggactgagcaatggctgtt

SEQ ID NO: 808 - DNA, 20 bp, Artificial Sequence
  Synthetic Construct
ggccgcagagcctcaacttt

SEQ ID NO: 809 - DNA, 26 bp, Artificial Sequence
  Synthetic Construct
ggagtctgcagtttgaggtttatatg

SEQ ID NO: 810 - DNA, 24 bp, Artificial Sequence
  Synthetic Construct
cctgtttcaggattaagggcttct

SEQ ID NO: 811 - DNA, 21 bp, Artificial Sequence
  Synthetic Construct
agctttggggtccctcagtat

SEQ ID NO: 812 - DNA, 23 bp, Artificial Sequence
  Synthetic Construct
agatcaaatcaccccagctttgt

SEQ ID NO: 813 - DNA, 21 bp, Artificial Sequence
  Synthetic Construct
cacacatgtccctgcagtttg

SEQ ID NO: 814 - DNA, 21 bp, Artificial Sequence
  Synthetic Construct
gcgtctgactcatgtcctgtt

SEQ ID NO: 815 - DNA, 22 bp, Artificial Sequence
  Synthetic Construct
ccggcttctttaccccacttag

SEQ ID NO: 816 - DNA, 19 bp, Artificial Sequence
  Synthetic Construct
caccccagaccccaagttc

SEQ ID NO: 817 - DNA, 20 bp, Artificial Sequence
  Synthetic Construct
agcctgtctgccacctgaaa

SEQ ID NO: 818 - DNA, 19 bp, Artificial Sequence
  Synthetic Construct
ggagcagagcgaccgtcat

SEQ ID NO: 819 - DNA, 24 bp, Artificial Sequence
  Synthetic Construct
gcactggactagtattcgggagat

SEQ ID NO: 820 - DNA, 23 bp, Artificial Sequence
  Synthetic Construct
ctcttctggcacaaggtgtgtct

SEQ ID NO: 821 - DNA, 23 bp, Artificial Sequence
  Synthetic Construct
caccagcaaagagggaagttaga

SEQ ID NO: 822 - DNA, 24 bp, Artificial Sequence
  Synthetic Construct
gatgtcaacgtactgactccaaca

SEQ ID NO: 823 - DNA, 21 bp, Artificial Sequence
  Synthetic Construct
ccaccagcttcattggtctct

SEQ ID NO: 824 - DNA, 24 bp, Artificial Sequence
  Synthetic Construct
gggatggttatcatgcccctcttc

SEQ ID NO: 825 - DNA, 23 bp, Artificial Sequence
  Synthetic Construct
ggttctagatcccgctctcttct

SEQ ID NO: 826 - DNA, 24 bp, Artificial Sequence
  Synthetic Construct
ctctggtacctgaaccttcccatt

SEQ ID NO: 827 - DNA, 21 bp, Artificial Sequence
  Synthetic Construct
tgcttcgaggagaggtagtga

SEQ ID NO: 828 - DNA, 21 bp, Artificial Sequence
  Synthetic Construct
gcacttgactcacagggagaa

SEQ ID NO: 829 - DNA, 22 bp, Artificial Sequence
  Synthetic Construct
gttatggcagctgacaccagta

SEQ ID NO: 830 - DNA, 23 bp, Artificial Sequence
  Synthetic Construct
gtcacagattcagggagaagcaa

SEQ ID NO: 831 - DNA, 22 bp, Artificial Sequence
  Synthetic Construct
cagccttttccctaggcaatgt

SEQ ID NO: 832 - DNA, 25 bp, Artificial Sequence
  Synthetic Construct
gctctggctactgctattggtgtga

SEQ ID NO: 833 - DNA, 23 bp, Artificial Sequence
  Synthetic Construct
acacaaagagttcgatggccttt

SEQ ID NO: 834 - DNA, 23 bp, Artificial Sequence
  Synthetic Construct
tgtttccagacaagccaacaagt

SEQ ID NO: 835 - DNA, 23 bp, Artificial Sequence
  Synthetic Construct
ggcagagcagcttctttccatct

SEQ ID NO: 836 - DNA, 19 bp, Artificial Sequence
  Synthetic Construct
gtccagcctcggagcaaaa

SEQ ID NO: 837 - DNA, 24 bp, Artificial Sequence
  Synthetic Construct
tcactatgaaccctaccaccacta

SEQ ID NO: 838 - DNA, 21 bp, Artificial Sequence
  Synthetic Construct
cccctgccttcctggtagtaa

SEQ ID NO: 839 - DNA, 19 bp, Artificial Sequence
  Synthetic Construct
aaggcgaccctccggaaca

SEQ ID NO: 840 - DNA, 20 bp, Artificial Sequence
  Synthetic Construct
aggcggagctctaagcacta

SEQ ID NO: 841 - DNA, 24 bp, Artificial Sequence
  Synthetic Construct
atgagctctgcagtcattgaattg

SEQ ID NO: 842 - DNA, 20 bp, Artificial Sequence
  Synthetic Construct
ctggctgctatgcactcaga

SEQ ID NO: 843 - DNA, 23 bp, Artificial Sequence
  Synthetic Construct
gcttcgtgcttttacctgactgt

SEQ ID NO: 844 - DNA, 22 bp, Artificial Sequence
  Synthetic Construct
ccaaggacagacctcccagaga

SEQ ID NO: 845 - DNA, 27 bp, Artificial Sequence
  Synthetic Construct
ggggttacttaccggtcagacaaattc

SEQ ID NO: 846 - DNA, 24 bp, Artificial Sequence
  Synthetic Construct
gcagaagcatcactgcgtaatatc

SEQ ID NO: 847 - DNA, 23 bp, Artificial Sequence
  Synthetic Construct
accatcctccccatctcagtaaa

SEQ ID NO: 848 - DNA, 26 bp, Artificial Sequence
  Synthetic Construct
cgtctccatttctgtatccctctcaa

SEQ ID NO: 849 - DNA, 23 bp, Artificial Sequence
  Synthetic Construct
gtggggtaacggtttaggagttg

SEQ ID NO: 850 - DNA, 25 bp, Artificial Sequence
  Synthetic Construct
ccttaattactgccgattgcctgtt

SEQ ID NO: 851 - DNA, 23 bp, Artificial Sequence
  Synthetic Construct
agcctggagaacaaaaggtgaaa

SEQ ID NO: 852 - DNA, 20 bp, Artificial Sequence
  Synthetic Construct
cgaggcaatttcccctgcaa

SEQ ID NO: 853 - DNA, 22 bp, Artificial Sequence
  Synthetic Construct
gaggtgacatgcctgttgtcat

SEQ ID NO: 854 - DNA, 26 bp, Artificial Sequence
  Synthetic Construct
gcccttctagtgaatgtttgggttca

SEQ ID NO: 855 - DNA, 23 bp, Artificial Sequence
  Synthetic Construct
ccaacaatctctgtgcctctact

SEQ ID NO: 856 - DNA, 23 bp, Artificial Sequence
  Synthetic Construct
ccctgcctaaaggtctccaaaac

SEQ ID NO: 857 - DNA, 21 bp, Artificial Sequence
  Synthetic Construct
tgagggctatcctcgaccttt

SEQ ID NO: 858 - DNA, 25 bp, Artificial Sequence
  Synthetic Construct
gtggtagctactgaatcagccctat

SEQ ID NO: 859 - DNA, 21 bp, Artificial Sequence
  Synthetic Construct
tccaggtgaaagcaggtcaag

SEQ ID NO: 860 - DNA, 24 bp, Artificial Sequence
  Synthetic Construct
gcagataaagcaaaagggtgactt

SEQ ID NO: 861 - DNA, 22 bp, Artificial Sequence
  Synthetic Construct
tccaggtcactgcctcatagat

SEQ ID NO: 862 - DNA, 21 bp, Artificial Sequence
  Synthetic Construct
tgtgggaggagaggtcaccat

SEQ ID NO: 863 - DNA, 20 bp, Artificial Sequence
  Synthetic Construct
agggcctagcggtcaacatt

SEQ ID NO: 864 - DNA, 25 bp, Artificial Sequence
  Synthetic Construct
gggcaacagaagtaacatccattag

SEQ ID NO: 865 - DNA, 22 bp, Artificial Sequence
  Synthetic Construct
tctgctacagtctttgcgttca

SEQ ID NO: 866 - DNA, 22 bp, Artificial Sequence
  Synthetic Construct
tgaccttttcagcttccgttgt

SEQ ID NO: 867 - DNA, 20 bp, Artificial Sequence
  Synthetic Construct
tggaggaccaaagccctcat

SEQ ID NO: 868 - DNA, 23 bp, Artificial Sequence
  Synthetic Construct
gtgacacctctgcctttgcatgt

SEQ ID NO: 869 - DNA, 23 bp, Artificial Sequence
  Synthetic Construct
tctgggatttgagcatggaactt

SEQ ID NO: 870 - DNA, 24 bp, Artificial Sequence
  Synthetic Construct
gaccgtctactaacagcaccaagt

SEQ ID NO: 871 - DNA, 23 bp, Artificial Sequence
  Synthetic Construct
ggtgtaagactaggctccctcta

SEQ ID NO: 872 - DNA, 22 bp, Artificial Sequence
  Synthetic Construct
ggggcgtagtgaatctccaatg

SEQ ID NO: 873 - DNA, 21 bp, Artificial Sequence
  Synthetic Construct
accaccacactccccttctct

SEQ ID NO: 874 - DNA, 27 bp, Artificial Sequence
  Synthetic Construct
gagaggtcaaagacaggagactgaatc

SEQ ID NO: 875 - DNA, 23 bp, Artificial Sequence
  Synthetic Construct
ggcataggtgacatgccatcaga

SEQ ID NO: 876 - DNA, 24 bp, Artificial Sequence
  Synthetic Construct
cagacaatggaactacgcctgcat

SEQ ID NO: 877 - DNA, 25 bp, Artificial Sequence
  Synthetic Construct
cgcctgagcttagacttcacctaca

SEQ ID NO: 878 - DNA, 21 bp, Artificial Sequence
  Synthetic Construct
tccccacctggagcccaaaat

SEQ ID NO: 879 - DNA, 22 bp, Artificial Sequence
  Synthetic Construct
ctgtccagacttgtccccaaga

SEQ ID NO: 880 - DNA, 22 bp, Artificial Sequence
  Synthetic Construct
aggagacagtgcaagcttttgt

SEQ ID NO: 881 - DNA, 23 bp, Artificial Sequence
  Synthetic Construct
tggactcactgttctccaagtga

SEQ ID NO: 882 - DNA, 22 bp, Artificial Sequence
  Synthetic Construct
gccctggtgaatgcacattttg

SEQ ID NO: 883 - DNA, 20 bp, Artificial Sequence
  Synthetic Construct
tggcatcgaggatggcatga

SEQ ID NO: 884 - DNA, 24 bp, Artificial Sequence
  Synthetic Construct
tcctgtttgttatgggaaccaagt

SEQ ID NO: 885 - DNA, 22 bp, Artificial Sequence
  Synthetic Construct
gcatccagcccaaatcctcact

SEQ ID NO: 886 - DNA, 21 bp, Artificial Sequence
  Synthetic Construct
tcctccctgagaccacagctt

SEQ ID NO: 887 - DNA, 24 bp, Artificial Sequence
  Synthetic Construct
ccatcacccatttacccctacttg

SEQ ID NO: 888 - DNA, 20 bp, Artificial Sequence
  Synthetic Construct
actggctgtcaggcttgctt

SEQ ID NO: 889 - DNA, 25 bp, Artificial Sequence
  Synthetic Construct
gcacgagatgaactaagacaccatt

SEQ ID NO: 890 - DNA, 25 bp, Artificial Sequence
  Synthetic Construct
gagggaatggtacctggattagcaa

SEQ ID NO: 891 - DNA, 24 bp, Artificial Sequence
  Synthetic Construct
tgccacttcacccatactgaattt

SEQ ID NO: 892 - DNA, 22 bp, Artificial Sequence
  Synthetic Construct
cacactgccacctgcttgagta

SEQ ID NO: 893 - DNA, 22 bp, Artificial Sequence
  Synthetic Construct
tgatgagtggaagcccatgttg

SEQ ID NO: 894 - DNA, 23 bp, Artificial Sequence
  Synthetic Construct
tgctcatcatggctatgctttct

SEQ ID NO: 895 - DNA, 22 bp, Artificial Sequence
  Synthetic Construct
gctgatccagagatggacacaa

SEQ ID NO: 896 - DNA, 21 bp, Artificial Sequence
  Synthetic Construct
gcagtgctgtctatgccaatg

SEQ ID NO: 897 - DNA, 24 bp, Artificial Sequence
  Synthetic Construct
gccagatgtggagttaacaagtca

SEQ ID NO: 898 - DNA, 25 bp, Artificial Sequence
  Synthetic Construct
tgacttaacaggtgacctagacaca

SEQ ID NO: 899 - DNA, 19 bp, Artificial Sequence
  Synthetic Construct
ccttggaggccagcaacaa

SEQ ID NO: 900 - DNA, 26 bp, Artificial Sequence
  Synthetic Construct
gaggcactgattcattcaacaggatt

SEQ ID NO: 901 - DNA, 24 bp, Artificial Sequence
  Synthetic Construct
cccatgggtaaactgctgtaagta

SEQ ID NO: 902 - DNA, 22 bp, Artificial Sequence
  Synthetic Construct
caggcctcaaaacacgaagaag

SEQ ID NO: 903 - DNA, 23 bp, Artificial Sequence
  Synthetic Construct
ggggagaagtgtcaccagattca

SEQ ID NO: 904 - DNA, 24 bp, Artificial Sequence
  Synthetic Construct
gcgggttaggaagattccctgaag

SEQ ID NO: 905 - DNA, 24 bp, Artificial Sequence
  Synthetic Construct
cttcctcacccgtccttaataaca

SEQ ID NO: 906 - DNA, 23 bp, Artificial Sequence
  Synthetic Construct
ggtgctttcctttccaccgaagt

SEQ ID NO: 907 - DNA, 23 bp, Artificial Sequence
  Synthetic Construct
gggaggaacagtgatctgagcat

SEQ ID NO: 908 - DNA, 27 bp, Artificial Sequence
  Synthetic Construct
gagaattaaacagggctttgagggatt

SEQ ID NO: 909 - DNA, 22 bp, Artificial Sequence
  Synthetic Construct
caccgagcactcgggtgaataa

SEQ ID NO: 910 - DNA, 24 bp, Artificial Sequence
  Synthetic Construct
ttgatggctcccatgtaagtttga

SEQ ID NO: 911 - DNA, 23 bp, Artificial Sequence
  Synthetic Construct
cgaagaagcaagaccgcagtaac

SEQ ID NO: 912 - DNA, 23 bp, Artificial Sequence
  Synthetic Construct
ctctggggaatgcctaacaatga

SEQ ID NO: 913 - DNA, 22 bp, Artificial Sequence
  Synthetic Construct
cagcaatgaggccagcgtagtt

SEQ ID NO: 914 - DNA, 28 bp, Artificial Sequence
  Synthetic Construct
ccctatccagaaagaaaaagccaagtga

SEQ ID NO: 915 - DNA, 23 bp, Artificial Sequence
  Synthetic Construct
ccttcctgcaagtcaaggactca

SEQ ID NO: 916 - DNA, 22 bp, Artificial Sequence
  Synthetic Construct
gccgtaggtagttccatgctaa

SEQ ID NO: 917 - DNA, 22 bp, Artificial Sequence
  Synthetic Construct
catcctcttgccgtgtgtgact

SEQ ID NO: 918 - DNA, 22 bp, Artificial Sequence
  Synthetic Construct
caagtagcgttcatcccaggaa

SEQ ID NO: 919 - DNA, 22 bp, Artificial Sequence
  Synthetic Construct
gcccctgaaattggaagcaaat

SEQ ID NO: 920 - DNA, 21 bp, Artificial Sequence
  Synthetic Construct
gccacaggtcgccttctgaac

SEQ ID NO: 921 - DNA, 26 bp, Artificial Sequence
  Synthetic Construct
ggcaacactctgtacaactccttact

SEQ ID NO: 922 - DNA, 23 bp, Artificial Sequence
  Synthetic Construct
aggcccttcaagaagttgaaaca

SEQ ID NO: 923 - DNA, 23 bp, Artificial Sequence
  Synthetic Construct
cccgtgtagccaagagactgaag

SEQ ID NO: 924 - DNA, 21 bp, Artificial Sequence
  Synthetic Construct
tgtgtggtacaggcccgatct

SEQ ID NO: 925 - DNA, 22 bp, Artificial Sequence
  Synthetic Construct
gctctcaaggactttgcagtct

SEQ ID NO: 926 - DNA, 22 bp, Artificial Sequence
  Synthetic Construct
gagggaggtgctttgctgtcaa

SEQ ID NO: 927 - DNA, 23 bp, Artificial Sequence
  Synthetic Construct
ggctctgtgaggatggagagagt

SEQ ID NO: 928 - DNA, 22 bp, Artificial Sequence
  Synthetic Construct
gccaggggaagtggtgtttaag

SEQ ID NO: 929 - DNA, 24 bp, Artificial Sequence
  Synthetic Construct
gtagactccacaccttcctacctt

SEQ ID NO: 930 - DNA, 25 bp, Artificial Sequence
  Synthetic Construct
tctcctggaaatgtgaacaggattg

SEQ ID NO: 931 - DNA, 20 bp, Artificial Sequence
  Synthetic Construct
ctcgctgcatctgagtgagt

SEQ ID NO: 932 - DNA, 21 bp, Artificial Sequence
  Synthetic Construct
tcggatgcttcctgggcaaag

SEQ ID NO: 933 - DNA, 19 bp, Artificial Sequence
  Synthetic Construct
caaccgctcaggctgtgaa

SEQ ID NO: 934 - DNA, 24 bp, Artificial Sequence
  Synthetic Construct
gatgataagcctgtccctgagatg

SEQ ID NO: 935 - DNA, 24 bp, Artificial Sequence
  Synthetic Construct
caggagggagaaagctttggaaga

SEQ ID NO: 936 - DNA, 27 bp, Artificial Sequence
  Synthetic Construct
catccgtctcttcactagctgttaaat

SEQ ID NO: 937 - DNA, 21 bp, Artificial Sequence
  Synthetic Construct
gtccctctgcttcctgccata

SEQ ID NO: 938 - DNA, 22 bp, Artificial Sequence
  Synthetic Construct
gctgtactcctgggtgacattc

SEQ ID NO: 939 - DNA, 22 bp, Artificial Sequence
  Synthetic Construct
agccctctgattccaggtaaga

SEQ ID NO: 940 - DNA, 22 bp, Artificial Sequence
  Synthetic Construct
tcgatggcagagacaaatgaca

SEQ ID NO: 941 - DNA, 22 bp, Artificial Sequence
  Synthetic Construct
cagggtcacacactcgggtatt

SEQ ID NO: 942 - DNA, 22 bp, Artificial Sequence
  Synthetic Construct
ctccagcagacagcatgcaaac

SEQ ID NO: 943 - DNA, 24 bp, Artificial Sequence
  Synthetic Construct
gcacacctgaaggtcaaacgaaca

SEQ ID NO: 944 - DNA, 24 bp, Artificial Sequence
  Synthetic Construct
gttgatggtcgcattccagatgta

SEQ ID NO: 945 - DNA, 20 bp, Artificial Sequence
  Synthetic Construct
tgtggcctggctcagacata

SEQ ID NO: 946 - DNA, 20 bp, Artificial Sequence
  Synthetic Construct
ttgcggccactgtcactact

SEQ ID NO: 947 - DNA, 25 bp, Artificial Sequence
  Synthetic Construct
caaatcctttgtgggtgttaagtgt

SEQ ID NO: 948 - DNA, 21 bp, Artificial Sequence
  Synthetic Construct
tgccctgatggataggtggat

SEQ ID NO: 949 - DNA, 22 bp, Artificial Sequence
  Synthetic Construct
agagctccaggctcatccctat

SEQ ID NO: 950 - DNA, 24 bp, Artificial Sequence
  Synthetic Construct
cagagtcccttggatctgttctca

SEQ ID NO: 951 - DNA, 19 bp, Artificial Sequence
  Synthetic Construct
ctggggcaggaccaggaaa

SEQ ID NO: 952 - DNA, 22 bp, Artificial Sequence
  Synthetic Construct
cagtggagcttgctggttgact

SEQ ID NO: 953 - DNA, 26 bp, Artificial Sequence
  Synthetic Construct
gggtaccttctctcaaagcagcatct

SEQ ID NO: 954 - DNA, 20 bp, Artificial Sequence
  Synthetic Construct
catccagcaccatggcatct

SEQ ID NO: 955 - DNA, 19 bp, Artificial Sequence
  Synthetic Construct
tggcagagactggcaggaa

SEQ ID NO: 956 - DNA, 23 bp, Artificial Sequence
  Synthetic Construct
ttcctgaagggttgtaccagttg

SEQ ID NO: 957 - DNA, 21 bp, Artificial Sequence
  Synthetic Construct
agggccctgctgaacactgaa

SEQ ID NO: 958 - DNA, 21 bp, Artificial Sequence
  Synthetic Construct
catctccagacggtggtgttc

SEQ ID NO: 959 - DNA, 22 bp, Artificial Sequence
  Synthetic Construct
cttggcttgggactgtctctct

SEQ ID NO: 960 - DNA, 19 bp, Artificial Sequence
  Synthetic Construct
actggcacagcccaggatt

SEQ ID NO: 961 - DNA, 23 bp, Artificial Sequence
  Synthetic Construct
caggacttctggaaacccactgt

SEQ ID NO: 962 - DNA, 22 bp, Artificial Sequence
  Synthetic Construct
catccctgcgcctaactctaag

SEQ ID NO: 963 - DNA, 19 bp, Artificial Sequence
  Synthetic Construct
tgcacatggcggctaaaca

SEQ ID NO: 964 - DNA, 24 bp, Artificial Sequence
  Synthetic Construct
ggagttcgcatggtacctccctta

SEQ ID NO: 965 - DNA, 20 bp, Artificial Sequence
  Synthetic Construct
agccatgccgattgcctctt

SEQ ID NO: 966 - DNA, 22 bp, Artificial Sequence
  Synthetic Construct
ttggtcttcaggtccggaggtt

SEQ ID NO: 967 - DNA, 22 bp, Artificial Sequence
  Synthetic Construct
ggcttttgttggaagcacagaa

SEQ ID NO: 968 - DNA, 19 bp, Artificial Sequence
  Synthetic Construct
ttgagtcgtggggctctct

SEQ ID NO: 969 - DNA, 20 bp, Artificial Sequence
  Synthetic Construct
tgtggatggccaggatgtgt

SEQ ID NO: 970 - DNA, 22 bp, Artificial Sequence
  Synthetic Construct
ccatgacagacacccagcatct

SEQ ID NO: 971 - DNA, 24 bp, Artificial Sequence
  Synthetic Construct
cctgcctcaaacagaggaactcta

SEQ ID NO: 972 - DNA, 23 bp, Artificial Sequence
  Synthetic Construct
cactgagcaatcatggcatttgt

SEQ ID NO: 973 - DNA, 22 bp, Artificial Sequence
  Synthetic Construct
tccatccctgtcccagctccta

SEQ ID NO: 974 - DNA, 22 bp, Artificial Sequence
  Synthetic Construct
ggaacagcagcctaagtcatgt

SEQ ID NO: 975 - DNA, 22 bp, Artificial Sequence
  Synthetic Construct
gtaagaaggaggcgtcggaatc

SEQ ID NO: 976 - DNA, 20 bp, Artificial Sequence
  Synthetic Construct
tgctgggtcttgcccaacat

SEQ ID NO: 977 - DNA, 21 bp, Artificial Sequence
  Synthetic Construct
gcctggagatcaagctgcaaa

SEQ ID NO: 978 - DNA, 25 bp, Artificial Sequence
  Synthetic Construct
caccagggtaggtatccaatactgt

SEQ ID NO: 979 - DNA, 22 bp, Artificial Sequence
  Synthetic Construct
gcaactgaatgcacgtgtgtga

SEQ ID NO: 980 - DNA, 23 bp, Artificial Sequence
  Synthetic Construct
ggaccttagagcaatgaccttca

SEQ ID NO: 981 - DNA, 26 bp, Artificial Sequence
  Synthetic Construct
ggagtaggtggaaacaaactgcttct

SEQ ID NO: 982 - DNA, 22 bp, Artificial Sequence
  Synthetic Construct
gaagcagtcagcagtgctcaga

SEQ ID NO: 983 - DNA, 22 bp, Artificial Sequence
  Synthetic Construct
gcagtctctcctcctccagcaa

SEQ ID NO: 984 - DNA, 25 bp, Artificial Sequence
  Synthetic Construct
gagctctacccaactcttggtccta

SEQ ID NO: 985 - DNA, 24 bp, Artificial Sequence
  Synthetic Construct
ccctgaagagctgaatcacagaca

SEQ ID NO: 986 - DNA, 25 bp, Artificial Sequence
  Synthetic Construct
aggaaggtgtaggaactgcaaatac

SEQ ID NO: 987 - DNA, 22 bp, Artificial Sequence
  Synthetic Construct
cctcaacatacgggctaccaaa

SEQ ID NO: 988 - DNA, 21 bp, Artificial Sequence
  Synthetic Construct
ggcaaggagttctgggagctt

SEQ ID NO: 989 - DNA, 21 bp, Artificial Sequence
  Synthetic Construct
ggtggagggtttggtgctatg

SEQ ID NO: 990 - DNA, 25 bp, Artificial Sequence
  Synthetic Construct
caaagcaaagaacctctacccatga

SEQ ID NO: 991 - DNA, 20 bp, Artificial Sequence
  Synthetic Construct
gccaaacagctctgcactga

SEQ ID NO: 992 - DNA, 23 bp, Artificial Sequence
  Synthetic Construct
gcagccaagaatgcacctgaaag

SEQ ID NO: 993 - DNA, 20 bp, Artificial Sequence
  Synthetic Construct
gggaaggagctctcgaccta

SEQ ID NO: 994 - DNA, 22 bp, Artificial Sequence
  Synthetic Construct
ctcccaagtcacctgcgtttgt

SEQ ID NO: 995 - DNA, 20 bp, Artificial Sequence
  Synthetic Construct
gccgtacaactgacgccaaa

SEQ ID NO: 996 - DNA, 21 bp, Artificial Sequence
  Synthetic Construct
gctcctcctccagctcaattt

SEQ ID NO: 997 - DNA, 20 bp, Artificial Sequence
  Synthetic Construct
ctcgggtgcttggattgtgt

SEQ ID NO: 998 - DNA, 22 bp, Artificial Sequence
  Synthetic Construct
tggttcctccgctccattctct

SEQ ID NO: 999 - DNA, 22 bp, Artificial Sequence
  Synthetic Construct
ctgtgtgtctggctgctgacat

SEQ ID NO: 1000 - DNA, 22 bp, Artificial Sequence
  Synthetic Construct
gttagcgtgggtggctctgaat

SEQ ID NO: 1001 - DNA, 20 bp, Artificial Sequence
  Synthetic Construct
gggcacttctgagtgcttga

SEQ ID NO: 1002 - DNA, 21 bp, Artificial Sequence
  Synthetic Construct
ctctctgttcccacccaccta

SEQ ID NO: 1003 - DNA, 24 bp, Artificial Sequence
  Synthetic Construct
gtctgaggagataaaccccacact

SEQ ID NO: 1004 - DNA, 27 bp, Artificial Sequence
  Synthetic Construct
ggaatgcatgggcataaattctgtctt

SEQ ID NO: 1005 - DNA, 28 bp, Artificial Sequence
  Synthetic Construct
gcaaggagcctattgttactaagagaga

SEQ ID NO: 1006 - DNA, 22 bp, Artificial Sequence
  Synthetic Construct
gggttgtgtggcaaatggaagt

SEQ ID NO: 1007 - DNA, 28 bp, Artificial Sequence
  Synthetic Construct
caggagcaggaggaggtagaattaatga

SEQ ID NO: 1008 - DNA, 24 bp, Artificial Sequence
  Synthetic Construct
ggccccagtgatgttttaggttca

SEQ ID NO: 1009 - DNA, 25 bp, Artificial Sequence
  Synthetic Construct
tgatttttccatcgtgatggtgttg

SEQ ID NO: 1010 - DNA, 22 bp, Artificial Sequence
  Synthetic Construct
gggagagcagtcacttggaaga

SEQ ID NO: 1011 - DNA, 24 bp, Artificial Sequence
  Synthetic Construct
cgtggctagggttgtactgtcgtt

SEQ ID NO: 1012 - DNA, 22 bp, Artificial Sequence
  Synthetic Construct
ccatgcgtgcaggggagaatta

SEQ ID NO: 1013 - DNA, 24 bp, Artificial Sequence
  Synthetic Construct
tgtgctcagtaagtgcttgttaga

SEQ ID NO: 1014 - DNA, 21 bp, Artificial Sequence
  Synthetic Construct
tggtgaaggccctgactcgat

SEQ ID NO: 1015 - DNA, 23 bp, Artificial Sequence
  Synthetic Construct
gggtccctctctaggccactttt

SEQ ID NO: 1016 - DNA, 27 bp, Artificial Sequence
  Synthetic Construct
ggaccttagattcgggagaaaatcact

SEQ ID NO: 1017 - DNA, 22 bp, Artificial Sequence
  Synthetic Construct
cctgaccatcctagctgcaagt

SEQ ID NO: 1018 - DNA, 21 bp, Artificial Sequence
  Synthetic Construct
ggcaggcagggtgtggatttt

SEQ ID NO: 1019 - DNA, 21 bp, Artificial Sequence
  Synthetic Construct
ctgtgccagtgacgaaagaca

SEQ ID NO: 1020 - DNA, 25 bp, Artificial Sequence
  Synthetic Construct
gatgtgaaggtgcaatgaagttaca

SEQ ID NO: 1021 - DNA, 20 bp, Artificial Sequence
  Synthetic Construct
ccccagtttggtgcttctca

SEQ ID NO: 1022 - DNA, 21 bp, Artificial Sequence
  Synthetic Construct
ggacaggaagcagctctcaca

SEQ ID NO: 1023 - DNA, 23 bp, Artificial Sequence
  Synthetic Construct
cggctcctgaactggaaggagat

SEQ ID NO: 1024 - DNA, 20 bp, Artificial Sequence
  Synthetic Construct
actcacggccctgaagcaaa

SEQ ID NO: 1025 - DNA, 24 bp, Artificial Sequence
  Synthetic Construct
caggagcaccaagactggtagatg

SEQ ID NO: 1026 - DNA, 22 bp, Artificial Sequence
  Synthetic Construct
ccctccaagtgtcaccaagcaa

SEQ ID NO: 1027 - DNA, 24 bp, Artificial Sequence
  Synthetic Construct
cagtgccatgtcagtttaccattg

SEQ ID NO: 1028 - DNA, 22 bp, Artificial Sequence
  Synthetic Construct
aaggactggacccacccactga

SEQ ID NO: 1029 - DNA, 23 bp, Artificial Sequence
  Synthetic Construct
cagagaaaagccccactcgttac

SEQ ID NO: 1030 - DNA, 22 bp, Artificial Sequence
  Synthetic Construct
cacatctgcctgatgcctgcta

SEQ ID NO: 1031 - DNA, 19 bp, Artificial Sequence
  Synthetic Construct
gggttatggtgggcagcaa

SEQ ID NO: 1032 - DNA, 24 bp, Artificial Sequence
  Synthetic Construct
acagagaaaatgaccctccaggaa

SEQ ID NO: 1033 - DNA, 24 bp, Artificial Sequence
  Synthetic Construct
ctggtgccctggttataggaagaa

SEQ ID NO: 1034 - DNA, 25 bp, Artificial Sequence
  Synthetic Construct
cctttcagcctatggcattggattt

SEQ ID NO: 1035 - DNA, 22 bp, Artificial Sequence
  Synthetic Construct
cagaggcagtttggaccctaca

SEQ ID NO: 1036 - DNA, 23 bp, Artificial Sequence
  Synthetic Construct
agcaaaaatagcctctgggacaa

SEQ ID NO: 1037 - DNA, 22 bp, Artificial Sequence
  Synthetic Construct
gcatttggagggctagggacaa

SEQ ID NO: 1038 - DNA, 23 bp, Artificial Sequence
  Synthetic Construct
gcaagggcaggtagggagaaaat

SEQ ID NO: 1039 - DNA, 23 bp, Artificial Sequence
  Synthetic Construct
cctcccagtggagtctgtgtttc

SEQ ID NO: 1040 - DNA, 19 bp, Artificial Sequence
  Synthetic Construct
gctgtcagccccacagatg

SEQ ID NO: 1041 - DNA, 22 bp, Artificial Sequence
  Synthetic Construct
gaggacgcatatggacccgaat

SEQ ID NO: 1042 - DNA, 26 bp, Artificial Sequence
  Synthetic Construct
gtctagaagctgtatccccagagtca

SEQ ID NO: 1043 - DNA, 21 bp, Artificial Sequence
  Synthetic Construct
cgcttccgtaagggagcatct

SEQ ID NO: 1044 - DNA, 22 bp, Artificial Sequence
  Synthetic Construct
cacggtcacaatgtttgtgcat

SEQ ID NO: 1045 - DNA, 24 bp, Artificial Sequence
  Synthetic Construct
gcccttggctacatttgaggttgt

SEQ ID NO: 1046 - DNA, 23 bp, Artificial Sequence
  Synthetic Construct
ggattggggtgttcagagcaaga

SEQ ID NO: 1047 - DNA, 20 bp, Artificial Sequence
  Synthetic Construct
aggagcgtgcgtgaatgtgt

SEQ ID NO: 1048 - DNA, 21 bp, Artificial Sequence
  Synthetic Construct
ggcactgagggactggaactt

SEQ ID NO: 1049 - DNA, 22 bp, Artificial Sequence
  Synthetic Construct
gagactttgaggcagactgtca

SEQ ID NO: 1050 - DNA, 26 bp, Artificial Sequence
  Synthetic Construct
ctggaagtcaggaaagtacagttcta

SEQ ID NO: 1051 - DNA, 22 bp, Artificial Sequence
  Synthetic Construct
ggttgtcctggttcgcagagtt

SEQ ID NO: 1052 - DNA, 23 bp, Artificial Sequence
  Synthetic Construct
gcctgatgggagaatcagaaact

SEQ ID NO: 1053 - DNA, 23 bp, Artificial Sequence
  Synthetic Construct
ggcaaatcaaagcctgccttttc

SEQ ID NO: 1054 - DNA, 22 bp, Artificial Sequence
  Synthetic Construct
agtgtgggccctacctgtgatt

SEQ ID NO: 1055 - DNA, 19 bp, Artificial Sequence
  Synthetic Construct
ttttgccgctgcccctgat

SEQ ID NO: 1056 - DNA, 22 bp, Artificial Sequence
  Synthetic Construct
ggactgtgttgggtgcaataac

SEQ ID NO: 1057 - DNA, 18 bp, Artificial Sequence
  Synthetic Construct
acccgatgccccatgact

SEQ ID NO: 1058 - DNA, 22 bp, Artificial Sequence
  Synthetic Construct
cccagtgaagccccacctttag

SEQ ID NO: 1059 - DNA, 22 bp, Artificial Sequence
  Synthetic Construct
gtggcagacaaggacagtgagt

SEQ ID NO: 1060 - DNA, 23 bp, Artificial Sequence
  Synthetic Construct
ccatggcaactccatgcttccaa

SEQ ID NO: 1061 - DNA, 24 bp, Artificial Sequence
  Synthetic Construct
gcttcccaggatacccacccatta

SEQ ID NO: 1062 - DNA, 21 bp, Artificial Sequence
  Synthetic Construct
gctgtctcggtcctcgttagt

SEQ ID NO: 1063 - DNA, 27 bp, Artificial Sequence
  Synthetic Construct
gagccgattttatatccatgcctgtag

SEQ ID NO: 1064 - DNA, 22 bp, Artificial Sequence
  Synthetic Construct
cccagaaacgagccatggaaag

SEQ ID NO: 1065 - DNA, 20 bp, Artificial Sequence
  Synthetic Construct
aggtcgccagagtgctgtga

SEQ ID NO: 1066 - DNA, 25 bp, Artificial Sequence
  Synthetic Construct
ccaaacccaattgcagctgtgtaac

SEQ ID NO: 1067 - DNA, 24 bp, Artificial Sequence
  Synthetic Construct
gctgccttcttgagctcctgattt

SEQ ID NO: 1068 - DNA, 23 bp, Artificial Sequence
  Synthetic Construct
cagcctagaggcagcaaaactgt

SEQ ID NO: 1069 - DNA, 24 bp, Artificial Sequence
  Synthetic Construct
gcaagtgtcaggtccctctagtca

SEQ ID NO: 1070 - DNA, 20 bp, Artificial Sequence
  Synthetic Construct
agccaactgagccaggaaca

SEQ ID NO: 1071 - DNA, 24 bp, Artificial Sequence
  Synthetic Construct
cctgcatgcttgggttaattcttg

SEQ ID NO: 1072 - DNA, 20 bp, Artificial Sequence
  Synthetic Construct
aaggggagctgtgtgtcctt

SEQ ID NO: 1073 - DNA, 22 bp, Artificial Sequence
  Synthetic Construct
ccaatcctacgacgggaccaaa

SEQ ID NO: 1074 - DNA, 21 bp, Artificial Sequence
  Synthetic Construct
tgctgattgcctgtgttgcta

SEQ ID NO: 1075 - DNA, 22 bp, Artificial Sequence
  Synthetic Construct
gggacactgacctgcaccaaaa

SEQ ID NO: 1076 - DNA, 25 bp, Artificial Sequence
  Synthetic Construct
ggacccttctaagccactgatctct

SEQ ID NO: 1077 - DNA, 22 bp, Artificial Sequence
  Synthetic Construct
ctaaccccagctcaacctcttg

SEQ ID NO: 1078 - DNA, 22 bp, Artificial Sequence
  Synthetic Construct
gtgacacaggctgcttctcatc

SEQ ID NO: 1079 - DNA, 21 bp, Artificial Sequence
  Synthetic Construct
ttggtgtagggagcaggagat

SEQ ID NO: 1080 - DNA, 26 bp, Artificial Sequence
  Synthetic Construct
cctcttacacccactgttccactaag

SEQ ID NO: 1081 - DNA, 23 bp, Artificial Sequence
  Synthetic Construct
gaagcattctgggctgagagaga

SEQ ID NO: 1082 - DNA, 22 bp, Artificial Sequence
  Synthetic Construct
ggaaacctggtccaaaccacaa

SEQ ID NO: 1083 - DNA, 21 bp, Artificial Sequence
  Synthetic Construct
aggcacctgtttgcccgaatg

SEQ ID NO: 1084 - DNA, 23 bp, Artificial Sequence
  Synthetic Construct
gctgtcagaaccagcctgagtat

SEQ ID NO: 1085 - DNA, 24 bp, Artificial Sequence
  Synthetic Construct
gcggtaggatgttaaaggcagctt

SEQ ID NO: 1086 - DNA, 22 bp, Artificial Sequence
  Synthetic Construct
ggttcaatctcaggctcacact

SEQ ID NO: 1087 - DNA, 21 bp, Artificial Sequence
  Synthetic Construct
gcatggatctgcgtggagaca

SEQ ID NO: 1088 - DNA, 23 bp, Artificial Sequence
  Synthetic Construct
cagaactgggtggtgtcgttttg

SEQ ID NO: 1089 - DNA, 21 bp, Artificial Sequence
  Synthetic Construct
cagaccacttgagagcaggtt

SEQ ID NO: 1090 - DNA, 22 bp, Artificial Sequence
  Synthetic Construct
gctaccaagggaggtctcttct

SEQ ID NO: 1091 - DNA, 22 bp, Artificial Sequence
  Synthetic Construct
gaggtgggtaacagacccatca

SEQ ID NO: 1092 - DNA, 23 bp, Artificial Sequence
  Synthetic Construct
ggaagcaagcacatactcaccat

SEQ ID NO: 1093 - DNA, 20 bp, Artificial Sequence
  Synthetic Construct
actgcgtaagcggtggcata

SEQ ID NO: 1094 - DNA, 25 bp, Artificial Sequence
  Synthetic Construct
ggtatcagcagtgtgggttaaggat

SEQ ID NO: 1095 - DNA, 24 bp, Artificial Sequence
  Synthetic Construct
ctcggaagtcccagcagatctttc

SEQ ID NO: 1096 - DNA, 23 bp, Artificial Sequence
  Synthetic Construct
ggtgaggttcacaccctcctttc

SEQ ID NO: 1097 - DNA, 20 bp, Artificial Sequence
  Synthetic Construct
ctgcagtcatggctgtggaa

SEQ ID NO: 1098 - DNA, 23 bp, Artificial Sequence
  Synthetic Construct
cccctgcctgtggaccttatatt

SEQ ID NO: 1099 - DNA, 20 bp, Artificial Sequence
  Synthetic Construct
gggcattgccacaatggttt

SEQ ID NO: 1100 - DNA, 20 bp, Artificial Sequence
  Synthetic Construct
gtggcaacaggacagggatt

SEQ ID NO: 1101 - DNA, 22 bp, Artificial Sequence
  Synthetic Construct
tctaggaccaggagccatcaga

SEQ ID NO: 1102 - DNA, 23 bp, Artificial Sequence
  Synthetic Construct
cgaggggtctttgaggcaaactt

SEQ ID NO: 1103 - DNA, 26 bp, Artificial Sequence
  Synthetic Construct
tccccacctctctttctttagagtat

SEQ ID NO: 1104 - DNA, 21 bp, Artificial Sequence
  Synthetic Construct
ccaggaaagccaccaatgcaa

SEQ ID NO: 1105 - DNA, 26 bp, Artificial Sequence
  Synthetic Construct
gggctgatataatggaggcagcttag

SEQ ID NO: 1106 - DNA, 22 bp, Artificial Sequence
  Synthetic Construct
gccctgtcctgactgacattct

SEQ ID NO: 1107 - DNA, 26 bp, Artificial Sequence
  Synthetic Construct
tctttggccacacagatttactctac

SEQ ID NO: 1108 - DNA, 22 bp, Artificial Sequence
  Synthetic Construct
cagagtaggtgtgccgtaggaa

SEQ ID NO: 1109 - DNA, 23 bp, Artificial Sequence
  Synthetic Construct
cgctgtctctccatccaagtgtt

SEQ ID NO: 1110 - DNA, 24 bp, Artificial Sequence
  Synthetic Construct
cggagccttggagctaggtgatta

SEQ ID NO: 1111 - DNA, 25 bp, Artificial Sequence
  Synthetic Construct
cagggttcctagctctttcctgttc

SEQ ID NO: 1112 - DNA, 24 bp, Artificial Sequence
  Synthetic Construct
cattcccaaatggatgtggctaga

SEQ ID NO: 1113 - DNA, 21 bp, Artificial Sequence
  Synthetic Construct
gctccactttcgccctcactt

SEQ ID NO: 1114 - DNA, 24 bp, Artificial Sequence
  Synthetic Construct
ctttgctcttgtctgcactgagta

SEQ ID NO: 1115 - DNA, 19 bp, Artificial Sequence
  Synthetic Construct
ttgagctgtgcaggcttgt

SEQ ID NO: 1116 - DNA, 23 bp, Artificial Sequence
  Synthetic Construct
tgtggctactttcccacagtttg

SEQ ID NO: 1117 - DNA, 24 bp, Artificial Sequence
  Synthetic Construct
caaaggacaatcacagagctgttc

SEQ ID NO: 1118 - DNA, 25 bp, Artificial Sequence
  Synthetic Construct
ggaatggaccaagtttgtcttgatt

SEQ ID NO: 1119 - DNA, 20 bp, Artificial Sequence
  Synthetic Construct
tggatgtggcccgcatttgt

SEQ ID NO: 1120 - DNA, 23 bp, Artificial Sequence
  Synthetic Construct
cccctgccccaaatagcatttta

SEQ ID NO: 1121 - DNA, 22 bp, Artificial Sequence
  Synthetic Construct
accaagcactggggaaactaaa

SEQ ID NO: 1122 - DNA, 19 bp, Artificial Sequence
  Synthetic Construct
ggcatgctccgcaccaaga

SEQ ID NO: 1123 - DNA, 22 bp, Artificial Sequence
  Synthetic Construct
caggccatgtaaacgactctca

SEQ ID NO: 1124 - DNA, 23 bp, Artificial Sequence
  Synthetic Construct
tgctgaatggtttgctcagtttg

SEQ ID NO: 1125 - DNA, 24 bp, Artificial Sequence
  Synthetic Construct
tcgagtcacttacctgctcaaatg

SEQ ID NO: 1126 - DNA, 20 bp, Artificial Sequence
  Synthetic Construct
agcaagcgacggtcctccat

SEQ ID NO: 1127 - DNA, 22 bp, Artificial Sequence
  Synthetic Construct
acctgcagaactgaggctctct

SEQ ID NO: 1128 - DNA, 21 bp, Artificial Sequence
  Synthetic Construct
agtgtcaggaggggaaacgaa

SEQ ID NO: 1129 - DNA, 25 bp, Artificial Sequence
  Synthetic Construct
ccactccttcccttatacccttgta

SEQ ID NO: 1130 - DNA, 21 bp, Artificial Sequence
  Synthetic Construct
gcaaagattgctgcccgttca

SEQ ID NO: 1131 - DNA, 24 bp, Artificial Sequence
  Synthetic Construct
tggacaagaatggagaaagacgtt

SEQ ID NO: 1132 - DNA, 22 bp, Artificial Sequence
  Synthetic Construct
gcctttcccaggactcaacagt

SEQ ID NO: 1133 - DNA, 24 bp, Artificial Sequence
  Synthetic Construct
ctgctttgaggcagataggagctt

SEQ ID NO: 1134 - DNA, 22 bp, Artificial Sequence
  Synthetic Construct
cctgcacaaagtggctgtcaac

SEQ ID NO: 1135 - DNA, 25 bp, Artificial Sequence
  Synthetic Construct
gcaggaaaccacaaaacatcaccta

SEQ ID NO: 1136 - DNA, 26 bp, Artificial Sequence
  Synthetic Construct
gctttctctcccctaggacatacagt

SEQ ID NO: 1137 - DNA, 20 bp, Artificial Sequence
  Synthetic Construct
agcctggctccctacacatt

SEQ ID NO: 1138 - DNA, 21 bp, Artificial Sequence
  Synthetic Construct
tgctattggggcattggtgtt

SEQ ID NO: 1139 - DNA, 20 bp, Artificial Sequence
  Synthetic Construct
tgcatcccgttgctgtcaag

SEQ ID NO: 1140 - DNA, 23 bp, Artificial Sequence
  Synthetic Construct
gacctgtgtccctttgtccttag

SEQ ID NO: 1141 - DNA, 24 bp, Artificial Sequence
  Synthetic Construct
cctttgcccttccagagtctcctt

SEQ ID NO: 1142 - DNA, 23 bp, Artificial Sequence
  Synthetic Construct
gcctggtactctcccagttttag

SEQ ID NO: 1143 - DNA, 24 bp, Artificial Sequence
  Synthetic Construct
gggaccagtcaactttgccagatt

SEQ ID NO: 1144 - DNA, 24 bp, Artificial Sequence
  Synthetic Construct
attcccattcctaaaagccgtgta

SEQ ID NO: 1145 - DNA, 20 bp, Artificial Sequence
  Synthetic Construct
tccaggcacgcacctctgat

SEQ ID NO: 1146 - DNA, 22 bp, Artificial Sequence
  Synthetic Construct
ggcaggcatctgtgcagtcatt

SEQ ID NO: 1147 - DNA, 21 bp, Artificial Sequence
  Synthetic Construct
tgccgacataaccccttcctt

SEQ ID NO: 1148 - DNA, 22 bp, Artificial Sequence
  Synthetic Construct
cgccaatctcagtggttggaat

SEQ ID NO: 1149 - DNA, 25 bp, Artificial Sequence
  Synthetic Construct
cggagcaacttggcatgttaataca

SEQ ID NO: 1150 - DNA, 22 bp, Artificial Sequence
  Synthetic Construct
gtggcagcctttctgtagttga

SEQ ID NO: 1151 - DNA, 25 bp, Artificial Sequence
  Synthetic Construct
gctcgttaagaattagccccacatc

SEQ ID NO: 1152 - DNA, 23 bp, Artificial Sequence
  Synthetic Construct
caccagctagaacctcctgtagt

SEQ ID NO: 1153 - DNA, 18 bp, Artificial Sequence
  Synthetic Construct
gctgctttgcgggacctt

SEQ ID NO: 1154 - DNA, 24 bp, Artificial Sequence
  Synthetic Construct
ggcaggagtcagtgacaagtggta

SEQ ID NO: 1155 - DNA, 25 bp, Artificial Sequence
  Synthetic Construct
tgtgtcaagcagatttgaagctaac

SEQ ID NO: 1156 - DNA, 22 bp, Artificial Sequence
  Synthetic Construct
tgcacattccttccttggtgat

SEQ ID NO: 1157 - DNA, 19 bp, Artificial Sequence
  Synthetic Construct
cctgcattgcaagccgttt

SEQ ID NO: 1158 - DNA, 21 bp, Artificial Sequence
  Synthetic Construct
acctgcctgtgtggtatggaa

SEQ ID NO: 1159 - DNA, 25 bp, Artificial Sequence
  Synthetic Construct
gagccgaatgttcacttatggagtt

SEQ ID NO: 1160 - DNA, 24 bp, Artificial Sequence
  Synthetic Construct
ctgaagcctaatggggatccagaa

SEQ ID NO: 1161 - DNA, 24 bp, Artificial Sequence
  Synthetic Construct
aaatagctgtcccattctggttgt

SEQ ID NO: 1162 - DNA, 21 bp, Artificial Sequence
  Synthetic Construct
tccccggatttccacagtagt

SEQ ID NO: 1163 - DNA, 27 bp, Artificial Sequence
  Synthetic Construct
gggtaggatgcatgagaagaactggat

SEQ ID NO: 1164 - DNA, 25 bp, Artificial Sequence
  Synthetic Construct
gccagctgaggaactattagacact

SEQ ID NO: 1165 - DNA, 23 bp, Artificial Sequence
  Synthetic Construct
ctgcagatctagccaatgaggtt

SEQ ID NO: 1166 - DNA, 25 bp, Artificial Sequence
  Synthetic Construct
ggccaagattttggtgttcaagtag

SEQ ID NO: 1167 - DNA, 20 bp, Artificial Sequence
  Synthetic Construct
acagctgcgaatggcctaat

SEQ ID NO: 1168 - DNA, 24 bp, Artificial Sequence
  Synthetic Construct
gatctcatggctacggagatcaag

SEQ ID NO: 1169 - DNA, 25 bp, Artificial Sequence
  Synthetic Construct
cctcctgggaaactggcaagtaaag

SEQ ID NO: 1170 - DNA, 24 bp, Artificial Sequence
  Synthetic Construct
gtacatggttatggctaccaggaa

SEQ ID NO: 1171 - DNA, 20 bp, Artificial Sequence
  Synthetic Construct
tggtcagtgctcccagagtt

SEQ ID NO: 1172 - DNA, 20 bp, Artificial Sequence
  Synthetic Construct
cgcacatgtctcgtgtcact

SEQ ID NO: 1173 - DNA, 21 bp, Artificial Sequence
  Synthetic Construct
accactgacaaacctgtgcat

SEQ ID NO: 1174 - DNA, 26 bp, Artificial Sequence
  Synthetic Construct
cagggatgaataagcctcatgaaaga

SEQ ID NO: 1175 - DNA, 24 bp, Artificial Sequence
  Synthetic Construct
actgcaacactgtgattgtcttca

SEQ ID NO: 1176 - DNA, 20 bp, Artificial Sequence
  Synthetic Construct
ttggctccccagagtgttgt

SEQ ID NO: 1177 - DNA, 24 bp, Artificial Sequence
  Synthetic Construct
cagtcgaaagagtggaaaggatga

SEQ ID NO: 1178 - DNA, 21 bp, Artificial Sequence
  Synthetic Construct
tgaagcatctggcctgtctga

SEQ ID NO: 1179 - DNA, 20 bp, Artificial Sequence
  Synthetic Construct
ttcggggtgcatcctcacat

SEQ ID NO: 1180 - DNA, 22 bp, Artificial Sequence
  Synthetic Construct
catccacagctgtctccgtgta

SEQ ID NO: 1181 - DNA, 25 bp, Artificial Sequence
  Synthetic Construct
ttccaggttgttttctgcaaagtag

SEQ ID NO: 1182 - DNA, 26 bp, Artificial Sequence
  Synthetic Construct
tcccagagacacagctagttaaaaac

SEQ ID NO: 1183 - DNA, 21 bp, Artificial Sequence
  Synthetic Construct
tgctgctcgtacagtggaaag

SEQ ID NO: 1184 - DNA, 25 bp, Artificial Sequence
  Synthetic Construct
ggagcagtatcattttggtgcattg

SEQ ID NO: 1185 - DNA, 22 bp, Artificial Sequence
  Synthetic Construct
cggtggtgcctttgttttaact

SEQ ID NO: 1186 - DNA, 25 bp, Artificial Sequence
  Synthetic Construct
ggagaaggaatgtcaggaagcaaac

SEQ ID NO: 1187 - DNA, 21 bp, Artificial Sequence
  Synthetic Construct
agtaggtgtgatggccaggat

SEQ ID NO: 1188 - DNA, 23 bp, Artificial Sequence
  Synthetic Construct
tgtcttcctagcctcatctctca

SEQ ID NO: 1189 - DNA, 24 bp, Artificial Sequence
  Synthetic Construct
gctaggggatactgagtcctgcat

SEQ ID NO: 1190 - DNA, 22 bp, Artificial Sequence
  Synthetic Construct
cccaaagagtccccatctggtt

SEQ ID NO: 1191 - DNA, 20 bp, Artificial Sequence
  Synthetic Construct
agacctaggcggcaaacaaa

SEQ ID NO: 1192 - DNA, 25 bp, Artificial Sequence
  Synthetic Construct
agtttcctggaagccagctattaaa

SEQ ID NO: 1193 - DNA, 22 bp, Artificial Sequence
  Synthetic Construct
cgtaagcataggggctgcagta

SEQ ID NO: 1194 - DNA, 25 bp, Artificial Sequence
  Synthetic Construct
gcagttgagggagttcaactaaaga

SEQ ID NO: 1195 - DNA, 23 bp, Artificial Sequence
  Synthetic Construct
cctaggctagaagcccagaaaac

SEQ ID NO: 1196 - DNA, 23 bp, Artificial Sequence
  Synthetic Construct
ccttccctttgtcacaccacatc

SEQ ID NO: 1197 - DNA, 24 bp, Artificial Sequence
  Synthetic Construct
cctgtgttcaggaagaatgaggat

SEQ ID NO: 1198 - DNA, 26 bp, Artificial Sequence
  Synthetic Construct
gaaggaaactgactttgcagcttaac

SEQ ID NO: 1199 - DNA, 24 bp, Artificial Sequence
  Synthetic Construct
agggagaaaatcacactcttgcat

SEQ ID NO: 1200 - DNA, 21 bp, Artificial Sequence
  Synthetic Construct
ggggacgaagtcaaggtgtag

SEQ ID NO: 1201 - DNA, 26 bp, Artificial Sequence
  Synthetic Construct
ctcactaaacttttccccagaactca

SEQ ID NO: 1202 - DNA, 24 bp, Artificial Sequence
  Synthetic Construct
cctctgaagggagactgaaacaac

SEQ ID NO: 1203 - DNA, 20 bp, Artificial Sequence
  Synthetic Construct
gcaagaatgcttggctgcaa

SEQ ID NO: 1204 - DNA, 21 bp, Artificial Sequence
  Synthetic Construct
gtggcatttcactgccctttg

SEQ ID NO: 1205 - DNA, 23 bp, Artificial Sequence
  Synthetic Construct
gcagcttgttcaattgtggttca

SEQ ID NO: 1206 - DNA, 26 bp, Artificial Sequence
  Synthetic Construct
gtgaggatgagttttcagtggctatc

SEQ ID NO: 1207 - DNA, 27 bp, Artificial Sequence
  Synthetic Construct
ccctggacaaaatgtaacagccaaagt

SEQ ID NO: 1208 - DNA, 24 bp, Artificial Sequence
  Synthetic Construct
acctagctatccttccagcatttc

SEQ ID NO: 1209 - DNA, 23 bp, Artificial Sequence
  Synthetic Construct
gctggacaaactactgcctcttc

SEQ ID NO: 1210 - DNA, 22 bp, Artificial Sequence
  Synthetic Construct
gccaatagctgcttgatgcaat

SEQ ID NO: 1211 - DNA, 22 bp, Artificial Sequence
  Synthetic Construct
tagttgcccgggattcccaaga

SEQ ID NO: 1212 - DNA, 20 bp, Artificial Sequence
  Synthetic Construct
gggagaggctggtcctgagt

SEQ ID NO: 1213 - DNA, 25 bp, Artificial Sequence
  Synthetic Construct
gtttgtgaaaggtcaatgtgaggaa

SEQ ID NO: 1214 - DNA, 22 bp, Artificial Sequence
  Synthetic Construct
tcctcgggagctcacaacctta

SEQ ID NO: 1215 - DNA, 20 bp, Artificial Sequence
  Synthetic Construct
tcccactgatgccagaccaa

SEQ ID NO: 1216 - DNA, 27 bp, Artificial Sequence
  Synthetic Construct
cccagcttaagcaaaatagggcaagta

SEQ ID NO: 1217 - DNA, 26 bp, Artificial Sequence
  Synthetic Construct
tggccagtagtaagttgagaagacta

SEQ ID NO: 1218 - DNA, 20 bp, Artificial Sequence
  Synthetic Construct
ccggaagcttcacgttctgt

SEQ ID NO: 1219 - DNA, 22 bp, Artificial Sequence
  Synthetic Construct
ggagggagagctccatctctga

SEQ ID NO: 1220 - DNA, 20 bp, Artificial Sequence
  Synthetic Construct
ccggcaataggactcagcaa

SEQ ID NO: 1221 - DNA, 21 bp, Artificial Sequence
  Synthetic Construct
tagggcaggtgtcctctgcat

SEQ ID NO: 1222 - DNA, 28 bp, Artificial Sequence
  Synthetic Construct
gtgaaccaagctatactacctgcttttc

SEQ ID NO: 1223 - DNA, 25 bp, Artificial Sequence
  Synthetic Construct
ggcttctgtgctcatagttcacact

SEQ ID NO: 1224 - DNA, 22 bp, Artificial Sequence
  Synthetic Construct
gggcacacggaggtgaaaaagt

SEQ ID NO: 1225 - DNA, 23 bp, Artificial Sequence
  Synthetic Construct
cgggagccgttataccagcttag

SEQ ID NO: 1226 - DNA, 23 bp, Artificial Sequence
  Synthetic Construct
gcttcctatgaccaagtcccttt

SEQ ID NO: 1227 - DNA, 20 bp, Artificial Sequence
  Synthetic Construct
gtgttggccagacccactgt

SEQ ID NO: 1228 - DNA, 23 bp, Artificial Sequence
  Synthetic Construct
gggcacttttgagttgggctttg

SEQ ID NO: 1229 - DNA, 21 bp, Artificial Sequence
  Synthetic Construct
gcagctcggtgcctaatggtt

SEQ ID NO: 1230 - DNA, 24 bp, Artificial Sequence
  Synthetic Construct
cagacctggcaggatcagaatagt

SEQ ID NO: 1231 - DNA, 22 bp, Artificial Sequence
  Synthetic Construct
tgcaatgcagaggagaaaggtt

SEQ ID NO: 1232 - DNA, 25 bp, Artificial Sequence
  Synthetic Construct
agtcacaggtatcctgactctcata

SEQ ID NO: 1233 - DNA, 22 bp, Artificial Sequence
  Synthetic Construct
ggagcaatcagccttgcagaga

SEQ ID NO: 1234 - DNA, 18 bp, Artificial Sequence
  Synthetic Construct
tggcgcccggaaaaccat

SEQ ID NO: 1235 - DNA, 22 bp, Artificial Sequence
  Synthetic Construct
ttcaagagcatccttgcgctat

SEQ ID NO: 1236 - DNA, 24 bp, Artificial Sequence
  Synthetic Construct
accttgagaaggtggtatttgtgt

SEQ ID NO: 1237 - DNA, 24 bp, Artificial Sequence
  Synthetic Construct
agaaagaccccaggtaagaaccat

SEQ ID NO: 1238 - DNA, 23 bp, Artificial Sequence
  Synthetic Construct
cactcacacatccacaggagaca

SEQ ID NO: 1239 - DNA, 23 bp, Artificial Sequence
  Synthetic Construct
gacgcagtatcccacagagcatt

SEQ ID NO: 1240 - DNA, 21 bp, Artificial Sequence
  Synthetic Construct
accagctctgagtcaggaagt

SEQ ID NO: 1241 - DNA, 22 bp, Artificial Sequence
  Synthetic Construct
cccacagtccgacgagtgtttt

SEQ ID NO: 1242 - DNA, 25 bp, Artificial Sequence
  Synthetic Construct
tcactccactttacaggcacatatt

SEQ ID NO: 1243 - DNA, 23 bp, Artificial Sequence
  Synthetic Construct
acgaggatcagacaagtcacaga

SEQ ID NO: 1244 - DNA, 23 bp, Artificial Sequence
  Synthetic Construct
cccatgaccccaggttggaattg

SEQ ID NO: 1245 - DNA, 21 bp, Artificial Sequence
  Synthetic Construct
cactctgtgcagttgctggtt

SEQ ID NO: 1246 - DNA, 22 bp, Artificial Sequence
  Synthetic Construct
gtctgtggagcacaccttggaa

SEQ ID NO: 1247 - DNA, 20 bp, Artificial Sequence
  Synthetic Construct
gcctttccactgagccatga

SEQ ID NO: 1248 - DNA, 23 bp, Artificial Sequence
  Synthetic Construct
cagcctggttggttagattctgt

SEQ ID NO: 1249 - DNA, 24 bp, Artificial Sequence
  Synthetic Construct
cttatgtgtggctttggcttcttg

SEQ ID NO: 1250 - DNA, 21 bp, Artificial Sequence
  Synthetic Construct
ggggctgaatcagacaaggaa

SEQ ID NO: 1251 - DNA, 20 bp, Artificial Sequence
  Synthetic Construct
cacagcttggaaggcctgaa

SEQ ID NO: 1252 - DNA, 24 bp, Artificial Sequence
  Synthetic Construct
ctcatgatgtcaaatgctgctcaa

SEQ ID NO: 1253 - DNA, 23 bp, Artificial Sequence
  Synthetic Construct
gttctggtgacagacaaccttct

SEQ ID NO: 1254 - DNA, 21 bp, Artificial Sequence
  Synthetic Construct
tgagcagcacagtccaattct

SEQ ID NO: 1255 - DNA, 23 bp, Artificial Sequence
  Synthetic Construct
cccctgggaaagttactgtcgat

SEQ ID NO: 1256 - DNA, 21 bp, Artificial Sequence
  Synthetic Construct
gtcagtgagctgccagttttc

SEQ ID NO: 1257 - DNA, 21 bp, Artificial Sequence
  Synthetic Construct
tcccaaatcctgagcctgtca

SEQ ID NO: 1258 - DNA, 28 bp, Artificial Sequence
  Synthetic Construct
gccaacctatagacacaactttggttac

SEQ ID NO: 1259 - DNA, 25 bp, Artificial Sequence
  Synthetic Construct
gttgacttccggcagtaagtgatga

SEQ ID NO: 1260 - DNA, 24 bp, Artificial Sequence
  Synthetic Construct
actgggacatttctcacgttatca

SEQ ID NO: 1261 - DNA, 23 bp, Artificial Sequence
  Synthetic Construct
ggaatccagcccatcctcacatc

SEQ ID NO: 1262 - DNA, 20 bp, Artificial Sequence
  Synthetic Construct
actgcaccaccacacggaaa

SEQ ID NO: 1263 - DNA, 22 bp, Artificial Sequence
  Synthetic Construct
ccttcaagggctttctctcaca

SEQ ID NO: 1264 - DNA, 24 bp, Artificial Sequence
  Synthetic Construct
acttccacatggcttaaacagaga

SEQ ID NO: 1265 - DNA, 25 bp, Artificial Sequence
  Synthetic Construct
tcgtgaagaagatggagaggagtta

SEQ ID NO: 1266 - DNA, 21 bp, Artificial Sequence
  Synthetic Construct
ctgggaccaacccatttcaca

SEQ ID NO: 1267 - DNA, 22 bp, Artificial Sequence
  Synthetic Construct
aaggaagtggggtatggactga

SEQ ID NO: 1268 - DNA, 24 bp, Artificial Sequence
  Synthetic Construct
tgttggccacatacattgttctca

SEQ ID NO: 1269 - DNA, 19 bp, Artificial Sequence
  Synthetic Construct
ctcctgccttcggggatgt

SEQ ID NO: 1270 - DNA, 21 bp, Artificial Sequence
  Synthetic Construct
cacaggccagagattcaccat

SEQ ID NO: 1271 - DNA, 21 bp, Artificial Sequence
  Synthetic Construct
tgggaagcctaccttgactct

SEQ ID NO: 1272 - DNA, 24 bp, Artificial Sequence
  Synthetic Construct
aagcccctgagaatctaaaagcaa

SEQ ID NO: 1273 - DNA, 19 bp, Artificial Sequence
  Synthetic Construct
cgacagggcctcccaattc

SEQ ID NO: 1274 - DNA, 24 bp, Artificial Sequence
  Synthetic Construct
aggtagacaccggaagtaatcaca

SEQ ID NO: 1275 - DNA, 22 bp, Artificial Sequence
  Synthetic Construct
tcaggtagaggtcgccaaggtt

SEQ ID NO: 1276 - DNA, 24 bp, Artificial Sequence
  Synthetic Construct
ggaggctatgagaagtgaggtttg

SEQ ID NO: 1277 - DNA, 23 bp, Artificial Sequence
  Synthetic Construct
gggcggttaaagagcttcagaga

SEQ ID NO: 1278 - DNA, 24 bp, Artificial Sequence
  Synthetic Construct
tggtcttctttatgcccaacaaac

SEQ ID NO: 1279 - DNA, 20 bp, Artificial Sequence
  Synthetic Construct
ctcacacgggctcacattct

SEQ ID NO: 1280 - DNA, 19 bp, Artificial Sequence
  Synthetic Construct
cctgctcaccgatgctcaa

SEQ ID NO: 1281 - DNA, 24 bp, Artificial Sequence
  Synthetic Construct
ggtcagaaacagagcctgtaaaac

SEQ ID NO: 1282 - DNA, 25 bp, Artificial Sequence
  Synthetic Construct
cctgagacagaagcagtagcgtctt

SEQ ID NO: 1283 - DNA, 20 bp, Artificial Sequence
  Synthetic Construct
cgcaaaatgggctcctgctt

SEQ ID NO: 1284 - DNA, 22 bp, Artificial Sequence
  Synthetic Construct
gccggattaggggtgaactttg

SEQ ID NO: 1285 - DNA, 24 bp, Artificial Sequence
  Synthetic Construct
ggaggtattctggcttccctaaga

SEQ ID NO: 1286 - DNA, 26 bp, Artificial Sequence
  Synthetic Construct
ggaagggtgagtttagcacaatggtt

SEQ ID NO: 1287 - DNA, 22 bp, Artificial Sequence
  Synthetic Construct
cccacttgcacaaatgcaaaga

SEQ ID NO: 1288 - DNA, 21 bp, Artificial Sequence
  Synthetic Construct
agctgtggttttcctgtgtca

SEQ ID NO: 1289 - DNA, 24 bp, Artificial Sequence
  Synthetic Construct
tgtgtgtgtttagcaagggatttc

SEQ ID NO: 1290 - DNA, 21 bp, Artificial Sequence
  Synthetic Construct
cgtttggcaacggagatgtgt

SEQ ID NO: 1291 - DNA, 22 bp, Artificial Sequence
  Synthetic Construct
tgcccacccttttcttttgctt

SEQ ID NO: 1292 - DNA, 23 bp, Artificial Sequence
  Synthetic Construct
gggctatacatttctgggctcaa

SEQ ID NO: 1293 - DNA, 22 bp, Artificial Sequence
  Synthetic Construct
tacattcccctctcccgcaaca

SEQ ID NO: 1294 - DNA, 25 bp, Artificial Sequence
  Synthetic Construct
ccagccaatcaggatcatggacaga

SEQ ID NO: 1295 - DNA, 20 bp, Artificial Sequence
  Synthetic Construct
ggcccatgactctgctggat

SEQ ID NO: 1296 - DNA, 19 bp, Artificial Sequence
  Synthetic Construct
ggaggcatctccggctaca

SEQ ID NO: 1297 - DNA, 24 bp, Artificial Sequence
  Synthetic Construct
agtgcaaggttggagaatgaaaag

SEQ ID NO: 1298 - DNA, 22 bp, Artificial Sequence
  Synthetic Construct
cgagttggcctcgtcttaccaa

SEQ ID NO: 1299 - DNA, 22 bp, Artificial Sequence
  Synthetic Construct
cgtggcagctggctttagaatc

SEQ ID NO: 1300 - DNA, 22 bp, Artificial Sequence
  Synthetic Construct
tggtgcagccacctctcttatc

SEQ ID NO: 1301 - DNA, 21 bp, Artificial Sequence
  Synthetic Construct
ctctggcacatgcgttagttg

SEQ ID NO: 1302 - DNA, 24 bp, Artificial Sequence
  Synthetic Construct
ggggctttggataacaccaaggta

SEQ ID NO: 1303 - DNA, 20 bp, Artificial Sequence
  Synthetic Construct
ttgcaacccctccgacattc

SEQ ID NO: 1304 - DNA, 21 bp, Artificial Sequence
  Synthetic Construct
aggagaagttcaggggaccaa

SEQ ID NO: 1305 - DNA, 24 bp, Artificial Sequence
  Synthetic Construct
agagctgctatcatgatgtggaaa

SEQ ID NO: 1306 - DNA, 21 bp, Artificial Sequence
  Synthetic Construct
agggtgagtctggaagaggtt

SEQ ID NO: 1307 - DNA, 22 bp, Artificial Sequence
  Synthetic Construct
ccccactcccctcaaggtatgt

SEQ ID NO: 1308 - DNA, 22 bp, Artificial Sequence
  Synthetic Construct
gtcaccctctgaggtacacact

SEQ ID NO: 1309 - DNA, 23 bp, Artificial Sequence
  Synthetic Construct
atgacaacatcacggacagagaa

SEQ ID NO: 1310 - DNA, 22 bp, Artificial Sequence
  Synthetic Construct
tgacaaatgccgaagggattct

SEQ ID NO: 1311 - DNA, 24 bp, Artificial Sequence
  Synthetic Construct
ctatgtttcagccacaccacattc

SEQ ID NO: 1312 - DNA, 23 bp, Artificial Sequence
  Synthetic Construct
caggcttgttcgggaaatacaag

SEQ ID NO: 1313 - DNA, 20 bp, Artificial Sequence
  Synthetic Construct
gccgaggtttcaaggtccaa

SEQ ID NO: 1314 - DNA, 22 bp, Artificial Sequence
  Synthetic Construct
tgctcaactcaaacaggacact

SEQ ID NO: 1315 - DNA, 18 bp, Artificial Sequence
  Synthetic Construct
tgcggcgatgtggctgta

SEQ ID NO: 1316 - DNA, 23 bp, Artificial Sequence
  Synthetic Construct
cagagggtggatggatacagttc

SEQ ID NO: 1317 - DNA, 19 bp, Artificial Sequence
  Synthetic Construct
cgtggcctcctgcactgat

SEQ ID NO: 1318 - DNA, 21 bp, Artificial Sequence
  Synthetic Construct
gtgcaggctcaagttgcttct

SEQ ID NO: 1319 - DNA, 24 bp, Artificial Sequence
  Synthetic Construct
gcttgcttggaaccgattttggat

SEQ ID NO: 1320 - DNA, 19 bp, Artificial Sequence
  Synthetic Construct
ggcgggaccgagtgcttta

SEQ ID NO: 1321 - DNA, 26 bp, Artificial Sequence
  Synthetic Construct
cctcaattactccccagatgttcaga

SEQ ID NO: 1322 - DNA, 22 bp, Artificial Sequence
  Synthetic Construct
tcagcaggaggaaggatgtttg

SEQ ID NO: 1323 - DNA, 20 bp, Artificial Sequence
  Synthetic Construct
accttccggccatgtgtgaa

SEQ ID NO: 1324 - DNA, 26 bp, Artificial Sequence
  Synthetic Construct
caaatctgctctgtctatgctaggaa

SEQ ID NO: 1325 - DNA, 22 bp, Artificial Sequence
  Synthetic Construct
agctcctgacattatgcccaaa

SEQ ID NO: 1326 - DNA, 24 bp, Artificial Sequence
  Synthetic Construct
gggaaagccagacatcctctccta

SEQ ID NO: 1327 - DNA, 22 bp, Artificial Sequence
  Synthetic Construct
gcccaggtagaggaacaaatca

SEQ ID NO: 1328 - DNA, 26 bp, Artificial Sequence
  Synthetic Construct
ggagaatatcaagctgtcatgggatt

SEQ ID NO: 1329 - DNA, 23 bp, Artificial Sequence
  Synthetic Construct
ccaaacgaggccctctctcttct

SEQ ID NO: 1330 - DNA, 20 bp, Artificial Sequence
  Synthetic Construct
gcccagaagagtgcttgaca

SEQ ID NO: 1331 - DNA, 24 bp, Artificial Sequence
  Synthetic Construct
ggcagtccttaactcctggttttc

SEQ ID NO: 1332 - DNA, 23 bp, Artificial Sequence
  Synthetic Construct
ccagcacattcagtccagaatca

SEQ ID NO: 1333 - DNA, 20 bp, Artificial Sequence
  Synthetic Construct
cagccaagtgcagactggaa

SEQ ID NO: 1334 - DNA, 22 bp, Artificial Sequence
  Synthetic Construct
tcctggcaaatcttgcacaaag

SEQ ID NO: 1335 - DNA, 26 bp, Artificial Sequence
  Synthetic Construct
gtgggattacattcacagatgcagaa

SEQ ID NO: 1336 - DNA, 22 bp, Artificial Sequence
  Synthetic Construct
agaccttcacctctgccacagt

SEQ ID NO: 1337 - DNA, 22 bp, Artificial Sequence
  Synthetic Construct
ggaacaggagaagagcaaggaa

SEQ ID NO: 1338 - DNA, 24 bp, Artificial Sequence
  Synthetic Construct
actgatgctaccaaagaggctaga

SEQ ID NO: 1339 - DNA, 20 bp, Artificial Sequence
  Synthetic Construct
cacaaccgctttccccttga

SEQ ID NO: 1340 - DNA, 22 bp, Artificial Sequence
  Synthetic Construct
gggagacactgcaggacaaagt

SEQ ID NO: 1341 - DNA, 21 bp, Artificial Sequence
  Synthetic Construct
gtgcctgagagtttcctggtt

SEQ ID NO: 1342 - DNA, 22 bp, Artificial Sequence
  Synthetic Construct
cacagtgctgtagttgcctgtt

SEQ ID NO: 1343 - DNA, 23 bp, Artificial Sequence
  Synthetic Construct
gccacaatctaggacctgcagaa

SEQ ID NO: 1344 - DNA, 23 bp, Artificial Sequence
  Synthetic Construct
tttctgccctagttcaggtcatc

SEQ ID NO: 1345 - DNA, 29 bp, Artificial Sequence
  Synthetic Construct
ccttgaagatgcaacagacattcttctac

SEQ ID NO: 1346 - DNA, 18 bp, Artificial Sequence
  Synthetic Construct
ggatgcaggcaggcaagt

SEQ ID NO: 1347 - DNA, 24 bp, Artificial Sequence
  Synthetic Construct
gtgctagagagcgaaatacctgtt

SEQ ID NO: 1348 - DNA, 24 bp, Artificial Sequence
  Synthetic Construct
ccacagaactcccactcgaataag

SEQ ID NO: 1349 - DNA, 21 bp, Artificial Sequence
  Synthetic Construct
ccccagaccaatccgaagtgt

SEQ ID NO: 1350 - DNA, 21 bp, Artificial Sequence
  Synthetic Construct
aagcaacccagttccttccaa

SEQ ID NO: 1351 - DNA, 21 bp, Artificial Sequence
  Synthetic Construct
cagctgctgcctcatttgcat

SEQ ID NO: 1352 - DNA, 23 bp, Artificial Sequence
  Synthetic Construct
aatggtagcctttgagacgatgt

SEQ ID NO: 1353 - DNA, 24 bp, Artificial Sequence
  Synthetic Construct
gccccttcttttctatgaggatgt

SEQ ID NO: 1354 - DNA, 22 bp, Artificial Sequence
  Synthetic Construct
agcatgggaaccagtgttcatc

SEQ ID NO: 1355 - DNA, 21 bp, Artificial Sequence
  Synthetic Construct
tgacaggacgaggagactcaa

SEQ ID NO: 1356 - DNA, 23 bp, Artificial Sequence
  Synthetic Construct
tctgccttgcagagttacagaat

SEQ ID NO: 1357 - DNA, 23 bp, Artificial Sequence
  Synthetic Construct
aaccttttcgctacccatgtact

SEQ ID NO: 1358 - DNA, 21 bp, Artificial Sequence
  Synthetic Construct
ccgagctcgtctgggtttgaa

SEQ ID NO: 1359 - DNA, 20 bp, Artificial Sequence
  Synthetic Construct
ctatctgcccgcatcacctt

SEQ ID NO: 1360 - DNA, 19 bp, Artificial Sequence
  Synthetic Construct
cgacggctcggagagaatc

SEQ ID NO: 1361 - DNA, 20 bp, Artificial Sequence
  Synthetic Construct
cccacgggtttgggtagctt

SEQ ID NO: 1362 - DNA, 24 bp, Artificial Sequence
  Synthetic Construct
cttgaccttgctctagcagttttg

SEQ ID NO: 1363 - DNA, 22 bp, Artificial Sequence
  Synthetic Construct
ctcacgtagtctccaccgtcat

SEQ ID NO: 1364 - DNA, 22 bp, Artificial Sequence
  Synthetic Construct
aaccctttcaaccctccacatt

SEQ ID NO: 1365 - DNA, 21 bp, Artificial Sequence
  Synthetic Construct
agttctcaggccaccttgttc

SEQ ID NO: 1366 - DNA, 19 bp, Artificial Sequence
  Synthetic Construct
cccgcaggactgagcacaa

SEQ ID NO: 1367 - DNA, 21 bp, Artificial Sequence
  Synthetic Construct
catccaggcacaccgttaaga

SEQ ID NO: 1368 - DNA, 20 bp, Artificial Sequence
  Synthetic Construct
tcgggagcacgtttgcagat

SEQ ID NO: 1369 - DNA, 22 bp, Artificial Sequence
  Synthetic Construct
ggttgctctcacgggaataaga

SEQ ID NO: 1370 - DNA, 23 bp, Artificial Sequence
  Synthetic Construct
ccggtaaacccaatccaaacaaa

SEQ ID NO: 1371 - DNA, 18 bp, Artificial Sequence
  Synthetic Construct
tgcacactgcgtcagctt

SEQ ID NO: 1372 - DNA, 27 bp, Artificial Sequence
  Synthetic Construct
gcatgcttcacaaacattatcccattc

SEQ ID NO: 1373 - DNA, 22 bp, Artificial Sequence
  Synthetic Construct
gggcatccaaggagagaagaga

SEQ ID NO: 1374 - DNA, 21 bp, Artificial Sequence
  Synthetic Construct
tgtcagcctggcttctgtaag

SEQ ID NO: 1375 - DNA, 21 bp, Artificial Sequence
  Synthetic Construct
tgagctggcctggtgaaatag

SEQ ID NO: 1376 - DNA, 25 bp, Artificial Sequence
  Synthetic Construct
acctcaccttctaattctggactgt

SEQ ID NO: 1377 - DNA, 22 bp, Artificial Sequence
  Synthetic Construct
cgtgacagctaatcacccacat

SEQ ID NO: 1378 - DNA, 24 bp, Artificial Sequence
  Synthetic Construct
ggaacacctctccctcaattcttt

SEQ ID NO: 1379 - DNA, 23 bp, Artificial Sequence
  Synthetic Construct
ccttggcagagggagatttgaga

SEQ ID NO: 1380 - DNA, 20 bp, Artificial Sequence
  Synthetic Construct
gtgaagcgtcctcctgttga

SEQ ID NO: 1381 - DNA, 25 bp, Artificial Sequence
  Synthetic Construct
ccagactagccgaattttccaggat

SEQ ID NO: 1382 - DNA, 24 bp, Artificial Sequence
  Synthetic Construct
tctggagaaagtgacagggtaaga

SEQ ID NO: 1383 - DNA, 25 bp, Artificial Sequence
  Synthetic Construct
gaaaggctgggtatttttgaaccaa

SEQ ID NO: 1384 - DNA, 24 bp, Artificial Sequence
  Synthetic Construct
cacaacctcacattctccaggtta

SEQ ID NO: 1385 - DNA, 22 bp, Artificial Sequence
  Synthetic Construct
gagcccacgtatcagctcaaca

SEQ ID NO: 1386 - DNA, 22 bp, Artificial Sequence
  Synthetic Construct
actgcaacctttttgcctgaga

SEQ ID NO: 1387 - DNA, 20 bp, Artificial Sequence
  Synthetic Construct
tctcaccgcttggtcagagt

SEQ ID NO: 1388 - DNA, 21 bp, Artificial Sequence
  Synthetic Construct
tctccagccctcagtccttct

SEQ ID NO: 1389 - DNA, 21 bp, Artificial Sequence
  Synthetic Construct
tgagaggtcaccacacacaga

SEQ ID NO: 1390 - DNA, 25 bp, Artificial Sequence
  Synthetic Construct
tcatcccagcatcatttgttgagaa

SEQ ID NO: 1391 - DNA, 22 bp, Artificial Sequence
  Synthetic Construct
ccgcctctccacctttgaactt

SEQ ID NO: 1392 - DNA, 25 bp, Artificial Sequence
  Synthetic Construct
cgacaatttaaggcgagacatggaa

SEQ ID NO: 1393 - DNA, 21 bp, Artificial Sequence
  Synthetic Construct
gcacattgccaccgtccagat

SEQ ID NO: 1394 - DNA, 21 bp, Artificial Sequence
  Synthetic Construct
cccatccttcaagtcgtggtt

SEQ ID NO: 1395 - DNA, 22 bp, Artificial Sequence
  Synthetic Construct
acccggtggagtcaggatttga

SEQ ID NO: 1396 - DNA, 21 bp, Artificial Sequence
  Synthetic Construct
tggatgggttggcttggtact

SEQ ID NO: 1397 - DNA, 23 bp, Artificial Sequence
  Synthetic Construct
gctgtgtatttgttgagccttgt

SEQ ID NO: 1398 - DNA, 25 bp, Artificial Sequence
  Synthetic Construct
ggggtgaggtactgcagttaaacat

SEQ ID NO: 1399 - DNA, 19 bp, Artificial Sequence
  Synthetic Construct
atcggcgcgagccaggatt

SEQ ID NO: 1400 - DNA, 24 bp, Artificial Sequence
  Synthetic Construct
gcagtctctcaactctgctgttgt

SEQ ID NO: 1401 - DNA, 20 bp, Artificial Sequence
  Synthetic Construct
agggatgtcctccccaactt

SEQ ID NO: 1402 - DNA, 22 bp, Artificial Sequence
  Synthetic Construct
gtcagcaccatgtagcagatgt

SEQ ID NO: 1403 - DNA, 20 bp, Artificial Sequence
  Synthetic Construct
ccagcattggggcagcttct

SEQ ID NO: 1404 - DNA, 23 bp, Artificial Sequence
  Synthetic Construct
gccctttaaggaaccttgctaca

SEQ ID NO: 1405 - DNA, 21 bp, Artificial Sequence
  Synthetic Construct
tccaggtccactactgtgtca

SEQ ID NO: 1406 - DNA, 21 bp, Artificial Sequence
  Synthetic Construct
cccttgggtccctcttcttca

SEQ ID NO: 1407 - DNA, 20 bp, Artificial Sequence
  Synthetic Construct
ggcgggtattgtgcctgaca

SEQ ID NO: 1408 - DNA, 24 bp, Artificial Sequence
  Synthetic Construct
ccattctgccaaatttctgtgtgt

SEQ ID NO: 1409 - DNA, 24 bp, Artificial Sequence
  Synthetic Construct
ggggagcagaatggatttgtcact

SEQ ID NO: 1410 - DNA, 22 bp, Artificial Sequence
  Synthetic Construct
cagctactcaggcaaccacaga

SEQ ID NO: 1411 - DNA, 25 bp, Artificial Sequence
  Synthetic Construct
aggcagatcactaactggttctaag

SEQ ID NO: 1412 - DNA, 23 bp, Artificial Sequence
  Synthetic Construct
tcagtagagccttgaggtagctt

SEQ ID NO: 1413 - DNA, 21 bp, Artificial Sequence
  Synthetic Construct
cctgccctaccaacccacatt

SEQ ID NO: 1414 - DNA, 22 bp, Artificial Sequence
  Synthetic Construct
ccctctgcttttgctccagata

SEQ ID NO: 1415 - DNA, 24 bp, Artificial Sequence
  Synthetic Construct
aagccaagctaaatcttccctgaa

SEQ ID NO: 1416 - DNA, 19 bp, Artificial Sequence
  Synthetic Construct
aggccttcagcctgagaca

SEQ ID NO: 1417 - DNA, 20 bp, Artificial Sequence
  Synthetic Construct
tcttcctgggcacgttcttc

SEQ ID NO: 1418 - DNA, 22 bp, Artificial Sequence
  Synthetic Construct
gggatctctgcagcatgacttg

SEQ ID NO: 1419 - DNA, 23 bp, Artificial Sequence
  Synthetic Construct
tcaacacctttttcggtgacagt

SEQ ID NO: 1420 - DNA, 22 bp, Artificial Sequence
  Synthetic Construct
ccgcgctctacctcttgattta

SEQ ID NO: 1421 - DNA, 23 bp, Artificial Sequence
  Synthetic Construct
tctgttcttgaacatgccagtga

SEQ ID NO: 1422 - DNA, 20 bp, Artificial Sequence
  Synthetic Construct
gcagtaggtggagggtgttc

SEQ ID NO: 1423 - DNA, 22 bp, Artificial Sequence
  Synthetic Construct
agaccttcctggcttccttttg

SEQ ID NO: 1424 - DNA, 20 bp, Artificial Sequence
  Synthetic Construct
atgggcctgaggcagattgt

SEQ ID NO: 1425 - DNA, 22 bp, Artificial Sequence
  Synthetic Construct
gcaagaggaaagaccagcatca

SEQ ID NO: 1426 - DNA, 19 bp, Artificial Sequence
  Synthetic Construct
caaccctgggctggactgt

SEQ ID NO: 1427 - DNA, 20 bp, Artificial Sequence
  Synthetic Construct
cagccgcaaagagagcctaa

SEQ ID NO: 1428 - DNA, 26 bp, Artificial Sequence
  Synthetic Construct
gaacacaccaggtttctgcactagat

SEQ ID NO: 1429 - DNA, 20 bp, Artificial Sequence
  Synthetic Construct
ccccgctctctgtcccatca

SEQ ID NO: 1430 - DNA, 20 bp, Artificial Sequence
  Synthetic Construct
atcgggagtcacagcacttg

SEQ ID NO: 1431 - DNA, 26 bp, Artificial Sequence
  Synthetic Construct
ctgagagaggagtctatcttccttga

SEQ ID NO: 1432 - DNA, 21 bp, Artificial Sequence
  Synthetic Construct
ggccaagggtgaactggagaa

SEQ ID NO: 1433 - DNA, 20 bp, Artificial Sequence
  Synthetic Construct
ccccgccaggtactgtctca

SEQ ID NO: 1434 - DNA, 19 bp, Artificial Sequence
  Synthetic Construct
ggaccagggctgcgagaaa

SEQ ID NO: 1435 - DNA, 25 bp, Artificial Sequence
  Synthetic Construct
gtgggacatcttatgatccgcttag

SEQ ID NO: 1436 - DNA, 25 bp, Artificial Sequence
  Synthetic Construct
tgagtgtctaaacatgggcacatac

SEQ ID NO: 1437 - DNA, 20 bp, Artificial Sequence
  Synthetic Construct
agcctgccctaccccaatct

SEQ ID NO: 1438 - DNA, 25 bp, Artificial Sequence
  Synthetic Construct
tgactatttgactggtcctggtaac

SEQ ID NO: 1439 - DNA, 23 bp, Artificial Sequence
  Synthetic Construct
gggacttgaccttgcttccacaa

SEQ ID NO: 1440 - DNA, 20 bp, Artificial Sequence
  Synthetic Construct
aagtaccgccctcgtctgtt

SEQ ID NO: 1441 - DNA, 20 bp, Artificial Sequence
  Synthetic Construct
tgccatggcgtgttggatct

SEQ ID NO: 1442 - DNA, 21 bp, Artificial Sequence
  Synthetic Construct
agagacccttggcaggtgcat

SEQ ID NO: 1443 - DNA, 23 bp, Artificial Sequence
  Synthetic Construct
cacattagtctgggagcttggtt

SEQ ID NO: 1444 - DNA, 23 bp, Artificial Sequence
  Synthetic Construct
ccccagtactcaggggactttgt

SEQ ID NO: 1445 - DNA, 19 bp, Artificial Sequence
  Synthetic Construct
gatgggccatgtggcttct

SEQ ID NO: 1446 - DNA, 21 bp, Artificial Sequence
  Synthetic Construct
tctccccagtggagcttatgt

SEQ ID NO: 1447 - DNA, 20 bp, Artificial Sequence
  Synthetic Construct
caccaacaagctggctctga

SEQ ID NO: 1448 - DNA, 19 bp, Artificial Sequence
  Synthetic Construct
cggctccaagttcccacat

SEQ ID NO: 1449 - DNA, 21 bp, Artificial Sequence
  Synthetic Construct
tgtccaaggttgaggggttgt

SEQ ID NO: 1450 - DNA, 23 bp, Artificial Sequence
  Synthetic Construct
ctggaatggctgttaggcacctt

SEQ ID NO: 1451 - DNA, 27 bp, Artificial Sequence
  Synthetic Construct
gcacataactgtacctcctaagccata

SEQ ID NO: 1452 - DNA, 25 bp, Artificial Sequence
  Synthetic Construct
gggaaagcaatgctgtgtgtttatg

SEQ ID NO: 1453 - DNA, 21 bp, Artificial Sequence
  Synthetic Construct
tcccacagtcaggccaaccat

SEQ ID NO: 1454 - DNA, 21 bp, Artificial Sequence
  Synthetic Construct
acagctggacccagggaagtt

SEQ ID NO: 1455 - DNA, 22 bp, Artificial Sequence
  Synthetic Construct
cctggtggcataagggatgctt

SEQ ID NO: 1456 - DNA, 23 bp, Artificial Sequence
  Synthetic Construct
gatgttggtactcgcttctcagt

SEQ ID NO: 1457 - DNA, 25 bp, Artificial Sequence
  Synthetic Construct
gggttactaaagggcagttctgttc

SEQ ID NO: 1458 - DNA, 21 bp, Artificial Sequence
  Synthetic Construct
tcctaggctgaccagtgtcat

SEQ ID NO: 1459 - DNA, 21 bp, Artificial Sequence
  Synthetic Construct
gcctttccccagtccatttct

SEQ ID NO: 1460 - DNA, 21 bp, Artificial Sequence
  Synthetic Construct
tgtctttcaccagcccagact

SEQ ID NO: 1461 - DNA, 26 bp, Artificial Sequence
  Synthetic Construct
cgtgtgagaaaaacctctcctactac

SEQ ID NO: 1462 - DNA, 25 bp, Artificial Sequence
  Synthetic Construct
tgtccaacagctttacatagcacat

SEQ ID NO: 1463 - DNA, 21 bp, Artificial Sequence
  Synthetic Construct
cagaagcagtgagctgtggtt

SEQ ID NO: 1464 - DNA, 20 bp, Artificial Sequence
  Synthetic Construct
ctgggcctgcagaaatgcta

SEQ ID NO: 1465 - DNA, 22 bp, Artificial Sequence
  Synthetic Construct
cactgaggcgatgctctgatct

SEQ ID NO: 1466 - DNA, 24 bp, Artificial Sequence
  Synthetic Construct
tggcctccttctctaaaagcattc

SEQ ID NO: 1467 - DNA, 23 bp, Artificial Sequence
  Synthetic Construct
cactcacaactcctttcccaagt

SEQ ID NO: 1468 - DNA, 19 bp, Artificial Sequence
  Synthetic Construct
gcgtgggcaaagcctccat

SEQ ID NO: 1469 - DNA, 20 bp, Artificial Sequence
  Synthetic Construct
atccactgccctgaccttgt

SEQ ID NO: 1470 - DNA, 20 bp, Artificial Sequence
  Synthetic Construct
actccaaaccccacctgcta

SEQ ID NO: 1471 - DNA, 22 bp, Artificial Sequence
  Synthetic Construct
gggtcctaaccctcagtcttgt

SEQ ID NO: 1472 - DNA, 21 bp, Artificial Sequence
  Synthetic Construct
acagggctcctggttctaact

SEQ ID NO: 1473 - DNA, 23 bp, Artificial Sequence
  Synthetic Construct
ctctaggagcatgggtcaccaaa

SEQ ID NO: 1474 - DNA, 18 bp, Artificial Sequence
  Synthetic Construct
aagccggcaggctgagtt

SEQ ID NO: 1475 - DNA, 22 bp, Artificial Sequence
  Synthetic Construct
ggagccacaaggaatgcagagt

SEQ ID NO: 1476 - DNA, 20 bp, Artificial Sequence
  Synthetic Construct
caagaccctgccacctctct

SEQ ID NO: 1477 - DNA, 18 bp, Artificial Sequence
  Synthetic Construct
ggtgcagccttgctcact

SEQ ID NO: 1478 - DNA, 21 bp, Artificial Sequence
  Synthetic Construct
gcggaaggtggaagaaccttt

SEQ ID NO: 1479 - DNA, 24 bp, Artificial Sequence
  Synthetic Construct
gggcacactgaagtctagaagcaa

SEQ ID NO: 1480 - DNA, 21 bp, Artificial Sequence
  Synthetic Construct
tgggcccatctcttgactttc

SEQ ID NO: 1481 - DNA, 22 bp, Artificial Sequence
  Synthetic Construct
gaaggatgagcggatggctcta

SEQ ID NO: 1482 - DNA, 25 bp, Artificial Sequence
  Synthetic Construct
gcagtacttggggtcgtatatctgt

SEQ ID NO: 1483 - DNA, 21 bp, Artificial Sequence
  Synthetic Construct
tccacctacctgtgggcaatc

SEQ ID NO: 1484 - DNA, 21 bp, Artificial Sequence
  Synthetic Construct
cccgggtacaacagtgacctt

SEQ ID NO: 1485 - DNA, 22 bp, Artificial Sequence
  Synthetic Construct
tctcccggaaagtccggttcta

SEQ ID NO: 1486 - DNA, 22 bp, Artificial Sequence
  Synthetic Construct
cacccaagctctcactgttact

SEQ ID NO: 1487 - DNA, 19 bp, Artificial Sequence
  Synthetic Construct
gggccagctgaccaactac

SEQ ID NO: 1488 - DNA, 20 bp, Artificial Sequence
  Synthetic Construct
ctccctgaagcagcagcaaa

SEQ ID NO: 1489 - DNA, 22 bp, Artificial Sequence
  Synthetic Construct
gctgtcacactgaccctggatt

SEQ ID NO: 1490 - DNA, 20 bp, Artificial Sequence
  Synthetic Construct
gccatgctgagagcctctgt

SEQ ID NO: 1491 - DNA, 24 bp, Artificial Sequence
  Synthetic Construct
gtccacgtgtggaacatgtttatt

SEQ ID NO: 1492 - DNA, 24 bp, Artificial Sequence
  Synthetic Construct
gcaaggagctgatctcatctgtgt

SEQ ID NO: 1493 - DNA, 22 bp, Artificial Sequence
  Synthetic Construct
caaagggctccttccccacaaa

SEQ ID NO: 1494 - DNA, 20 bp, Artificial Sequence
  Synthetic Construct
gggaagcctttgagggttgt

SEQ ID NO: 1495 - DNA, 20 bp, Artificial Sequence
  Synthetic Construct
tctgcacccctgccctgtgt

SEQ ID NO: 1496 - DNA, 22 bp, Artificial Sequence
  Synthetic Construct
tccccagagtgcacaactcctt

SEQ ID NO: 1497 - DNA, 23 bp, Artificial Sequence
  Synthetic Construct
gtttggctgcacgtagagaaaag

SEQ ID NO: 1498 - DNA, 19 bp, Artificial Sequence
  Synthetic Construct
gttggcactggggccttct

SEQ ID NO: 1499 - DNA, 24 bp, Artificial Sequence
  Synthetic Construct
gactcagtcagtagagagggagaa

SEQ ID NO: 1500 - DNA, 20 bp, Artificial Sequence
  Synthetic Construct
cgtggggagggagaccactt

SEQ ID NO: 1501 - DNA, 25 bp, Artificial Sequence
  Synthetic Construct
tcttcttttgacagactgggaacat

SEQ ID NO: 1502 - DNA, 22 bp, Artificial Sequence
  Synthetic Construct
accttctgaggtttggggtaga

SEQ ID NO: 1503 - DNA, 22 bp, Artificial Sequence
  Synthetic Construct
tgtaaggctaagccgcattttg

SEQ ID NO: 1504 - DNA, 22 bp, Artificial Sequence
  Synthetic Construct
tgaccagaaccactcggacaga

SEQ ID NO: 1505 - DNA, 20 bp, Artificial Sequence
  Synthetic Construct
acaggcccactgccctgtct

SEQ ID NO: 1506 - DNA, 20 bp, Artificial Sequence
  Synthetic Construct
gctgacggctggaatcatct

SEQ ID NO: 1507 - DNA, 24 bp, Artificial Sequence
  Synthetic Construct
agctcaggtaaaaggtcaaagaca

SEQ ID NO: 1508 - DNA, 21 bp, Artificial Sequence
  Synthetic Construct
gcaggccagtaacgtcaattc

SEQ ID NO: 1509 - DNA, 22 bp, Artificial Sequence
  Synthetic Construct
agtgcttcaagcctgagattgt

SEQ ID NO: 1510 - DNA, 21 bp, Artificial Sequence
  Synthetic Construct
cccggttccctccttctccat

SEQ ID NO: 1511 - DNA, 22 bp, Artificial Sequence
  Synthetic Construct
ggtgaccgatggcactgaatgt

SEQ ID NO: 1512 - DNA, 22 bp, Artificial Sequence
  Synthetic Construct
caccctgatcacctgggaaaag

SEQ ID NO: 1513 - DNA, 21 bp, Artificial Sequence
  Synthetic Construct
tgctgtcagccactctacaca

SEQ ID NO: 1514 - DNA, 24 bp, Artificial Sequence
  Synthetic Construct
ttcccttaatgcaatggaggtcaa

SEQ ID NO: 1515 - DNA, 20 bp, Artificial Sequence
  Synthetic Construct
caagcttgctccctgacact

SEQ ID NO: 1516 - DNA, 20 bp, Artificial Sequence
  Synthetic Construct
aggcagtgccaggtcctgaa

SEQ ID NO: 1517 - DNA, 22 bp, Artificial Sequence
  Synthetic Construct
tccttccagggttcgtttgttt

SEQ ID NO: 1518 - DNA, 24 bp, Artificial Sequence
  Synthetic Construct
gcagttaccagggacattactgaa

SEQ ID NO: 1519 - DNA, 24 bp, Artificial Sequence
  Synthetic Construct
ggacctgaagtggatgagctttgt

SEQ ID NO: 1520 - DNA, 20 bp, Artificial Sequence
  Synthetic Construct
agccctggaccagattgaga

SEQ ID NO: 1521 - DNA, 24 bp, Artificial Sequence
  Synthetic Construct
gcagaaggagcacctctctccata

SEQ ID NO: 1522 - DNA, 20 bp, Artificial Sequence
  Synthetic Construct
gtcacagccatccagtgcaa

SEQ ID NO: 1523 - DNA, 20 bp, Artificial Sequence
  Synthetic Construct
gagcgagccttgccttgtta

SEQ ID NO: 1524 - DNA, 22 bp, Artificial Sequence
  Synthetic Construct
aaggctagagtgggaactgact

SEQ ID NO: 1525 - DNA, 23 bp, Artificial Sequence
  Synthetic Construct
acattgttcatggaggagtgcaa

SEQ ID NO: 1526 - DNA, 24 bp, Artificial Sequence
  Synthetic Construct
gagggaaactgaagatggagcttt

SEQ ID NO: 1527 - DNA, 19 bp, Artificial Sequence
  Synthetic Construct
caagggctggggctcacat

SEQ ID NO: 1528 - DNA, 20 bp, Artificial Sequence
  Synthetic Construct
cagacacagtcagcgtccat

SEQ ID NO: 1529 - DNA, 23 bp, Artificial Sequence
  Synthetic Construct
tgttcttcagaatgtgccgtttc

SEQ ID NO: 1530 - DNA, 23 bp, Artificial Sequence
  Synthetic Construct
ctgcaaaaatcctgacccagtct

SEQ ID NO: 1531 - DNA, 20 bp, Artificial Sequence
  Synthetic Construct
ccaccttgttggctctgagt

SEQ ID NO: 1532 - DNA, 20 bp, Artificial Sequence
  Synthetic Construct
cctggagcggctgtctcata

SEQ ID NO: 1533 - DNA, 27 bp, Artificial Sequence
  Synthetic Construct
cagtctgtctgaacccatttacaccaa

SEQ ID NO: 1534 - DNA, 24 bp, Artificial Sequence
  Synthetic Construct
cagtgtgagtgctgagaaacaaag

SEQ ID NO: 1535 - DNA, 22 bp, Artificial Sequence
  Synthetic Construct
cacccctgggaaggatggaaat

SEQ ID NO: 1536 - DNA, 18 bp, Artificial Sequence
  Synthetic Construct
agggctgcatgccacaga

SEQ ID NO: 1537 - DNA, 23 bp, Artificial Sequence
  Synthetic Construct
cctgtactcccttccctggtatc

SEQ ID NO: 1538 - DNA, 19 bp, Artificial Sequence
  Synthetic Construct
tctctgtgccaggctgtgt

SEQ ID NO: 1539 - DNA, 22 bp, Artificial Sequence
  Synthetic Construct
tctgagacttcctcccttgtga

SEQ ID NO: 1540 - DNA, 24 bp, Artificial Sequence
  Synthetic Construct
cctcatggtcggtcttggtgactt

SEQ ID NO: 1541 - DNA, 19 bp, Artificial Sequence
  Synthetic Construct
agacggagagcccctgttg

SEQ ID NO: 1542 - DNA, 24 bp, Artificial Sequence
  Synthetic Construct
catgggtacaagctccaattcctt

SEQ ID NO: 1543 - DNA, 24 bp, Artificial Sequence
  Synthetic Construct
gagggaaagggttggggaaaaatc

SEQ ID NO: 1544 - DNA, 24 bp, Artificial Sequence
  Synthetic Construct
gcactagaaagggaaggaactaca

SEQ ID NO: 1545 - DNA, 22 bp, Artificial Sequence
  Synthetic Construct
gaggtaagccttgggcatttct

SEQ ID NO: 1546 - DNA, 21 bp, Artificial Sequence
  Synthetic Construct
gtgaggtgatgggcagactac

SEQ ID NO: 1547 - DNA, 22 bp, Artificial Sequence
  Synthetic Construct
ccttaccagcaggccttcacaa

SEQ ID NO: 1548 - DNA, 22 bp, Artificial Sequence
  Synthetic Construct
tacccacccacccagtcccatt

SEQ ID NO: 1549 - DNA, 23 bp, Artificial Sequence
  Synthetic Construct
cgaacttgctgggagtgtagaac

SEQ ID NO: 1550 - DNA, 22 bp, Artificial Sequence
  Synthetic Construct
ctgtggtccttggtgtcagaga

SEQ ID NO: 1551 - DNA, 22 bp, Artificial Sequence
  Synthetic Construct
ccaaggggctacagtgacaaca

SEQ ID NO: 1552 - DNA, 22 bp, Artificial Sequence
  Synthetic Construct
cagcagtgtggcctttctctac

SEQ ID NO: 1553 - DNA, 20 bp, Artificial Sequence
  Synthetic Construct
tgccacacggagcttgtttc

SEQ ID NO: 1554 - DNA, 25 bp, Artificial Sequence
  Synthetic Construct
caccatgtacttgcactctcagaaa

SEQ ID NO: 1555 - DNA, 20 bp, Artificial Sequence
  Synthetic Construct
cgccaacgtggctgatgttt

SEQ ID NO: 1556 - DNA, 22 bp, Artificial Sequence
  Synthetic Construct
cctggccttactcttcctgagt

SEQ ID NO: 1557 - DNA, 23 bp, Artificial Sequence
  Synthetic Construct
gacttcctgcaagcatttcaaca

SEQ ID NO: 1558 - DNA, 21 bp, Artificial Sequence
  Synthetic Construct
tcaagccaggagacccataca

SEQ ID NO: 1559 - DNA, 22 bp, Artificial Sequence
  Synthetic Construct
cccggaagcactagctcgtaag

SEQ ID NO: 1560 - DNA, 21 bp, Artificial Sequence
  Synthetic Construct
cgctcgcagctttgactgtag

SEQ ID NO: 1561 - DNA, 22 bp, Artificial Sequence
  Synthetic Construct
gcgtctggtctgtgagggtaga

SEQ ID NO: 1562 - DNA, 23 bp, Artificial Sequence
  Synthetic Construct
gagcgtggagagaaaagcaatgt

SEQ ID NO: 1563 - DNA, 21 bp, Artificial Sequence
  Synthetic Construct
cgataagcccgtgttcctgtt

SEQ ID NO: 1564 - DNA, 21 bp, Artificial Sequence
  Synthetic Construct
acgctggatctccaggacact

SEQ ID NO: 1565 - DNA, 24 bp, Artificial Sequence
  Synthetic Construct
caccctcttccctgttaaaggatt

SEQ ID NO: 1566 - DNA, 25 bp, Artificial Sequence
  Synthetic Construct
gctgattctgtgcaaagtccagtgt

SEQ ID NO: 1567 - DNA, 22 bp, Artificial Sequence
  Synthetic Construct
cgatgaaaggctgggagctgaa

SEQ ID NO: 1568 - DNA, 20 bp, Artificial Sequence
  Synthetic Construct
ccggccactggctgctatac

SEQ ID NO: 1569 - DNA, 22 bp, Artificial Sequence
  Synthetic Construct
ctctgcatgtggagcaaaccaa

SEQ ID NO: 1570 - DNA, 21 bp, Artificial Sequence
  Synthetic Construct
aggtaaggggaggctgcagaa

SEQ ID NO: 1571 - DNA, 23 bp, Artificial Sequence
  Synthetic Construct
gctagataatgctgcctgctttg

SEQ ID NO: 1572 - DNA, 26 bp, Artificial Sequence
  Synthetic Construct
ctgaaaagatcactaccaggatgcta

SEQ ID NO: 1573 - DNA, 22 bp, Artificial Sequence
  Synthetic Construct
agacaacagcgttgcttgagta

SEQ ID NO: 1574 - DNA, 23 bp, Artificial Sequence
  Synthetic Construct
agggagagcctctgatgaaaagt

SEQ ID NO: 1575 - DNA, 22 bp, Artificial Sequence
  Synthetic Construct
ccagtgtaggctcacattctgt

SEQ ID NO: 1576 - DNA, 22 bp, Artificial Sequence
  Synthetic Construct
cccaggagtctctgtccattgt

SEQ ID NO: 1577 - DNA, 22 bp, Artificial Sequence
  Synthetic Construct
tcctggtgtggacgtgtctcat

SEQ ID NO: 1578 - DNA, 22 bp, Artificial Sequence
  Synthetic Construct
cgtcaggggtcccttctttttg

SEQ ID NO: 1579 - DNA, 24 bp, Artificial Sequence
  Synthetic Construct
gccagagccttcatttgggagaaa

SEQ ID NO: 1580 - DNA, 19 bp, Artificial Sequence
  Synthetic Construct
tgggcctcctccagccttt

SEQ ID NO: 1581 - DNA, 23 bp, Artificial Sequence
  Synthetic Construct
gttttcccaggcctctcttcttc

SEQ ID NO: 1582 - DNA, 23 bp, Artificial Sequence
  Synthetic Construct
gggatgtacccaaaggcttctct

SEQ ID NO: 1583 - DNA, 22 bp, Artificial Sequence
  Synthetic Construct
ggtgcttcacagggttcacagt

SEQ ID NO: 1584 - DNA, 20 bp, Artificial Sequence
  Synthetic Construct
agccagcaggtgccattcat

SEQ ID NO: 1585 - DNA, 23 bp, Artificial Sequence
  Synthetic Construct
gggaagtaaacatcccagcttca

SEQ ID NO: 1586 - DNA, 21 bp, Artificial Sequence
  Synthetic Construct
gcagttctccctgcaggcttt

SEQ ID NO: 1587 - DNA, 27 bp, Artificial Sequence
  Synthetic Construct
cttcccgtattgctaaggaactattct

SEQ ID NO: 1588 - DNA, 22 bp, Artificial Sequence
  Synthetic Construct
ctgtgcagcagaggcagttatg

SEQ ID NO: 1589 - DNA, 21 bp, Artificial Sequence
  Synthetic Construct
gggcctcgaaaggcagaaatc

SEQ ID NO: 1590 - DNA, 22 bp, Artificial Sequence
  Synthetic Construct
gcatccatccgggcagttttca

SEQ ID NO: 1591 - DNA, 26 bp, Artificial Sequence
  Synthetic Construct
gaagagcaggagctacttctatccat

SEQ ID NO: 1592 - DNA, 24 bp, Artificial Sequence
  Synthetic Construct
gaccccagactcagtcagtagatg

SEQ ID NO: 1593 - DNA, 24 bp, Artificial Sequence
  Synthetic Construct
caaactggaaaccatacccacttc

SEQ ID NO: 1594 - DNA, 20 bp, Artificial Sequence
  Synthetic Construct
tggggctccaccagccagaa

SEQ ID NO: 1595 - DNA, 22 bp, Artificial Sequence
  Synthetic Construct
gcgtctaacagcctcacccaat

SEQ ID NO: 1596 - DNA, 21 bp, Artificial Sequence
  Synthetic Construct
ctggtgggagtgggcttattt

SEQ ID NO: 1597 - DNA, 28 bp, Artificial Sequence
  Synthetic Construct
gcaagtgttatcagaagtccaccttagt

SEQ ID NO: 1598 - DNA, 24 bp, Artificial Sequence
  Synthetic Construct
tgagccaaagactttccctgtatt

SEQ ID NO: 1599 - DNA, 20 bp, Artificial Sequence
  Synthetic Construct
gccagacgcaggcctagtaa

SEQ ID NO: 1600 - DNA, 20 bp, Artificial Sequence
  Synthetic Construct
tggccacgtcctctccacta

SEQ ID NO: 1601 - DNA, 24 bp, Artificial Sequence
  Synthetic Construct
acagcaggcttaatcctagaggta

SEQ ID NO: 1602 - DNA, 24 bp, Artificial Sequence
  Synthetic Construct
cccagagttgcagtaggacacagt

SEQ ID NO: 1603 - DNA, 19 bp, Artificial Sequence
  Synthetic Construct
ctgcttgccccgacctctt

SEQ ID NO: 1604 - DNA, 19 bp, Artificial Sequence
  Synthetic Construct
tgcccggctcagtttgaat

SEQ ID NO: 1605 - DNA, 23 bp, Artificial Sequence
  Synthetic Construct
ctgccttagggatctgggtgatg

SEQ ID NO: 1606 - DNA, 22 bp, Artificial Sequence
  Synthetic Construct
ggctttggaaggagccatctgt

SEQ ID NO: 1607 - DNA, 20 bp, Artificial Sequence
  Synthetic Construct
ccagcttcagtgtgcaccaa

SEQ ID NO: 1608 - DNA, 25 bp, Artificial Sequence
  Synthetic Construct
cctgagagctgtactgttgctcgaa

SEQ ID NO: 1609 - DNA, 21 bp, Artificial Sequence
  Synthetic Construct
tttcctcactgggtgggatct

SEQ ID NO: 1610 - DNA, 20 bp, Artificial Sequence
  Synthetic Construct
gcgggcaattccacatctga

SEQ ID NO: 1611 - DNA, 22 bp, Artificial Sequence
  Synthetic Construct
ccaactcagggcaagtggttct

SEQ ID NO: 1612 - DNA, 26 bp, Artificial Sequence
  Synthetic Construct
ggttgcaaagtactgtgggaataaag

SEQ ID NO: 1613 - DNA, 22 bp, Artificial Sequence
  Synthetic Construct
gaggacttgggcctttcctatc

SEQ ID NO: 1614 - DNA, 19 bp, Artificial Sequence
  Synthetic Construct
tctgcgatgcgttcctgtt

SEQ ID NO: 1615 - DNA, 20 bp, Artificial Sequence
  Synthetic Construct
gtgaagcttgggctggtttg

SEQ ID NO: 1616 - DNA, 24 bp, Artificial Sequence
  Synthetic Construct
ccatacaaagcaagagtgggaagt

SEQ ID NO: 1617 - DNA, 22 bp, Artificial Sequence
  Synthetic Construct
gggaggggtttccccactaaga

SEQ ID NO: 1618 - DNA, 23 bp, Artificial Sequence
  Synthetic Construct
catcttccaatgtggagctgtca

SEQ ID NO: 1619 - DNA, 19 bp, Artificial Sequence
  Synthetic Construct
cagccgctgactgcctcat

SEQ ID NO: 1620 - DNA, 21 bp, Artificial Sequence
  Synthetic Construct
cgaaaaggggatggtgctttc

SEQ ID NO: 1621 - DNA, 20 bp, Artificial Sequence
  Synthetic Construct
cccctgctggtggtctgttc

SEQ ID NO: 1622 - DNA, 19 bp, Artificial Sequence
  Synthetic Construct
gggcctgggttctccttct

SEQ ID NO: 1623 - DNA, 22 bp, Artificial Sequence
  Synthetic Construct
cagtgcctgtggttctcacact

SEQ ID NO: 1624 - DNA, 23 bp, Artificial Sequence
  Synthetic Construct
gcttacactgacgctgcaactga

SEQ ID NO: 1625 - DNA, 19 bp, Artificial Sequence
  Synthetic Construct
tgccctgcacctctgatct

SEQ ID NO: 1626 - DNA, 20 bp, Artificial Sequence
  Synthetic Construct
ggaggccaccacacctccta

SEQ ID NO: 1627 - DNA, 21 bp, Artificial Sequence
  Synthetic Construct
tctcagccgactcagatcact

SEQ ID NO: 1628 - DNA, 22 bp, Artificial Sequence
  Synthetic Construct
cattctggagtgtgggtggatt

SEQ ID NO: 1629 - DNA, 22 bp, Artificial Sequence
  Synthetic Construct
acggtgaaaaatgaggctgtgt

SEQ ID NO: 1630 - DNA, 19 bp, Artificial Sequence
  Synthetic Construct
ggggacaggaggcatgaga

SEQ ID NO: 1631 - DNA, 20 bp, Artificial Sequence
  Synthetic Construct
tgccactgcgtcatctgtga

SEQ ID NO: 1632 - DNA, 19 bp, Artificial Sequence
  Synthetic Construct
ggcgcctggggacttcatt

SEQ ID NO: 1633 - DNA, 22 bp, Artificial Sequence
  Synthetic Construct
ctctggccccacaaatcaatgt

SEQ ID NO: 1634 - DNA, 24 bp, Artificial Sequence
  Synthetic Construct
accctgtccccaataccctgtatc

SEQ ID NO: 1635 - DNA, 24 bp, Artificial Sequence
  Synthetic Construct
gcctgacctatgaccttcagtaac

SEQ ID NO: 1636 - DNA, 20 bp, Artificial Sequence
  Synthetic Construct
ggagccaccatgacgactgt

SEQ ID NO: 1637 - DNA, 24 bp, Artificial Sequence
  Synthetic Construct
cctgagccctaacaatgatccaaa

SEQ ID NO: 1638 - DNA, 18 bp, Artificial Sequence
  Synthetic Construct
tgagcctcctgcctgcta

SEQ ID NO: 1639 - DNA, 18 bp, Artificial Sequence
  Synthetic Construct
gtgccctttggccaccat

SEQ ID NO: 1640 - DNA, 21 bp, Artificial Sequence
  Synthetic Construct
gctggatgggcagacaggaaa

SEQ ID NO: 1641 - DNA, 19 bp, Artificial Sequence
  Synthetic Construct
acacggccgtccagtcagt

SEQ ID NO: 1642 - DNA, 20 bp, Artificial Sequence
  Synthetic Construct
tgcgtgacaaggggcaagat

SEQ ID NO: 1643 - DNA, 21 bp, Artificial Sequence
  Synthetic Construct
ccaccaggactcgggtcttct

SEQ ID NO: 1644 - DNA, 24 bp, Artificial Sequence
  Synthetic Construct
ggacctccctggatgaagatgaga

SEQ ID NO: 1645 - DNA, 20 bp, Artificial Sequence
  Synthetic Construct
ggggacaccgatgggagaca

SEQ ID NO: 1646 - DNA, 21 bp, Artificial Sequence
  Synthetic Construct
gtggaatgcaggactgtgtct

SEQ ID NO: 1647 - DNA, 23 bp, Artificial Sequence
  Synthetic Construct
ccagaccccttgactctatccaa

SEQ ID NO: 1648 - DNA, 20 bp, Artificial Sequence
  Synthetic Construct
tccacttcagctgcgccaaa

SEQ ID NO: 1649 - DNA, 22 bp, Artificial Sequence
  Synthetic Construct
gtgtgtgatttggcccggatct

SEQ ID NO: 1650 - DNA, 20 bp, Artificial Sequence
  Synthetic Construct
agaagggatcaccccacctt

SEQ ID NO: 1651 - DNA, 24 bp, Artificial Sequence
  Synthetic Construct
ctccgcctcaagtaccttgaattt

SEQ ID NO: 1652 - DNA, 22 bp, Artificial Sequence
  Synthetic Construct
gcttggactcatggtacacgtt

SEQ ID NO: 1653 - DNA, 25 bp, Artificial Sequence
  Synthetic Construct
catcgccactacaattcacctctga

SEQ ID NO: 1654 - DNA, 22 bp, Artificial Sequence
  Synthetic Construct
ctcccttgccactttcctctga

SEQ ID NO: 1655 - DNA, 22 bp, Artificial Sequence
  Synthetic Construct
gccaacaccttgatggcaggtt

SEQ ID NO: 1656 - DNA, 23 bp, Artificial Sequence
  Synthetic Construct
gttatcccatcgattccctgcat

SEQ ID NO: 1657 - DNA, 18 bp, Artificial Sequence
  Synthetic Construct
tgcgaggcagagcacgtt

SEQ ID NO: 1658 - DNA, 24 bp, Artificial Sequence
  Synthetic Construct
ggggatgggttacaatgtatgtct

SEQ ID NO: 1659 - DNA, 23 bp, Artificial Sequence
  Synthetic Construct
gattggggaatgcagcttacaga

SEQ ID NO: 1660 - DNA, 21 bp, Artificial Sequence
  Synthetic Construct
caggctttggggcaacagaga

SEQ ID NO: 1661 - DNA, 21 bp, Artificial Sequence
  Synthetic Construct
ggggcatctgccttctggaat

SEQ ID NO: 1662 - DNA, 22 bp, Artificial Sequence
  Synthetic Construct
cactagagccagctcggaatac

SEQ ID NO: 1663 - DNA, 24 bp, Artificial Sequence
  Synthetic Construct
cggattctcagagagcaagcgtaa

SEQ ID NO: 1664 - DNA, 18 bp, Artificial Sequence
  Synthetic Construct
gctgcacccttggagcat

SEQ ID NO: 1665 - DNA, 21 bp, Artificial Sequence
  Synthetic Construct
tttccgtgccctgaccactct

SEQ ID NO: 1666 - DNA, 22 bp, Artificial Sequence
  Synthetic Construct
gctttcagggtggtgagtgagt

SEQ ID NO: 1667 - DNA, 26 bp, Artificial Sequence
  Synthetic Construct
gccagaggacatatttccaagcaatc

SEQ ID NO: 1668 - DNA, 22 bp, Artificial Sequence
  Synthetic Construct
cacagactcacacgggtgttca

SEQ ID NO: 1669 - DNA, 22 bp, Artificial Sequence
  Synthetic Construct
ccctcaggcaaaatcccataca

SEQ ID NO: 1670 - DNA, 24 bp, Artificial Sequence
  Synthetic Construct
ctctctgtccctctggagtaagaa

SEQ ID NO: 1671 - DNA, 24 bp, Artificial Sequence
  Synthetic Construct
tctctgactaccatcttccactgt

SEQ ID NO: 1672 - DNA, 22 bp, Artificial Sequence
  Synthetic Construct
cgcagcaccatagtcacagcaa

SEQ ID NO: 1673 - DNA, 21 bp, Artificial Sequence
  Synthetic Construct
gccttggatgatggagcaagt

SEQ ID NO: 1674 - DNA, 24 bp, Artificial Sequence
  Synthetic Construct
gtctccaaactgtcctttcctcaa

SEQ ID NO: 1675 - DNA, 22 bp, Artificial Sequence
  Synthetic Construct
aagtgagggctgcaaggagtca

SEQ ID NO: 1676 - DNA, 20 bp, Artificial Sequence
  Synthetic Construct
acgtggtgatctgggagaga

SEQ ID NO: 1677 - DNA, 19 bp, Artificial Sequence
  Synthetic Construct
aggccgaggagctggactt

SEQ ID NO: 1678 - DNA, 24 bp, Artificial Sequence
  Synthetic Construct
caaggtgtgcccaatccaactatc

SEQ ID NO: 1679 - DNA, 19 bp, Artificial Sequence
  Synthetic Construct
ggtggtggtccctcagtct

SEQ ID NO: 1680 - DNA, 19 bp, Artificial Sequence
  Synthetic Construct
aagggcacggccagtaaac

SEQ ID NO: 1681 - DNA, 20 bp, Artificial Sequence
  Synthetic Construct
agcctggggcctgggaatta

SEQ ID NO: 1682 - DNA, 20 bp, Artificial Sequence
  Synthetic Construct
caccgtggctgtgtggagat

SEQ ID NO: 1683 - DNA, 22 bp, Artificial Sequence
  Synthetic Construct
tggagagatgggctctccttag

SEQ ID NO: 1684 - DNA, 24 bp, Artificial Sequence
  Synthetic Construct
ctgcattacctgccctacctatct

SEQ ID NO: 1685 - DNA, 20 bp, Artificial Sequence
  Synthetic Construct
ccctgcgggacttgtggtaa

SEQ ID NO: 1686 - DNA, 23 bp, Artificial Sequence
  Synthetic Construct
cagtggtgtccctaaagcactct

SEQ ID NO: 1687 - DNA, 23 bp, Artificial Sequence
  Synthetic Construct
acggggctgctataaggattaag

SEQ ID NO: 1688 - DNA, 24 bp, Artificial Sequence
  Synthetic Construct
cgacagaggctgtgaatccccaaa

SEQ ID NO: 1689 - DNA, 22 bp, Artificial Sequence
  Synthetic Construct
gccactgatccaggtgacttct

SEQ ID NO: 1690 - DNA, 22 bp, Artificial Sequence
  Synthetic Construct
gccagctcgacagtttcttaca

SEQ ID NO: 1691 - DNA, 20 bp, Artificial Sequence
  Synthetic Construct
agtgggatggggctgctgtt

SEQ ID NO: 1692 - DNA, 23 bp, Artificial Sequence
  Synthetic Construct
gcagagtcccttggtggtgtaag

SEQ ID NO: 1693 - DNA, 21 bp, Artificial Sequence
  Synthetic Construct
caggcccacattctccacaga

SEQ ID NO: 1694 - DNA, 22 bp, Artificial Sequence
  Synthetic Construct
tgcaaacatggacgggtttgat

SEQ ID NO: 1695 - DNA, 24 bp, Artificial Sequence
  Synthetic Construct
gtgttgcagcactaaaacatcaca

SEQ ID NO: 1696 - DNA, 24 bp, Artificial Sequence
  Synthetic Construct
acaaagggaaatccaatggtcact

SEQ ID NO: 1697 - DNA, 20 bp, Artificial Sequence
  Synthetic Construct
gctgggaagctctgcctcaa

SEQ ID NO: 1698 - DNA, 21 bp, Artificial Sequence
  Synthetic Construct
tgggaagtccacccactccaa

SEQ ID NO: 1699 - DNA, 22 bp, Artificial Sequence
  Synthetic Construct
ccacggaggaagaaccagaagt

SEQ ID NO: 1700 - DNA, 20 bp, Artificial Sequence
  Synthetic Construct
atcacccggaggacccatgt

SEQ ID NO: 1701 - DNA, 21 bp, Artificial Sequence
  Synthetic Construct
aggggcctaagtgggctcttc

SEQ ID NO: 1702 - DNA, 22 bp, Artificial Sequence
  Synthetic Construct
gaaaaacgggttagggcagaga

SEQ ID NO: 1703 - DNA, 20 bp, Artificial Sequence
  Synthetic Construct
cggaatgggatgccttggaa

SEQ ID NO: 1704 - DNA, 18 bp, Artificial Sequence
  Synthetic Construct
cactgtcccgctgcagat

SEQ ID NO: 1705 - DNA, 24 bp, Artificial Sequence
  Synthetic Construct
tgtcacagatcagttggtgaatgt

SEQ ID NO: 1706 - DNA, 21 bp, Artificial Sequence
  Synthetic Construct
ccaggacccgagatggtctgt

SEQ ID NO: 1707 - DNA, 23 bp, Artificial Sequence
  Synthetic Construct
agagaccaagggcttctctctaa

SEQ ID NO: 1708 - DNA, 23 bp, Artificial Sequence
  Synthetic Construct
gagggaggtgaatccacgagaga

SEQ ID NO: 1709 - DNA, 20 bp, Artificial Sequence
  Synthetic Construct
agggccaccacggtgagaaa

SEQ ID NO: 1710 - DNA, 22 bp, Artificial Sequence
  Synthetic Construct
agagagccatcctcccttccaa

SEQ ID NO: 1711 - DNA, 23 bp, Artificial Sequence
  Synthetic Construct
acttctgagcaagtgtgatgtga

SEQ ID NO: 1712 - DNA, 22 bp, Artificial Sequence
  Synthetic Construct
ggcgacagttcctctggactta

SEQ ID NO: 1713 - DNA, 22 bp, Artificial Sequence
  Synthetic Construct
cagattggcgacccacccttat

SEQ ID NO: 1714 - DNA, 24 bp, Artificial Sequence
  Synthetic Construct
ggcctttcctaagctgatggttga

SEQ ID NO: 1715 - DNA, 24 bp, Artificial Sequence
  Synthetic Construct
gctggcatctaatgctgccatgtt

SEQ ID NO: 1716 - DNA, 22 bp, Artificial Sequence
  Synthetic Construct
gctgctcagagagaaactgcat

SEQ ID NO: 1717 - DNA, 22 bp, Artificial Sequence
  Synthetic Construct
gatccgcctgagaaggaacaag

SEQ ID NO: 1718 - DNA, 22 bp, Artificial Sequence
  Synthetic Construct
atgccctcgagaccagctagaa

SEQ ID NO: 1719 - DNA, 21 bp, Artificial Sequence
  Synthetic Construct
gaggtttggggtgcgaatgat

SEQ ID NO: 1720 - DNA, 22 bp, Artificial Sequence
  Synthetic Construct
gcagaagttgctggttctgttt

SEQ ID NO: 1721 - DNA, 20 bp, Artificial Sequence
  Synthetic Construct
gggcagaggcaggaccattg

SEQ ID NO: 1722 - DNA, 24 bp, Artificial Sequence
  Synthetic Construct
gctggtattttcgtttctgcatgt

SEQ ID NO: 1723 - DNA, 19 bp, Artificial Sequence
  Synthetic Construct
ttgcccctcctcccctcaa

SEQ ID NO: 1724 - DNA, 23 bp, Artificial Sequence
  Synthetic Construct
acatgcctacacccaaagtcatc

SEQ ID NO: 1725 - DNA, 20 bp, Artificial Sequence
  Synthetic Construct
tgcctggaggaaggaagtca

SEQ ID NO: 1726 - DNA, 23 bp, Artificial Sequence
  Synthetic Construct
ccttccctctggattttgggttt

SEQ ID NO: 1727 - DNA, 20 bp, Artificial Sequence
  Synthetic Construct
agctcctcacccagcctcaa

SEQ ID NO: 1728 - DNA, 21 bp, Artificial Sequence
  Synthetic Construct
acacctgtggaccatgtctga

SEQ ID NO: 1729 - DNA, 22 bp, Artificial Sequence
  Synthetic Construct
gccccaggtatgcttgaccatt

SEQ ID NO: 1730 - DNA, 20 bp, Artificial Sequence
  Synthetic Construct
acccagcaacccacgaaatc

SEQ ID NO: 1731 - DNA, 25 bp, Artificial Sequence
  Synthetic Construct
ggagaccagaacatgacactccaat

SEQ ID NO: 1732 - DNA, 20 bp, Artificial Sequence
  Synthetic Construct
ctgggcaccttgcagctttt

SEQ ID NO: 1733 - DNA, 21 bp, Artificial Sequence
  Synthetic Construct
aggccctgtttccctggaatg

SEQ ID NO: 1734 - DNA, 21 bp, Artificial Sequence
  Synthetic Construct
atctgccgagccaggtcactt

SEQ ID NO: 1735 - DNA, 21 bp, Artificial Sequence
  Synthetic Construct
ggttttgcccaccacctctga

SEQ ID NO: 1736 - DNA, 23 bp, Artificial Sequence
  Synthetic Construct
aaggttgtgctttctctcgctat

SEQ ID NO: 1737 - DNA, 22 bp, Artificial Sequence
  Synthetic Construct
ccttagctcggtcgcctaaact

SEQ ID NO: 1738 - DNA, 23 bp, Artificial Sequence
  Synthetic Construct
cccactatggcaaagatccatca

SEQ ID NO: 1739 - DNA, 20 bp, Artificial Sequence
  Synthetic Construct
tggcacccagtcatctgcta

SEQ ID NO: 1740 - DNA, 23 bp, Artificial Sequence
  Synthetic Construct
catccccgtgtttcaaaggaaag

SEQ ID NO: 1741 - DNA, 23 bp, Artificial Sequence
  Synthetic Construct
aaggacgtacaatttcggagtca

SEQ ID NO: 1742 - DNA, 21 bp, Artificial Sequence
  Synthetic Construct
tccttccctagctgggccttt

SEQ ID NO: 1743 - DNA, 19 bp, Artificial Sequence
  Synthetic Construct
ggggcgataggcacacaca

SEQ ID NO: 1744 - DNA, 22 bp, Artificial Sequence
  Synthetic Construct
ctgacataggtggctggagtga

SEQ ID NO: 1745 - DNA, 22 bp, Artificial Sequence
  Synthetic Construct
ccgcagacagagaagcagtcta

SEQ ID NO: 1746 - DNA, 20 bp, Artificial Sequence
  Synthetic Construct
gactgccgcagctcttgtaa

SEQ ID NO: 1747 - DNA, 22 bp, Artificial Sequence
  Synthetic Construct
gccatggtttagggtcctggat

SEQ ID NO: 1748 - DNA, 20 bp, Artificial Sequence
  Synthetic Construct
ctccccgggtagagcagtga

SEQ ID NO: 1749 - DNA, 22 bp, Artificial Sequence
  Synthetic Construct
cactggggcttccctttacgat

SEQ ID NO: 1750 - DNA, 22 bp, Artificial Sequence
  Synthetic Construct
ccgatggccaaaggctctcaaa

SEQ ID NO: 1751 - DNA, 21 bp, Artificial Sequence
  Synthetic Construct
acacacttcatcacgccttgt

SEQ ID NO: 1752 - DNA, 24 bp, Artificial Sequence
  Synthetic Construct
tccttgatctcccactccattttc

SEQ ID NO: 1753 - DNA, 20 bp, Artificial Sequence
  Synthetic Construct
acctggctggccacttctca

SEQ ID NO: 1754 - DNA, 19 bp, Artificial Sequence
  Synthetic Construct
acctgcctgcctcgtgttc

SEQ ID NO: 1755 - DNA, 20 bp, Artificial Sequence
  Synthetic Construct
aagtctcagggccactccat

SEQ ID NO: 1756 - DNA, 21 bp, Artificial Sequence
  Synthetic Construct
atcaggcccagagagacatga

SEQ ID NO: 1757 - DNA, 22 bp, Artificial Sequence
  Synthetic Construct
ggatgaggggctggcttcatac

SEQ ID NO: 1758 - DNA, 19 bp, Artificial Sequence
  Synthetic Construct
accccagggaagcaagcat

SEQ ID NO: 1759 - DNA, 18 bp, Artificial Sequence
  Synthetic Construct
cgcgtggctgcttgagaa

SEQ ID NO: 1760 - DNA, 23 bp, Artificial Sequence
  Synthetic Construct
agctcaagggaagatgtctccta

SEQ ID NO: 1761 - DNA, 23 bp, Artificial Sequence
  Synthetic Construct
gccctcctcaaagttaggactga

SEQ ID NO: 1762 - DNA, 22 bp, Artificial Sequence
  Synthetic Construct
tcgccctagccctggaaattca

SEQ ID NO: 1763 - DNA, 20 bp, Artificial Sequence
  Synthetic Construct
gggcagtgtccgcaaagttc

SEQ ID NO: 1764 - DNA, 22 bp, Artificial Sequence
  Synthetic Construct
agactccgtcaccctccacaat

SEQ ID NO: 1765 - DNA, 21 bp, Artificial Sequence
  Synthetic Construct
ttgtagccgttccaagagcaa

SEQ ID NO: 1766 - DNA, 24 bp, Artificial Sequence
  Synthetic Construct
ccagaaaacctgtaggcaagatgt

SEQ ID NO: 1767 - DNA, 20 bp, Artificial Sequence
  Synthetic Construct
cgactcacccgctcagcaaa

SEQ ID NO: 1768 - DNA, 19 bp, Artificial Sequence
  Synthetic Construct
ctgccaggcctctctcaca

SEQ ID NO: 1769 - DNA, 20 bp, Artificial Sequence
  Synthetic Construct
cctgtccctgagccctctgt

SEQ ID NO: 1770 - DNA, 20 bp, Artificial Sequence
  Synthetic Construct
acggctggtccttccagtca

SEQ ID NO: 1771 - DNA, 21 bp, Artificial Sequence
  Synthetic Construct
ctcgagcctttgtggacatct

SEQ ID NO: 1772 - DNA, 20 bp, Artificial Sequence
  Synthetic Construct
catgcacactctgcctcgaa

SEQ ID NO: 1773 - DNA, 24 bp, Artificial Sequence
  Synthetic Construct
gccaaatcacctccatcactcaag

SEQ ID NO: 1774 - DNA, 23 bp, Artificial Sequence
  Synthetic Construct
cggacaccaactgtcttgttttg

SEQ ID NO: 1775 - DNA, 20 bp, Artificial Sequence
  Synthetic Construct
ccaccatgcctgttctcact

SEQ ID NO: 1776 - DNA, 25 bp, Artificial Sequence
  Synthetic Construct
gatttagttgcacctttcccaagtt

SEQ ID NO: 1777 - DNA, 20 bp, Artificial Sequence
  Synthetic Construct
tgtgctgccagctgtggtta

SEQ ID NO: 1778 - DNA, 20 bp, Artificial Sequence
  Synthetic Construct
cagcccctcgtttctgttct

SEQ ID NO: 1779 - DNA, 21 bp, Artificial Sequence
  Synthetic Construct
ttcctcttccgccccaacact

SEQ ID NO: 1780 - DNA, 23 bp, Artificial Sequence
  Synthetic Construct
cctctgagacctgaatggtgtga

SEQ ID NO: 1781 - DNA, 21 bp, Artificial Sequence
  Synthetic Construct
ggaagagccgtctccccttga

SEQ ID NO: 1782 - DNA, 19 bp, Artificial Sequence
  Synthetic Construct
acgtggccccagtgtgact

SEQ ID NO: 1783 - DNA, 21 bp, Artificial Sequence
  Synthetic Construct
ggctgcagcagagactgcttt

SEQ ID NO: 1784 - DNA, 23 bp, Artificial Sequence
  Synthetic Construct
ctcaatgagaccgatgcaagttc

SEQ ID NO: 1785 - DNA, 22 bp, Artificial Sequence
  Synthetic Construct
tggacacagaggcagaagagat

SEQ ID NO: 1786 - DNA, 22 bp, Artificial Sequence
  Synthetic Construct
cctcgctagccaactcttctga

SEQ ID NO: 1787 - DNA, 22 bp, Artificial Sequence
  Synthetic Construct
aaggctcccctgcatcctaaag

SEQ ID NO: 1788 - DNA, 26 bp, Artificial Sequence
  Synthetic Construct
ccaggctagacacagaggatgtttac

SEQ ID NO: 1789 - DNA, 23 bp, Artificial Sequence
  Synthetic Construct
agaagcagcatatggtggaaact

SEQ ID NO: 1790 - DNA, 18 bp, Artificial Sequence
  Synthetic Construct
gcgtggtgctggttggaa

SEQ ID NO: 1791 - DNA, 23 bp, Artificial Sequence
  Synthetic Construct
tgctttgctggggatcttttctt

SEQ ID NO: 1792 - DNA, 22 bp, Artificial Sequence
  Synthetic Construct
cctgacccgaatgccaacttca

SEQ ID NO: 1793 - DNA, 19 bp, Artificial Sequence
  Synthetic Construct
ctgatgcccagtgccacat

SEQ ID NO: 1794 - DNA, 21 bp, Artificial Sequence
  Synthetic Construct
acgctggcaggctctcaatag

SEQ ID NO: 1795 - DNA, 20 bp, Artificial Sequence
  Synthetic Construct
gccttggcccctcaaacaag

SEQ ID NO: 1796 - DNA, 21 bp, Artificial Sequence
  Synthetic Construct
tgctacctttggcagggtgta

SEQ ID NO: 1797 - DNA, 22 bp, Artificial Sequence
  Synthetic Construct
agaaggaacggctccagtgatg

SEQ ID NO: 1798 - DNA, 27 bp, Artificial Sequence
  Synthetic Construct
gcctaaggtttttcttaggtcttggta

SEQ ID NO: 1799 - DNA, 24 bp, Artificial Sequence
  Synthetic Construct
ccagaggaagcttgtttgatgaga

SEQ ID NO: 1800 - DNA, 20 bp, Artificial Sequence
  Synthetic Construct
tctccccacacttgcccttt

SEQ ID NO: 1801 - DNA, 19 bp, Artificial Sequence
  Synthetic Construct
gcaggcacctgcagtcaca

SEQ ID NO: 1802 - DNA, 22 bp, Artificial Sequence
  Synthetic Construct
ccagcaaaggctccttccttct

SEQ ID NO: 1803 - DNA, 23 bp, Artificial Sequence
  Synthetic Construct
ccgccaaaatctactgggacttt

SEQ ID NO: 1804 - DNA, 19 bp, Artificial Sequence
  Synthetic Construct
agccctgccgagtgacgat

SEQ ID NO: 1805 - DNA, 23 bp, Artificial Sequence
  Synthetic Construct
ctcccaccacccttcctagaaca

SEQ ID NO: 1806 - DNA, 20 bp, Artificial Sequence
  Synthetic Construct
aggttagagcccctgtgcaa

SEQ ID NO: 1807 - DNA, 23 bp, Artificial Sequence
  Synthetic Construct
ggaaaatgcacggtggaaagaga

SEQ ID NO: 1808 - DNA, 21 bp, Artificial Sequence
  Synthetic Construct
aggtacatgggctcagagaca

SEQ ID NO: 1809 - DNA, 20 bp, Artificial Sequence
  Synthetic Construct
gaggtgggtttgcagtggtt

SEQ ID NO: 1810 - DNA, 23 bp, Artificial Sequence
  Synthetic Construct
tccaccctttcctagcctttctt

SEQ ID NO: 1811 - DNA, 25 bp, Artificial Sequence
  Synthetic Construct
gcaacatagaagcaaggcagttttt

SEQ ID NO: 1812 - DNA, 24 bp, Artificial Sequence
  Synthetic Construct
cacagggcatgatttcctggctta

SEQ ID NO: 1813 - DNA, 20 bp, Artificial Sequence
  Synthetic Construct
atgggcggagttgtgttcaa

SEQ ID NO: 1814 - DNA, 26 bp, Artificial Sequence
  Synthetic Construct
gctacttcccaatttggtttgacaca

SEQ ID NO: 1815 - DNA, 19 bp, Artificial Sequence
  Synthetic Construct
tgctggggcaaggctcaaa

SEQ ID NO: 1816 - DNA, 20 bp, Artificial Sequence
  Synthetic Construct
acatgtgaccccagggatgt

SEQ ID NO: 1817 - DNA, 20 bp, Artificial Sequence
  Synthetic Construct
tggtccctgtcttgcagtct

SEQ ID NO: 1818 - DNA, 23 bp, Artificial Sequence
  Synthetic Construct
cccagaccctggaataggacttg

SEQ ID NO: 1819 - DNA, 19 bp, Artificial Sequence
  Synthetic Construct
agggctgccccttcacctt

SEQ ID NO: 1820 - DNA, 22 bp, Artificial Sequence
  Synthetic Construct
ggctgaggcaaggtttttgcat

SEQ ID NO: 1821 - DNA, 21 bp, Artificial Sequence
  Synthetic Construct
cctccccttctctccactgat

SEQ ID NO: 1822 - DNA, 21 bp, Artificial Sequence
  Synthetic Construct
agtgaccacaggtgcaagaag

SEQ ID NO: 1823 - DNA, 24 bp, Artificial Sequence
  Synthetic Construct
tgtgtatccttgggatctggtaca

SEQ ID NO: 1824 - DNA, 23 bp, Artificial Sequence
  Synthetic Construct
gagctttcctgatgccttacact

SEQ ID NO: 1825 - DNA, 19 bp, Artificial Sequence
  Synthetic Construct
cgcaggcttctgctgttga

SEQ ID NO: 1826 - DNA, 24 bp, Artificial Sequence
  Synthetic Construct
tgacctgaaagctctttgttccat

SEQ ID NO: 1827 - DNA, 22 bp, Artificial Sequence
  Synthetic Construct
cctctggaggccccactgtaat

SEQ ID NO: 1828 - DNA, 25 bp, Artificial Sequence
  Synthetic Construct
ttctagtacatgccttttggtggat

SEQ ID NO: 1829 - DNA, 21 bp, Artificial Sequence
  Synthetic Construct
gcatggaaccagggcatgact

SEQ ID NO: 1830 - DNA, 21 bp, Artificial Sequence
  Synthetic Construct
cgctttgtccccactcttaca

SEQ ID NO: 1831 - DNA, 23 bp, Artificial Sequence
  Synthetic Construct
cactctgtgcaaaccagttgtag

SEQ ID NO: 1832 - DNA, 21 bp, Artificial Sequence
  Synthetic Construct
tcagcacccatcttgctcatc

SEQ ID NO: 1833 - DNA, 20 bp, Artificial Sequence
  Synthetic Construct
ggagactcctaccccagctt

SEQ ID NO: 1834 - DNA, 23 bp, Artificial Sequence
  Synthetic Construct
ggggattgttaatggccgagact

SEQ ID NO: 1835 - DNA, 21 bp, Artificial Sequence
  Synthetic Construct
acccaccacttgcacagttac

SEQ ID NO: 1836 - DNA, 23 bp, Artificial Sequence
  Synthetic Construct
gggtccctaagcactgtgagaag

SEQ ID NO: 1837 - DNA, 20 bp, Artificial Sequence
  Synthetic Construct
aaccaggccttgcggtaaag

SEQ ID NO: 1838 - DNA, 24 bp, Artificial Sequence
  Synthetic Construct
cctagggaacagtccactgagaga

SEQ ID NO: 1839 - DNA, 24 bp, Artificial Sequence
  Synthetic Construct
gcccgtgttttgaagctactgtct

SEQ ID NO: 1840 - DNA, 24 bp, Artificial Sequence
  Synthetic Construct
gccaaccagttcagttgggagtca

SEQ ID NO: 1841 - DNA, 24 bp, Artificial Sequence
  Synthetic Construct
gccagctagtggctttaaccaagt

SEQ ID NO: 1842 - DNA, 20 bp, Artificial Sequence
  Synthetic Construct
gcttcgcccatggctgtctt

SEQ ID NO: 1843 - DNA, 22 bp, Artificial Sequence
  Synthetic Construct
cgtgatctaccccactgagaca

SEQ ID NO: 1844 - DNA, 20 bp, Artificial Sequence
  Synthetic Construct
agttgggcatggaggcatgt

SEQ ID NO: 1845 - DNA, 21 bp, Artificial Sequence
  Synthetic Construct
aggccttgcaggagagaaatg

SEQ ID NO: 1846 - DNA, 25 bp, Artificial Sequence
  Synthetic Construct
cacctctgctttaggtctcaggttt

SEQ ID NO: 1847 - DNA, 25 bp, Artificial Sequence
  Synthetic Construct
cgatgctgagactaaggagcctaaa

SEQ ID NO: 1848 - DNA, 24 bp, Artificial Sequence
  Synthetic Construct
gtcactcattctgctctacccaaa

SEQ ID NO: 1849 - DNA, 25 bp, Artificial Sequence
  Synthetic Construct
gagcatcctcgagaattgcatttga

SEQ ID NO: 1850 - DNA, 25 bp, Artificial Sequence
  Synthetic Construct
gacaagtcagctggtgaagagtgaa

SEQ ID NO: 1851 - DNA, 23 bp, Artificial Sequence
  Synthetic Construct
gcctgtggcaaacttgaacatga

SEQ ID NO: 1852 - DNA, 23 bp, Artificial Sequence
  Synthetic Construct
tccactgtggtttgagtggaaag

SEQ ID NO: 1853 - DNA, 24 bp, Artificial Sequence
  Synthetic Construct
agactcgctcattcactctcattt

SEQ ID NO: 1854 - DNA, 22 bp, Artificial Sequence
  Synthetic Construct
gaatccagctcagccccttcta

SEQ ID NO: 1855 - DNA, 23 bp, Artificial Sequence
  Synthetic Construct
tcaagcagaacaggactgacaat

SEQ ID NO: 1856 - DNA, 20 bp, Artificial Sequence
  Synthetic Construct
tctcagccttcccgcttcat

SEQ ID NO: 1857 - DNA, 19 bp, Artificial Sequence
  Synthetic Construct
agggcccaggttccttctt

SEQ ID NO: 1858 - DNA, 22 bp, Artificial Sequence
  Synthetic Construct
tcccttccaggatgaccattga

SEQ ID NO: 1859 - DNA, 19 bp, Artificial Sequence
  Synthetic Construct
agccaggaagcctcagagt

SEQ ID NO: 1860 - DNA, 22 bp, Artificial Sequence
  Synthetic Construct
ttgctctaccctcctccagctt

SEQ ID NO: 1861 - DNA, 25 bp, Artificial Sequence
  Synthetic Construct
cccctgccctattttaaccacaaag

SEQ ID NO: 1862 - DNA, 20 bp, Artificial Sequence
  Synthetic Construct
ccactgcacccagccaatct

SEQ ID NO: 1863 - DNA, 20 bp, Artificial Sequence
  Synthetic Construct
aggcaggaagcctgttcaga

SEQ ID NO: 1864 - DNA, 25 bp, Artificial Sequence
  Synthetic Construct
tgtgcaaactctgtgatggaatgta

SEQ ID NO: 1865 - DNA, 20 bp, Artificial Sequence
  Synthetic Construct
aggggcccttctggaggttt

SEQ ID NO: 1866 - DNA, 22 bp, Artificial Sequence
  Synthetic Construct
tcgttccaccatgcttttcctt

SEQ ID NO: 1867 - DNA, 22 bp, Artificial Sequence
  Synthetic Construct
tgcttaaacgaacagggctttg

SEQ ID NO: 1868 - DNA, 21 bp, Artificial Sequence
  Synthetic Construct
tctgcaggggtgtggtatttc

SEQ ID NO: 1869 - DNA, 22 bp, Artificial Sequence
  Synthetic Construct
ccacctatgccacccaaggtat

SEQ ID NO: 1870 - DNA, 23 bp, Artificial Sequence
  Synthetic Construct
cccctccctcgcagaagtataag

SEQ ID NO: 1871 - DNA, 24 bp, Artificial Sequence
  Synthetic Construct
gccttcctaatgccacccagatca

SEQ ID NO: 1872 - DNA, 22 bp, Artificial Sequence
  Synthetic Construct
gcctcagtctcggttagcttca

SEQ ID NO: 1873 - DNA, 20 bp, Artificial Sequence
  Synthetic Construct
tgccctgtgccctcaattct

SEQ ID NO: 1874 - DNA, 23 bp, Artificial Sequence
  Synthetic Construct
accctgtactcctctcattcaca

SEQ ID NO: 1875 - DNA, 19 bp, Artificial Sequence
  Synthetic Construct
ccgcgtctggtcgcttctt

SEQ ID NO: 1876 - DNA, 20 bp, Artificial Sequence
  Synthetic Construct
ctggaggagagggcagtcat

SEQ ID NO: 1877 - DNA, 23 bp, Artificial Sequence
  Synthetic Construct
gggattacaaagttgcgcgtttc

SEQ ID NO: 1878 - DNA, 20 bp, Artificial Sequence
  Synthetic Construct
ggatggagacggcaggaatg

SEQ ID NO: 1879 - DNA, 24 bp, Artificial Sequence
  Synthetic Construct
ggacagagaatcaggtcacggtat

SEQ ID NO: 1880 - DNA, 20 bp, Artificial Sequence
  Synthetic Construct
acctcggcctcaggacttct

SEQ ID NO: 1881 - DNA, 22 bp, Artificial Sequence
  Synthetic Construct
tgctcacaggctcggagatagt

SEQ ID NO: 1882 - DNA, 21 bp, Artificial Sequence
  Synthetic Construct
agcagtcaggtgctcctcctt

SEQ ID NO: 1883 - DNA, 19 bp, Artificial Sequence
  Synthetic Construct
tggtatggggcggcagtga

SEQ ID NO: 1884 - DNA, 20 bp, Artificial Sequence
  Synthetic Construct
cccagctgacacaggctcat

SEQ ID NO: 1885 - DNA, 25 bp, Artificial Sequence
  Synthetic Construct
gtgtccagtctccttgagtcatttg

SEQ ID NO: 1886 - DNA, 19 bp, Artificial Sequence
  Synthetic Construct
ggaggcatgccccatctca

SEQ ID NO: 1887 - DNA, 20 bp, Artificial Sequence
  Synthetic Construct
gtggtgcttgttgccactgt

SEQ ID NO: 1888 - DNA, 24 bp, Artificial Sequence
  Synthetic Construct
gggcagtgatagaactgacatttg

SEQ ID NO: 1889 - DNA, 20 bp, Artificial Sequence
  Synthetic Construct
ggaacgtcagtggtcagctt

SEQ ID NO: 1890 - DNA, 23 bp, Artificial Sequence
  Synthetic Construct
tgtcaccctctctgctcataagt

SEQ ID NO: 1891 - DNA, 22 bp, Artificial Sequence
  Synthetic Construct
gttccatccccaaggacacaga

SEQ ID NO: 1892 - DNA, 23 bp, Artificial Sequence
  Synthetic Construct
gggactggaccaagaagggtatg

SEQ ID NO: 1893 - DNA, 22 bp, Artificial Sequence
  Synthetic Construct
ccatggcagaagctcaggaaac

SEQ ID NO: 1894 - DNA, 22 bp, Artificial Sequence
  Synthetic Construct
ggtctcgctctgtgacaccatt

SEQ ID NO: 1895 - DNA, 23 bp, Artificial Sequence
  Synthetic Construct
gcttccccgtgactgtctcctat

SEQ ID NO: 1896 - DNA, 25 bp, Artificial Sequence
  Synthetic Construct
gagagggtactggtagaagcatttc

SEQ ID NO: 1897 - DNA, 20 bp, Artificial Sequence
  Synthetic Construct
aagtgtggggccctcctaag

SEQ ID NO: 1898 - DNA, 22 bp, Artificial Sequence
  Synthetic Construct
gcagctgctgtctctgcaattc

SEQ ID NO: 1899 - DNA, 21 bp, Artificial Sequence
  Synthetic Construct
ccttgtcctgtgcatctctgt

SEQ ID NO: 1900 - DNA, 23 bp, Artificial Sequence
  Synthetic Construct
caaaggcaaaaagtggcatctgt

SEQ ID NO: 1901 - DNA, 22 bp, Artificial Sequence
  Synthetic Construct
gagcctacctctgtggacttca

SEQ ID NO: 1902 - DNA, 24 bp, Artificial Sequence
  Synthetic Construct
ggaaaaccctctgagcctcacatt

SEQ ID NO: 1903 - DNA, 22 bp, Artificial Sequence
  Synthetic Construct
cggccccttagcttgagttagt

SEQ ID NO: 1904 - DNA, 21 bp, Artificial Sequence
  Synthetic Construct
gaggctgcctagagagacaga

SEQ ID NO: 1905 - DNA, 19 bp, Artificial Sequence
  Synthetic Construct
ggccacgcatgggcatttg

SEQ ID NO: 1906 - DNA, 19 bp, Artificial Sequence
  Synthetic Construct
ggggctcgcgtctctgttt

SEQ ID NO: 1907 - DNA, 22 bp, Artificial Sequence
  Synthetic Construct
ctgtgggatgtcctggaactac

SEQ ID NO: 1908 - DNA, 24 bp, Artificial Sequence
  Synthetic Construct
cttcgagaaaggcttggagatact

SEQ ID NO: 1909 - DNA, 19 bp, Artificial Sequence
  Synthetic Construct
tggccctcaaggagctgta

SEQ ID NO: 1910 - DNA, 22 bp, Artificial Sequence
  Synthetic Construct
gcacccagccagcaattggata

SEQ ID NO: 1911 - DNA, 20 bp, Artificial Sequence
  Synthetic Construct
ccccgattctgcgtttgctt

SEQ ID NO: 1912 - DNA, 22 bp, Artificial Sequence
  Synthetic Construct
agaacccggtccacatgctaac

SEQ ID NO: 1913 - DNA, 22 bp, Artificial Sequence
  Synthetic Construct
ccaaggccctcctctctctaag

SEQ ID NO: 1914 - DNA, 23 bp, Artificial Sequence
  Synthetic Construct
cacaggcagttagggtaggttct

SEQ ID NO: 1915 - DNA, 21 bp, Artificial Sequence
  Synthetic Construct
tccccacgatggcagtgagtt

SEQ ID NO: 1916 - DNA, 22 bp, Artificial Sequence
  Synthetic Construct
tggagcaatatggtgcactgtt

SEQ ID NO: 1917 - DNA, 24 bp, Artificial Sequence
  Synthetic Construct
cactctgtcaagttttgccgtctt

SEQ ID NO: 1918 - DNA, 22 bp, Artificial Sequence
  Synthetic Construct
gcaggcatgacagactttcctt

SEQ ID NO: 1919 - DNA, 23 bp, Artificial Sequence
  Synthetic Construct
gcgttccccatggcatgtctaaa

SEQ ID NO: 1920 - DNA, 24 bp, Artificial Sequence
  Synthetic Construct
ttggagtggacgtcttcctatttc

SEQ ID NO: 1921 - DNA, 20 bp, Artificial Sequence
  Synthetic Construct
cagggctccctcctccattt

SEQ ID NO: 1922 - DNA, 26 bp, Artificial Sequence
  Synthetic Construct
cagcactgagttcattgcctcaaaaa

SEQ ID NO: 1923 - DNA, 23 bp, Artificial Sequence
  Synthetic Construct
gccataggagagaccctgaatct

SEQ ID NO: 1924 - DNA, 22 bp, Artificial Sequence
  Synthetic Construct
gactgcaacagaggctgaccta

SEQ ID NO: 1925 - DNA, 18 bp, Artificial Sequence
  Synthetic Construct
tgccctgggtggtcttgt

SEQ ID NO: 1926 - DNA, 25 bp, Artificial Sequence
  Synthetic Construct
cagcagagacctgatagccctatgt

SEQ ID NO: 1927 - DNA, 23 bp, Artificial Sequence
  Synthetic Construct
gcaacaggttttgtcctctggtt

SEQ ID NO: 1928 - DNA, 22 bp, Artificial Sequence
  Synthetic Construct
cctcgtcctcctcccatccaaa

SEQ ID NO: 1929 - DNA, 19 bp, Artificial Sequence
  Synthetic Construct
ctggaaacggccccagagt

SEQ ID NO: 1930 - DNA, 22 bp, Artificial Sequence
  Synthetic Construct
tggtggggacattttcctgaag

SEQ ID NO: 1931 - DNA, 20 bp, Artificial Sequence
  Synthetic Construct
ctggttgcagtgtggagcat

SEQ ID NO: 1932 - DNA, 21 bp, Artificial Sequence
  Synthetic Construct
tcagatgtcaaccccgcctat

SEQ ID NO: 1933 - DNA, 20 bp, Artificial Sequence
  Synthetic Construct
cggcgactactggaggcttt

SEQ ID NO: 1934 - DNA, 22 bp, Artificial Sequence
  Synthetic Construct
aggtagcccagcagttctccat

SEQ ID NO: 1935 - DNA, 20 bp, Artificial Sequence
  Synthetic Construct
tggcctgcctcacttgctta

SEQ ID NO: 1936 - DNA, 21 bp, Artificial Sequence
  Synthetic Construct
tccggaagacacgagaggaaa

SEQ ID NO: 1937 - DNA, 23 bp, Artificial Sequence
  Synthetic Construct
acatgggttttgagtcagccatt

SEQ ID NO: 1938 - DNA, 25 bp, Artificial Sequence
  Synthetic Construct
gaaccttggctctttgcaagtcatc

SEQ ID NO: 1939 - DNA, 20 bp, Artificial Sequence
  Synthetic Construct
tgactgactgggccttcaga

SEQ ID NO: 1940 - DNA, 25 bp, Artificial Sequence
  Synthetic Construct
ggcaaggcagccaataaaggatgta

SEQ ID NO: 1941 - DNA, 21 bp, Artificial Sequence
  Synthetic Construct
gggcctgttgggcttgttttg

SEQ ID NO: 1942 - DNA, 24 bp, Artificial Sequence
  Synthetic Construct
caaagtggtgagttccttgggttt

SEQ ID NO: 1943 - DNA, 20 bp, Artificial Sequence
  Synthetic Construct
ttgccctcccagtggcttca

SEQ ID NO: 1944 - DNA, 19 bp, Artificial Sequence
  Synthetic Construct
ggtgctctagggcctcaca

SEQ ID NO: 1945 - DNA, 24 bp, Artificial Sequence
  Synthetic Construct
cagtgaggaacgtattcagcctat

SEQ ID NO: 1946 - DNA, 19 bp, Artificial Sequence
  Synthetic Construct
ggcatcgctccacccaagt

SEQ ID NO: 1947 - DNA, 23 bp, Artificial Sequence
  Synthetic Construct
aaagaaagaggccatgtggtaca

SEQ ID NO: 1948 - DNA, 19 bp, Artificial Sequence
  Synthetic Construct
tctggccacctggcgattt

SEQ ID NO: 1949 - DNA, 24 bp, Artificial Sequence
  Synthetic Construct
gacatgacccacaaagccttcctt

SEQ ID NO: 1950 - DNA, 20 bp, Artificial Sequence
  Synthetic Construct
tgcctgacctccatggaaac

SEQ ID NO: 1951 - DNA, 21 bp, Artificial Sequence
  Synthetic Construct
gcccatgtgaggcatagactt

SEQ ID NO: 1952 - DNA, 20 bp, Artificial Sequence
  Synthetic Construct
agaaagccgaggctcagaga

SEQ ID NO: 1953 - DNA, 24 bp, Artificial Sequence
  Synthetic Construct
aggcaagctagctgatatcctttc

SEQ ID NO: 1954 - DNA, 22 bp, Artificial Sequence
  Synthetic Construct
ggtggagtgacccaaaccttca

SEQ ID NO: 1955 - DNA, 27 bp, Artificial Sequence
  Synthetic Construct
ggcatgctttcaatatatcctcctagt

SEQ ID NO: 1956 - DNA, 20 bp, Artificial Sequence
  Synthetic Construct
ccgggaaacctgggaagtga

SEQ ID NO: 1957 - DNA, 22 bp, Artificial Sequence
  Synthetic Construct
cctggtgagtaacggagagtca

SEQ ID NO: 1958 - DNA, 24 bp, Artificial Sequence
  Synthetic Construct
caggcatgggcagtttcttttatc

SEQ ID NO: 1959 - DNA, 22 bp, Artificial Sequence
  Synthetic Construct
accctctgcttctggtgtcagt

SEQ ID NO: 1960 - DNA, 20 bp, Artificial Sequence
  Synthetic Construct
acgcctacagtgagcggaaa

SEQ ID NO: 1961 - DNA, 21 bp, Artificial Sequence
  Synthetic Construct
ggggcatggaatcaggaactt

SEQ ID NO: 1962 - DNA, 22 bp, Artificial Sequence
  Synthetic Construct
ttagagtgggagcggagacctt

SEQ ID NO: 1963 - DNA, 24 bp, Artificial Sequence
  Synthetic Construct
gcaatgatcagtggcgttttcaga

SEQ ID NO: 1964 - DNA, 20 bp, Artificial Sequence
  Synthetic Construct
accacagggttgggcaatga

SEQ ID NO: 1965 - DNA, 19 bp, Artificial Sequence
  Synthetic Construct
acggtgcccggccatttct

SEQ ID NO: 1966 - DNA, 23 bp, Artificial Sequence
  Synthetic Construct
gcatgtgcctgttttctaaccat

SEQ ID NO: 1967 - DNA, 24 bp, Artificial Sequence
  Synthetic Construct
gcccaccttatacctcgctcaact

SEQ ID NO: 1968 - DNA, 22 bp, Artificial Sequence
  Synthetic Construct
cctcctgccaccacatctatca

SEQ ID NO: 1969 - DNA, 21 bp, Artificial Sequence
  Synthetic Construct
tggtgacggaggatggcagaa

SEQ ID NO: 1970 - DNA, 22 bp, Artificial Sequence
  Synthetic Construct
tgcatcccacctgtctatgact

SEQ ID NO: 1971 - DNA, 21 bp, Artificial Sequence
  Synthetic Construct
agccagagttctgccttcttg

SEQ ID NO: 1972 - DNA, 20 bp, Artificial Sequence
  Synthetic Construct
aggctgcgagtttggcagat

SEQ ID NO: 1973 - DNA, 18 bp, Artificial Sequence
  Synthetic Construct
gtccctgctggtgcactt

SEQ ID NO: 1974 - DNA, 23 bp, Artificial Sequence
  Synthetic Construct
gcactatgcagcaggaacctaag

SEQ ID NO: 1975 - DNA, 20 bp, Artificial Sequence
  Synthetic Construct
acaggcctggttggctttgt

SEQ ID NO: 1976 - DNA, 26 bp, Artificial Sequence
  Synthetic Construct
ccaggtcagggtatattatggaaaca

SEQ ID NO: 1977 - DNA, 20 bp, Artificial Sequence
  Synthetic Construct
ccgtggccactcattcaaga

SEQ ID NO: 1978 - DNA, 24 bp, Artificial Sequence
  Synthetic Construct
gggctcacttggatggtcctaaag

SEQ ID NO: 1979 - DNA, 24 bp, Artificial Sequence
  Synthetic Construct
ccaagtgtgacagtgtctttgttt

SEQ ID NO: 1980 - DNA, 26 bp, Artificial Sequence
  Synthetic Construct
cgatacaagtggatggctcttcattc

SEQ ID NO: 1981 - DNA, 25 bp, Artificial Sequence
  Synthetic Construct
catctcaccagatcttgagtgctaa

SEQ ID NO: 1982 - DNA, 20 bp, Artificial Sequence
  Synthetic Construct
aggtggagctgccatcttga

SEQ ID NO: 1983 - DNA, 24 bp, Artificial Sequence
  Synthetic Construct
agacacagttagccagacctattg

SEQ ID NO: 1984 - DNA, 26 bp, Artificial Sequence
  Synthetic Construct
gacatgtcgggaggcttaatctgaac

SEQ ID NO: 1985 - DNA, 23 bp, Artificial Sequence
  Synthetic Construct
cctgcctaaaggtttgcagacaa

SEQ ID NO: 1986 - DNA, 24 bp, Artificial Sequence
  Synthetic Construct
ccacccagatggacctccctttta

SEQ ID NO: 1987 - DNA, 20 bp, Artificial Sequence
  Synthetic Construct
tgcctgtgtgactgccctta

SEQ ID NO: 1988 - DNA, 23 bp, Artificial Sequence
  Synthetic Construct
gaattctgccgtctggttctttc

SEQ ID NO: 1989 - DNA, 22 bp, Artificial Sequence
  Synthetic Construct
acccaatgtcctttgccagtag

SEQ ID NO: 1990 - DNA, 20 bp, Artificial Sequence
  Synthetic Construct
ggctgcagtacacccagact

SEQ ID NO: 1991 - DNA, 28 bp, Artificial Sequence
  Synthetic Construct
gtctttggggtaatcacccacagttaaa

SEQ ID NO: 1992 - DNA, 22 bp, Artificial Sequence
  Synthetic Construct
cacacaccttttggcccttttg

SEQ ID NO: 1993 - DNA, 23 bp, Artificial Sequence
  Synthetic Construct
tctggaggggtaaaaagctgact

SEQ ID NO: 1994 - DNA, 24 bp, Artificial Sequence
  Synthetic Construct
gtaggaccaaaacatggagactgt

SEQ ID NO: 1995 - DNA, 22 bp, Artificial Sequence
  Synthetic Construct
cactaagtgcccgagtcaggtt

SEQ ID NO: 1996 - DNA, 21 bp, Artificial Sequence
  Synthetic Construct
caaccattggtgcggcaaaac

SEQ ID NO: 1997 - DNA, 23 bp, Artificial Sequence
  Synthetic Construct
gacagcacatgctatccctactt

SEQ ID NO: 1998 - DNA, 23 bp, Artificial Sequence
  Synthetic Construct
agaaaccagactgtgagggaaga

SEQ ID NO: 1999 - DNA, 20 bp, Artificial Sequence
  Synthetic Construct
aggggaagggtccctcattt

SEQ ID NO: 2000 - DNA, 22 bp, Artificial Sequence
  Synthetic Construct
accttaggtaccagctcagaca

SEQ ID NO: 2001 - DNA, 20 bp, Artificial Sequence
  Synthetic Construct
agggctcttgagaccagcaa

SEQ ID NO: 2002 - DNA, 22 bp, Artificial Sequence
  Synthetic Construct
gtgtggattgttgcaggaggaa

SEQ ID NO: 2003 - DNA, 24 bp, Artificial Sequence
  Synthetic Construct
cagcaaagactggattcctactca

SEQ ID NO: 2004 - DNA, 25 bp, Artificial Sequence
  Synthetic Construct
ggcatcattgcattcaaagacattc

SEQ ID NO: 2005 - DNA, 20 bp, Artificial Sequence
  Synthetic Construct
cacccatggccacctttctt

SEQ ID NO: 2006 - DNA, 25 bp, Artificial Sequence
  Synthetic Construct
cctctctgatcatttggcaggaaga

SEQ ID NO: 2007 - DNA, 25 bp, Artificial Sequence
  Synthetic Construct
tcattgtaactagggactccacgta

SEQ ID NO: 2008 - DNA, 25 bp, Artificial Sequence
  Synthetic Construct
catattaccctgggaatcacagcaa

SEQ ID NO: 2009 - DNA, 21 bp, Artificial Sequence
  Synthetic Construct
ttggcctgccacatcccctat

SEQ ID NO: 2010 - DNA, 21 bp, Artificial Sequence
  Synthetic Construct
cccaaatggcagaggctgtgt

SEQ ID NO: 2011 - DNA, 24 bp, Artificial Sequence
  Synthetic Construct
cctgattcccttcagttctgttct

SEQ ID NO: 2012 - DNA, 26 bp, Artificial Sequence
  Synthetic Construct
tgcactaatgtcttagaggagctttc

SEQ ID NO: 2013 - DNA, 22 bp, Artificial Sequence
  Synthetic Construct
caaggccacacaggatgtgtct

SEQ ID NO: 2014 - DNA, 23 bp, Artificial Sequence
  Synthetic Construct
gggtccagggtataggtggaaga

SEQ ID NO: 2015 - DNA, 22 bp, Artificial Sequence
  Synthetic Construct
gcgcctctggaaaggtgagatt

SEQ ID NO: 2016 - DNA, 27 bp, Artificial Sequence
  Synthetic Construct
ggcctggtgtaaatttctacctacata

SEQ ID NO: 2017 - DNA, 23 bp, Artificial Sequence
  Synthetic Construct
tgagtgaaatgcaaaggctgcta

SEQ ID NO: 2018 - DNA, 23 bp, Artificial Sequence
  Synthetic Construct
cacctggatgattgccattgctt

SEQ ID NO: 2019 - DNA, 23 bp, Artificial Sequence
  Synthetic Construct
ggtcagtgacagatccaggacta

SEQ ID NO: 2020 - DNA, 22 bp, Artificial Sequence
  Synthetic Construct
tttcaggccctagctccaggat

SEQ ID NO: 2021 - DNA, 23 bp, Artificial Sequence
  Synthetic Construct
cagcctctttcctagggttgtgt

SEQ ID NO: 2022 - DNA, 25 bp, Artificial Sequence
  Synthetic Construct
ggcagttattgcagcaaggaaatct

SEQ ID NO: 2023 - DNA, 20 bp, Artificial Sequence
  Synthetic Construct
gccaccctaagtgctcatgt

SEQ ID NO: 2024 - DNA, 23 bp, Artificial Sequence
  Synthetic Construct
caggacaaggtgctcagagtttc

SEQ ID NO: 2025 - DNA, 20 bp, Artificial Sequence
  Synthetic Construct
aagatggaggccggcagttc

SEQ ID NO: 2026 - DNA, 20 bp, Artificial Sequence
  Synthetic Construct
gttgaggctgaagcccatga

SEQ ID NO: 2027 - DNA, 24 bp, Artificial Sequence
  Synthetic Construct
ccacttagcattgcttgtcatcaa

SEQ ID NO: 2028 - DNA, 20 bp, Artificial Sequence
  Synthetic Construct
tccaggaacaaccgcacagt

SEQ ID NO: 2029 - DNA, 22 bp, Artificial Sequence
  Synthetic Construct
ggagccccaagaaccttggatt

SEQ ID NO: 2030 - DNA, 23 bp, Artificial Sequence
  Synthetic Construct
ggctatcgaagccttcatgtcta

SEQ ID NO: 2031 - DNA, 22 bp, Artificial Sequence
  Synthetic Construct
gtgacaactgtgtgggtgagta

SEQ ID NO: 2032 - DNA, 21 bp, Artificial Sequence
  Synthetic Construct
tgggacacctgagtcatggat

SEQ ID NO: 2033 - DNA, 23 bp, Artificial Sequence
  Synthetic Construct
agtactcattttggcagcacgta

SEQ ID NO: 2034 - DNA, 21 bp, Artificial Sequence
  Synthetic Construct
caggctgctcaaggcattagt

SEQ ID NO: 2035 - DNA, 25 bp, Artificial Sequence
  Synthetic Construct
ggttgttgttcccggactctgaata

SEQ ID NO: 2036 - DNA, 22 bp, Artificial Sequence
  Synthetic Construct
ggattgaggaaggtagcgcttt

SEQ ID NO: 2037 - DNA, 24 bp, Artificial Sequence
  Synthetic Construct
gtggtagtaaagctggtgatgaca

SEQ ID NO: 2038 - DNA, 20 bp, Artificial Sequence
  Synthetic Construct
cccagcaccaatcccatgaa

SEQ ID NO: 2039 - DNA, 26 bp, Artificial Sequence
  Synthetic Construct
caaattacaggcaatgacgcacatag

SEQ ID NO: 2040 - DNA, 23 bp, Artificial Sequence
  Synthetic Construct
tctggccactttaacacctcatt

SEQ ID NO: 2041 - DNA, 24 bp, Artificial Sequence
  Synthetic Construct
gggtcatgcttcgcttgatactgt

SEQ ID NO: 2042 - DNA, 22 bp, Artificial Sequence
  Synthetic Construct
tctctaccccaccccagcaaat

SEQ ID NO: 2043 - DNA, 24 bp, Artificial Sequence
  Synthetic Construct
caccagagccctccattcctaaac

SEQ ID NO: 2044 - DNA, 19 bp, Artificial Sequence
  Synthetic Construct
ggagggcaagggcatctca

SEQ ID NO: 2045 - DNA, 22 bp, Artificial Sequence
  Synthetic Construct
ctcccctgtgcactctttcact

SEQ ID NO: 2046 - DNA, 24 bp, Artificial Sequence
  Synthetic Construct
gtggtagatagacccggctagact

SEQ ID NO: 2047 - DNA, 21 bp, Artificial Sequence
  Synthetic Construct
ggtcctgagcaactgggtaaa

SEQ ID NO: 2048 - DNA, 20 bp, Artificial Sequence
  Synthetic Construct
gaagatgggacaggcgttgt

SEQ ID NO: 2049 - DNA, 22 bp, Artificial Sequence
  Synthetic Construct
gggtaaggtgtgcccttgttct

SEQ ID NO: 2050 - DNA, 20 bp, Artificial Sequence
  Synthetic Construct
caagcggagcacagaactga

SEQ ID NO: 2051 - DNA, 24 bp, Artificial Sequence
  Synthetic Construct
gcaagatcccaacctccaggagaa

SEQ ID NO: 2052 - DNA, 23 bp, Artificial Sequence
  Synthetic Construct
ggagacatcctcgcctgaaccta

SEQ ID NO: 2053 - DNA, 27 bp, Artificial Sequence
  Synthetic Construct
ggcctgagctaagctttttctttgcta

SEQ ID NO: 2054 - DNA, 19 bp, Artificial Sequence
  Synthetic Construct
cgccagcattctgctgctt

SEQ ID NO: 2055 - DNA, 19 bp, Artificial Sequence
  Synthetic Construct
acagtggtgcccagtgtga

SEQ ID NO: 2056 - DNA, 25 bp, Artificial Sequence
  Synthetic Construct
gcagaataaacaggttcttgtgtca

SEQ ID NO: 2057 - DNA, 22 bp, Artificial Sequence
  Synthetic Construct
cccaatcagccccagacatttg

SEQ ID NO: 2058 - DNA, 21 bp, Artificial Sequence
  Synthetic Construct
tcgctctctctccacctctgt

SEQ ID NO: 2059 - DNA, 20 bp, Artificial Sequence
  Synthetic Construct
gtgtgtggcaaggtgtgtct

SEQ ID NO: 2060 - DNA, 21 bp, Artificial Sequence
  Synthetic Construct
aggtgggattggaggttggaa

SEQ ID NO: 2061 - DNA, 20 bp, Artificial Sequence
  Synthetic Construct
caggcagagaggaagccaaa

SEQ ID NO: 2062 - DNA, 19 bp, Artificial Sequence
  Synthetic Construct
cctgcctccccaacagtga

SEQ ID NO: 2063 - DNA, 23 bp, Artificial Sequence
  Synthetic Construct
tcccttaacaagtcacccacttc

SEQ ID NO: 2064 - DNA, 21 bp, Artificial Sequence
  Synthetic Construct
cccctcagcctgtatgtctct

SEQ ID NO: 2065 - DNA, 23 bp, Artificial Sequence
  Synthetic Construct
cccttcctaagtgccagagaaac

SEQ ID NO: 2066 - DNA, 20 bp, Artificial Sequence
  Synthetic Construct
aacctcactgttgcgtgagt

SEQ ID NO: 2067 - DNA, 22 bp, Artificial Sequence
  Synthetic Construct
ccctgctcccacaaactcttta

SEQ ID NO: 2068 - DNA, 27 bp, Artificial Sequence
  Synthetic Construct
cagagtaggattagccacttcagtaag

SEQ ID NO: 2069 - DNA, 23 bp, Artificial Sequence
  Synthetic Construct
gctcggagactctgcctctctat

SEQ ID NO: 2070 - DNA, 22 bp, Artificial Sequence
  Synthetic Construct
cctcaatgcaggggcagtctat

SEQ ID NO: 2071 - DNA, 22 bp, Artificial Sequence
  Synthetic Construct
aaaattgtagccccacccatgt

SEQ ID NO: 2072 - DNA, 25 bp, Artificial Sequence
  Synthetic Construct
gggagtttaccgctaagatgttttc

SEQ ID NO: 2073 - DNA, 21 bp, Artificial Sequence
  Synthetic Construct
gcctgaggtccatgactttgt

SEQ ID NO: 2074 - DNA, 20 bp, Artificial Sequence
  Synthetic Construct
aggcccactgtcacatggat

SEQ ID NO: 2075 - DNA, 19 bp, Artificial Sequence
  Synthetic Construct
gcggtaggctgcctgaaca

SEQ ID NO: 2076 - DNA, 20 bp, Artificial Sequence
  Synthetic Construct
tgggttccccgaggctctgt

SEQ ID NO: 2077 - DNA, 25 bp, Artificial Sequence
  Synthetic Construct
catagcactgggatcaagaaagact

SEQ ID NO: 2078 - DNA, 23 bp, Artificial Sequence
  Synthetic Construct
gtctgttcactccaaagcacaag

SEQ ID NO: 2079 - DNA, 22 bp, Artificial Sequence
  Synthetic Construct
agggaccctagaggacaggaaa

SEQ ID NO: 2080 - DNA, 22 bp, Artificial Sequence
  Synthetic Construct
ctgctgttggaccctaaacact

SEQ ID NO: 2081 - DNA, 21 bp, Artificial Sequence
  Synthetic Construct
tcaggctttcctgtccctctt

SEQ ID NO: 2082 - DNA, 25 bp, Artificial Sequence
  Synthetic Construct
ttggatattgtttgtcacccctaca

SEQ ID NO: 2083 - DNA, 19 bp, Artificial Sequence
  Synthetic Construct
ggcccacctcgtcactatg

SEQ ID NO: 2084 - DNA, 22 bp, Artificial Sequence
  Synthetic Construct
gcttacaacgcaacttcacaca

SEQ ID NO: 2085 - DNA, 21 bp, Artificial Sequence
  Synthetic Construct
cccaccctgagccttcacttc

SEQ ID NO: 2086 - DNA, 20 bp, Artificial Sequence
  Synthetic Construct
ttggtggcgcccatgagtct

SEQ ID NO: 2087 - DNA, 21 bp, Artificial Sequence
  Synthetic Construct
ttgaaagcctcgtgccatttg

SEQ ID NO: 2088 - DNA, 24 bp, Artificial Sequence
  Synthetic Construct
tttaggtgggatgtgaatgtgtca

SEQ ID NO: 2089 - DNA, 23 bp, Artificial Sequence
  Synthetic Construct
cacataagggaacaagcgcacaa

SEQ ID NO: 2090 - DNA, 23 bp, Artificial Sequence
  Synthetic Construct
cctccaacctagactggatgtca

SEQ ID NO: 2091 - DNA, 22 bp, Artificial Sequence
  Synthetic Construct
gacttggtcgtgggttttgaga

SEQ ID NO: 2092 - DNA, 22 bp, Artificial Sequence
  Synthetic Construct
tgactgctgacacgggaggaat

SEQ ID NO: 2093 - DNA, 20 bp, Artificial Sequence
  Synthetic Construct
tggtggcgagggtagaagat

SEQ ID NO: 2094 - DNA, 24 bp, Artificial Sequence
  Synthetic Construct
actcacagtaatccaggggaaaag

SEQ ID NO: 2095 - DNA, 24 bp, Artificial Sequence
  Synthetic Construct
ctgcaaaaataccagggaggaact

SEQ ID NO: 2096 - DNA, 22 bp, Artificial Sequence
  Synthetic Construct
actctcacacccttaggccttt

SEQ ID NO: 2097 - DNA, 20 bp, Artificial Sequence
  Synthetic Construct
accgcgccccatcacttact

SEQ ID NO: 2098 - DNA, 22 bp, Artificial Sequence
  Synthetic Construct
ctgaccctgggcaaatgactct

SEQ ID NO: 2099 - DNA, 20 bp, Artificial Sequence
  Synthetic Construct
cgccacggactaatgctgtt

SEQ ID NO: 2100 - DNA, 23 bp, Artificial Sequence
  Synthetic Construct
ttggctttgtatctccagcaact

SEQ ID NO: 2101 - DNA, 23 bp, Artificial Sequence
  Synthetic Construct
catcgctaccgggttatgttttc

SEQ ID NO: 2102 - DNA, 21 bp, Artificial Sequence
  Synthetic Construct
agaggcaaaatccgcacctaa

SEQ ID NO: 2103 - DNA, 22 bp, Artificial Sequence
  Synthetic Construct
ccctgcccttctcactcacaaa

SEQ ID NO: 2104 - DNA, 22 bp, Artificial Sequence
  Synthetic Construct
catgcatgaccctgctcacttt

SEQ ID NO: 2105 - DNA, 24 bp, Artificial Sequence
  Synthetic Construct
ggcctgccttaagttctgctaaag

SEQ ID NO: 2106 - DNA, 23 bp, Artificial Sequence
  Synthetic Construct
ggagttctgcacttgtgatgttc

SEQ ID NO: 2107 - DNA, 21 bp, Artificial Sequence
  Synthetic Construct
gcgtccaaggctgggtaaaga

SEQ ID NO: 2108 - DNA, 20 bp, Artificial Sequence
  Synthetic Construct
ggcagcctgggtatgtcttg

SEQ ID NO: 2109 - DNA, 25 bp, Artificial Sequence
  Synthetic Construct
tcaacttgattgtctccacactgta

SEQ ID NO: 2110 - DNA, 23 bp, Artificial Sequence
  Synthetic Construct
ggccggccatcccagtataattt

SEQ ID NO: 2111 - DNA, 18 bp, Artificial Sequence
  Synthetic Construct
gtgcggggcttgaaggat

SEQ ID NO: 2112 - DNA, 25 bp, Artificial Sequence
  Synthetic Construct
ttgttcctatcgattacccaccaaa

SEQ ID NO: 2113 - DNA, 26 bp, Artificial Sequence
  Synthetic Construct
ctagtaccactttctccttgctcatt

SEQ ID NO: 2114 - DNA, 22 bp, Artificial Sequence
  Synthetic Construct
ctgccagaccacaccaatctca

SEQ ID NO: 2115 - DNA, 19 bp, Artificial Sequence
  Synthetic Construct
ccaggcaggacgcaactca

SEQ ID NO: 2116 - DNA, 23 bp, Artificial Sequence
  Synthetic Construct
tggtatagccactctggcatttt

SEQ ID NO: 2117 - DNA, 24 bp, Artificial Sequence
  Synthetic Construct
ggaggagtgcgtgcagaagtatca

SEQ ID NO: 2118 - DNA, 22 bp, Artificial Sequence
  Synthetic Construct
gcctctgttttctcgggctaag

SEQ ID NO: 2119 - DNA, 22 bp, Artificial Sequence
  Synthetic Construct
ccatctaccctgtgcccagaaa

SEQ ID NO: 2120 - DNA, 19 bp, Artificial Sequence
  Synthetic Construct
gcccacgtcttggccttgt

SEQ ID NO: 2121 - DNA, 22 bp, Artificial Sequence
  Synthetic Construct
tccgcttccacaacccaagaac

SEQ ID NO: 2122 - DNA, 25 bp, Artificial Sequence
  Synthetic Construct
ccactttgccaaattccctttcatc

SEQ ID NO: 2123 - DNA, 19 bp, Artificial Sequence
  Synthetic Construct
acgaggacccgcgatgtct

SEQ ID NO: 2124 - DNA, 21 bp, Artificial Sequence
  Synthetic Construct
cggccagagactcactcagaa

SEQ ID NO: 2125 - DNA, 21 bp, Artificial Sequence
  Synthetic Construct
acccaccaacaccacattgat

SEQ ID NO: 2126 - DNA, 22 bp, Artificial Sequence
  Synthetic Construct
tcccttgagcctcctctgttct

SEQ ID NO: 2127 - DNA, 21 bp, Artificial Sequence
  Synthetic Construct
ggggacagtgggaggatgtca

SEQ ID NO: 2128 - DNA, 21 bp, Artificial Sequence
  Synthetic Construct
actggctagctcccagtgatg

SEQ ID NO: 2129 - DNA, 20 bp, Artificial Sequence
  Synthetic Construct
cgccacctggacaggaaaca

SEQ ID NO: 2130 - DNA, 22 bp, Artificial Sequence
  Synthetic Construct
agcaatcctcaggccaggaaag

SEQ ID NO: 2131 - DNA, 23 bp, Artificial Sequence
  Synthetic Construct
gcctctgttacctttctcccatt

SEQ ID NO: 2132 - DNA, 19 bp, Artificial Sequence
  Synthetic Construct
agctgctgggagtgggaaa

SEQ ID NO: 2133 - DNA, 21 bp, Artificial Sequence
  Synthetic Construct
gcccagtgaaagggcaaaact

SEQ ID NO: 2134 - DNA, 21 bp, Artificial Sequence
  Synthetic Construct
ggtccgtgcagactggacaat

SEQ ID NO: 2135 - DNA, 23 bp, Artificial Sequence
  Synthetic Construct
tccatcacatgctggtgaaatgt

SEQ ID NO: 2136 - DNA, 22 bp, Artificial Sequence
  Synthetic Construct
tctatgctcagggcctaacact

SEQ ID NO: 2137 - DNA, 20 bp, Artificial Sequence
  Synthetic Construct
caccttcccacgttgcctat

SEQ ID NO: 2138 - DNA, 25 bp, Artificial Sequence
  Synthetic Construct
tgagctacccatcagggttattttt

SEQ ID NO: 2139 - DNA, 24 bp, Artificial Sequence
  Synthetic Construct
ccattgagtttcaactggggtaca

SEQ ID NO: 2140 - DNA, 22 bp, Artificial Sequence
  Synthetic Construct
gcctcatcaacgacccgattca

SEQ ID NO: 2141 - DNA, 18 bp, Artificial Sequence
  Synthetic Construct
accaggaccccactggtt

SEQ ID NO: 2142 - DNA, 20 bp, Artificial Sequence
  Synthetic Construct
aggtctcagccctgactgtt

SEQ ID NO: 2143 - DNA, 24 bp, Artificial Sequence
  Synthetic Construct
tggtttaccctgaatccactctga

SEQ ID NO: 2144 - DNA, 22 bp, Artificial Sequence
  Synthetic Construct
accatatgaccgtcaggcttct

SEQ ID NO: 2145 - DNA, 19 bp, Artificial Sequence
  Synthetic Construct
ccaggggttggcgtgaaag

SEQ ID NO: 2146 - DNA, 25 bp, Artificial Sequence
  Synthetic Construct
caaaccaagtgcctggtagatttca

SEQ ID NO: 2147 - DNA, 19 bp, Artificial Sequence
  Synthetic Construct
cctccacctgcccatcagt

SEQ ID NO: 2148 - DNA, 22 bp, Artificial Sequence
  Synthetic Construct
gtagccaggcatgcatttttga

SEQ ID NO: 2149 - DNA, 22 bp, Artificial Sequence
  Synthetic Construct
cccagctgtccaaaggacttca

SEQ ID NO: 2150 - DNA, 18 bp, Artificial Sequence
  Synthetic Construct
ctgtcccgtgcgttccaa

SEQ ID NO: 2151 - DNA, 20 bp, Artificial Sequence
  Synthetic Construct
gccacctccctcccagctaa

SEQ ID NO: 2152 - DNA, 26 bp, Artificial Sequence
  Synthetic Construct
gcactttgcctttgatgcctgaaata

SEQ ID NO: 2153 - DNA, 23 bp, Artificial Sequence
  Synthetic Construct
ccgcacagtagcacctctgtaag

SEQ ID NO: 2154 - DNA, 20 bp, Artificial Sequence
  Synthetic Construct
ggcctcctcctctccccatt

SEQ ID NO: 2155 - DNA, 21 bp, Artificial Sequence
  Synthetic Construct
tcccacccctcgatccccata

SEQ ID NO: 2156 - DNA, 21 bp, Artificial Sequence
  Synthetic Construct
gaaggacatggccatcagcaa

SEQ ID NO: 2157 - DNA, 19 bp, Artificial Sequence
  Synthetic Construct
aggcagagggcggtgtctt

SEQ ID NO: 2158 - DNA, 19 bp, Artificial Sequence
  Synthetic Construct
cgtctgccttcctgggttt

SEQ ID NO: 2159 - DNA, 21 bp, Artificial Sequence
  Synthetic Construct
aggtgaccatgtgaccacaga

SEQ ID NO: 2160 - DNA, 25 bp, Artificial Sequence
  Synthetic Construct
gggtagcttattggggttcagttct

SEQ ID NO: 2161 - DNA, 22 bp, Artificial Sequence
  Synthetic Construct
gccgttattgcaggcacaatct

SEQ ID NO: 2162 - DNA, 20 bp, Artificial Sequence
  Synthetic Construct
aagcaggcaggaaggagaca

SEQ ID NO: 2163 - DNA, 22 bp, Artificial Sequence
  Synthetic Construct
tggaccaactctcacagcagat

SEQ ID NO: 2164 - DNA, 23 bp, Artificial Sequence
  Synthetic Construct
caggccaatggacagtgaagcta

SEQ ID NO: 2165 - DNA, 21 bp, Artificial Sequence
  Synthetic Construct
ggtggcgaaggggtagtgaaa

SEQ ID NO: 2166 - DNA, 20 bp, Artificial Sequence
  Synthetic Construct
acttcccgggcctggcttct

SEQ ID NO: 2167 - DNA, 24 bp, Artificial Sequence
  Synthetic Construct
gctaggaaccttccaggcatttta

SEQ ID NO: 2168 - DNA, 27 bp, Artificial Sequence
  Synthetic Construct
gttctgactttctagtaaccaccgatt

SEQ ID NO: 2169 - DNA, 19 bp, Artificial Sequence
  Synthetic Construct
tccacagccgtgcatctga

SEQ ID NO: 2170 - DNA, 23 bp, Artificial Sequence
  Synthetic Construct
gtgatgccaacttgggcctatga

SEQ ID NO: 2171 - DNA, 22 bp, Artificial Sequence
  Synthetic Construct
gctgaaagctttgctggcttct

SEQ ID NO: 2172 - DNA, 27 bp, Artificial Sequence
  Synthetic Construct
caatgggtaactaggcaagggaattat

SEQ ID NO: 2173 - DNA, 24 bp, Artificial Sequence
  Synthetic Construct
cccggcctccttataatggaaaga

SEQ ID NO: 2174 - DNA, 21 bp, Artificial Sequence
  Synthetic Construct
gccagttctggcgatggctaa

SEQ ID NO: 2175 - DNA, 22 bp, Artificial Sequence
  Synthetic Construct
ttccctaccccttccccagaac

SEQ ID NO: 2176 - DNA, 23 bp, Artificial Sequence
  Synthetic Construct
ggaagaaagccctctcgagacaa

SEQ ID NO: 2177 - DNA, 26 bp, Artificial Sequence
  Synthetic Construct
gaactagccaccttgatgtcatctgt

SEQ ID NO: 2178 - DNA, 21 bp, Artificial Sequence
  Synthetic Construct
tgcccaccagtgagactaaac

SEQ ID NO: 2179 - DNA, 22 bp, Artificial Sequence
  Synthetic Construct
gcaggtgctaagtgtcctgctt

SEQ ID NO: 2180 - DNA, 25 bp, Artificial Sequence
  Synthetic Construct
gagttcctttccctccagtttcttg

SEQ ID NO: 2181 - DNA, 20 bp, Artificial Sequence
  Synthetic Construct
gccagctgaggactctcctt

SEQ ID NO: 2182 - DNA, 22 bp, Artificial Sequence
  Synthetic Construct
cagtgccagtggaatcccagat

SEQ ID NO: 2183 - DNA, 22 bp, Artificial Sequence
  Synthetic Construct
ctcagcctccctgagaacaaac

SEQ ID NO: 2184 - DNA, 20 bp, Artificial Sequence
  Synthetic Construct
gccatgccctttccaacctt

SEQ ID NO: 2185 - DNA, 20 bp, Artificial Sequence
  Synthetic Construct
acagactgcgtgtcctgcaa

SEQ ID NO: 2186 - DNA, 23 bp, Artificial Sequence
  Synthetic Construct
gattacgaacgtagggcacaaac

SEQ ID NO: 2187 - DNA, 23 bp, Artificial Sequence
  Synthetic Construct
cccaggggttcctgaagtgaaaa

SEQ ID NO: 2188 - DNA, 22 bp, Artificial Sequence
  Synthetic Construct
gcccatccccaggagttaggat

SEQ ID NO: 2189 - DNA, 24 bp, Artificial Sequence
  Synthetic Construct
aacttcctcaaacttccactccat

SEQ ID NO: 2190 - DNA, 21 bp, Artificial Sequence
  Synthetic Construct
ggctttgagagcagggttgaa

SEQ ID NO: 2191 - DNA, 20 bp, Artificial Sequence
  Synthetic Construct
ccacgttgggatgtgaggtt

SEQ ID NO: 2192 - DNA, 22 bp, Artificial Sequence
  Synthetic Construct
ctggagccaggaagccaagaaa

SEQ ID NO: 2193 - DNA, 22 bp, Artificial Sequence
  Synthetic Construct
ggatgtctgctgttgcctcttc

SEQ ID NO: 2194 - DNA, 21 bp, Artificial Sequence
  Synthetic Construct
ttccagagggctccacccaaa

SEQ ID NO: 2195 - DNA, 22 bp, Artificial Sequence
  Synthetic Construct
ctcggtctcctcgtacctactt

SEQ ID NO: 2196 - DNA, 22 bp, Artificial Sequence
  Synthetic Construct
acgacccacttcctccttctgt

SEQ ID NO: 2197 - DNA, 25 bp, Artificial Sequence
  Synthetic Construct
ccaagatgctcatccaagaatggaa

SEQ ID NO: 2198 - DNA, 21 bp, Artificial Sequence
  Synthetic Construct
tgaaaaaccctggggagcaaa

SEQ ID NO: 2199 - DNA, 22 bp, Artificial Sequence
  Synthetic Construct
gagagggccaagatgggaacat

SEQ ID NO: 2200 - DNA, 20 bp, Artificial Sequence
  Synthetic Construct
ccccaacacactgcacagaa

SEQ ID NO: 2201 - DNA, 26 bp, Artificial Sequence
  Synthetic Construct
ctgctctgctcaatccataccatttc

SEQ ID NO: 2202 - DNA, 20 bp, Artificial Sequence
  Synthetic Construct
caagggcaagcccagtgtct

SEQ ID NO: 2203 - DNA, 19 bp, Artificial Sequence
  Synthetic Construct
cggggaggccatcactgtt

SEQ ID NO: 2204 - DNA, 21 bp, Artificial Sequence
  Synthetic Construct
gcccatggtcactagctcaaa

SEQ ID NO: 2205 - DNA, 22 bp, Artificial Sequence
  Synthetic Construct
gctcccagatgtttcggatcaa

SEQ ID NO: 2206 - DNA, 20 bp, Artificial Sequence
  Synthetic Construct
tccccaggtgtctgtggaaa

SEQ ID NO: 2207 - DNA, 21 bp, Artificial Sequence
  Synthetic Construct
gttcagcccaacctggaaagt

SEQ ID NO: 2208 - DNA, 26 bp, Artificial Sequence
  Synthetic Construct
gatttttcaaggacctactggacact

SEQ ID NO: 2209 - DNA, 22 bp, Artificial Sequence
  Synthetic Construct
cccaaggcagtggtatttccaa

SEQ ID NO: 2210 - DNA, 21 bp, Artificial Sequence
  Synthetic Construct
agggtggtggcctacaggatt

SEQ ID NO: 2211 - DNA, 20 bp, Artificial Sequence
  Synthetic Construct
tacaacgcgccaggtgtaac

SEQ ID NO: 2212 - DNA, 20 bp, Artificial Sequence
  Synthetic Construct
acagcggcctccttcctttt

SEQ ID NO: 2213 - DNA, 23 bp, Artificial Sequence
  Synthetic Construct
ttgcatggttgaatgcactgtag

SEQ ID NO: 2214 - DNA, 21 bp, Artificial Sequence
  Synthetic Construct
acctcaggatgctgccatttg

SEQ ID NO: 2215 - DNA, 19 bp, Artificial Sequence
  Synthetic Construct
cagcagctggtgggcaaag

SEQ ID NO: 2216 - DNA, 22 bp, Artificial Sequence
  Synthetic Construct
gagccacctgaaaccaccaaag

SEQ ID NO: 2217 - DNA, 20 bp, Artificial Sequence
  Synthetic Construct
gcccttgcggctctacatta

SEQ ID NO: 2218 - DNA, 20 bp, Artificial Sequence
  Synthetic Construct
tgaggcaggcattggacatt

SEQ ID NO: 2219 - DNA, 24 bp, Artificial Sequence
  Synthetic Construct
tcttgctttgcctaacagggtatt

SEQ ID NO: 2220 - DNA, 23 bp, Artificial Sequence
  Synthetic Construct
gcatttttggcccactgaacact

SEQ ID NO: 2221 - DNA, 24 bp, Artificial Sequence
  Synthetic Construct
ggtgccaagctgagaaggtacttg

SEQ ID NO: 2222 - DNA, 20 bp, Artificial Sequence
  Synthetic Construct
gcagaagagcctcacacact

SEQ ID NO: 2223 - DNA, 23 bp, Artificial Sequence
  Synthetic Construct
ggaaatggctggcctgtaacctt

SEQ ID NO: 2224 - DNA, 23 bp, Artificial Sequence
  Synthetic Construct
aatctcctggtcccacccctact

SEQ ID NO: 2225 - DNA, 19 bp, Artificial Sequence
  Synthetic Construct
tggcaccctggctctctct

SEQ ID NO: 2226 - DNA, 21 bp, Artificial Sequence
  Synthetic Construct
agctcagccagtgcttgattt

SEQ ID NO: 2227 - DNA, 18 bp, Artificial Sequence
  Synthetic Construct
aaggggcggcaacattca

SEQ ID NO: 2228 - DNA, 20 bp, Artificial Sequence
  Synthetic Construct
atgtactgtgcccgcgactt

SEQ ID NO: 2229 - DNA, 23 bp, Artificial Sequence
  Synthetic Construct
gccactgacaaattgccgagttt

SEQ ID NO: 2230 - DNA, 23 bp, Artificial Sequence
  Synthetic Construct
gggtagacatggtggacgtggat

SEQ ID NO: 2231 - DNA, 20 bp, Artificial Sequence
  Synthetic Construct
cctcagcagtgccacaaatg

SEQ ID NO: 2232 - DNA, 23 bp, Artificial Sequence
  Synthetic Construct
gctcatggggctgaagatagaca

SEQ ID NO: 2233 - DNA, 21 bp, Artificial Sequence
  Synthetic Construct
aggtctgtggccctagcatgt

SEQ ID NO: 2234 - DNA, 22 bp, Artificial Sequence
  Synthetic Construct
accctggtcattgctggaaaag

SEQ ID NO: 2235 - DNA, 22 bp, Artificial Sequence
  Synthetic Construct
ccaacatcccagccaaatcaag

SEQ ID NO: 2236 - DNA, 21 bp, Artificial Sequence
  Synthetic Construct
ggtgacggtgtcttcacttca

SEQ ID NO: 2237 - DNA, 22 bp, Artificial Sequence
  Synthetic Construct
ggtatcagacagccctgcatct

SEQ ID NO: 2238 - DNA, 20 bp, Artificial Sequence
  Synthetic Construct
agtcgcgtctggtagagcat

SEQ ID NO: 2239 - DNA, 19 bp, Artificial Sequence
  Synthetic Construct
tgctgccgtggctctcaca

SEQ ID NO: 2240 - DNA, 22 bp, Artificial Sequence
  Synthetic Construct
accctcatccagcactccacta

SEQ ID NO: 2241 - DNA, 21 bp, Artificial Sequence
  Synthetic Construct
tgtttcagcctccaacgtgat

SEQ ID NO: 2242 - DNA, 20 bp, Artificial Sequence
  Synthetic Construct
atctccagacgtcggcaatg

SEQ ID NO: 2243 - DNA, 21 bp, Artificial Sequence
  Synthetic Construct
gcagggaagaggcagcattga

SEQ ID NO: 2244 - DNA, 20 bp, Artificial Sequence
  Synthetic Construct
agcgtgtgcagggtaatgaa

SEQ ID NO: 2245 - DNA, 22 bp, Artificial Sequence
  Synthetic Construct
gttctccactgcgtggtgacta

SEQ ID NO: 2246 - DNA, 24 bp, Artificial Sequence
  Synthetic Construct
actgctgatttttctccagaccat

SEQ ID NO: 2247 - DNA, 20 bp, Artificial Sequence
  Synthetic Construct
aatccggttcccacctccat

SEQ ID NO: 2248 - DNA, 23 bp, Artificial Sequence
  Synthetic Construct
gggaggtggtggagtcagaatca

SEQ ID NO: 2249 - DNA, 25 bp, Artificial Sequence
  Synthetic Construct
acacacagctaaaagaaagcagttg

SEQ ID NO: 2250 - DNA, 21 bp, Artificial Sequence
  Synthetic Construct
acctttgtgcctgctgaatct

SEQ ID NO: 2251 - DNA, 20 bp, Artificial Sequence
  Synthetic Construct
gactggctggcaccaagatt

SEQ ID NO: 2252 - DNA, 25 bp, Artificial Sequence
  Synthetic Construct
ccttctacagacattgcaggtcatc

SEQ ID NO: 2253 - DNA, 26 bp, Artificial Sequence
  Synthetic Construct
ggacaatgattttgagctacggtgta

SEQ ID NO: 2254 - DNA, 21 bp, Artificial Sequence
  Synthetic Construct
aacccacagggtcccctaaca

SEQ ID NO: 2255 - DNA, 22 bp, Artificial Sequence
  Synthetic Construct
cactgccaggggaagaaactga

SEQ ID NO: 2256 - DNA, 25 bp, Artificial Sequence
  Synthetic Construct
gtctatgccagttgctagaggaaac

SEQ ID NO: 2257 - DNA, 20 bp, Artificial Sequence
  Synthetic Construct
ggggaccatcagtgccatct

SEQ ID NO: 2258 - DNA, 19 bp, Artificial Sequence
  Synthetic Construct
ccgccaggcttcagacctt

SEQ ID NO: 2259 - DNA, 18 bp, Artificial Sequence
  Synthetic Construct
tgggcctcccctgaacaa

SEQ ID NO: 2260 - DNA, 24 bp, Artificial Sequence
  Synthetic Construct
gaggagtcaaggaatcgaggatga

SEQ ID NO: 2261 - DNA, 25 bp, Artificial Sequence
  Synthetic Construct
ggtaatgtgtagaccccacagttca

SEQ ID NO: 2262 - DNA, 21 bp, Artificial Sequence
  Synthetic Construct
tgaacccacagccccatctca

SEQ ID NO: 2263 - DNA, 20 bp, Artificial Sequence
  Synthetic Construct
acctgcggcaagatctcagt

SEQ ID NO: 2264 - DNA, 20 bp, Artificial Sequence
  Synthetic Construct
tgctgggtccctggatggat

SEQ ID NO: 2265 - DNA, 22 bp, Artificial Sequence
  Synthetic Construct
actctccaccaggcatgcagat

SEQ ID NO: 2266 - DNA, 22 bp, Artificial Sequence
  Synthetic Construct
tctgagagaggctggctacctt

SEQ ID NO: 2267 - DNA, 21 bp, Artificial Sequence
  Synthetic Construct
agcctgaggacttggcagtca

SEQ ID NO: 2268 - DNA, 20 bp, Artificial Sequence
  Synthetic Construct
tcgggcaactgctcctctgt

SEQ ID NO: 2269 - DNA, 20 bp, Artificial Sequence
  Synthetic Construct
gggacaactttggggcttga

SEQ ID NO: 2270 - DNA, 20 bp, Artificial Sequence
  Synthetic Construct
ggccaagctttcagcctttc

SEQ ID NO: 2271 - DNA, 24 bp, Artificial Sequence
  Synthetic Construct
ctggatgagaatggttggcctaat

SEQ ID NO: 2272 - DNA, 19 bp, Artificial Sequence
  Synthetic Construct
agcgagccctgcagcaaga

SEQ ID NO: 2273 - DNA, 22 bp, Artificial Sequence
  Synthetic Construct
cagagcagggctgtcattgtct

SEQ ID NO: 2274 - DNA, 24 bp, Artificial Sequence
  Synthetic Construct
caggaaatccaggggacagaagaa

SEQ ID NO: 2275 - DNA, 22 bp, Artificial Sequence
  Synthetic Construct
ggccaaacacatcagggagcaa

SEQ ID NO: 2276 - DNA, 20 bp, Artificial Sequence
  Synthetic Construct
tggggctgctgggagaggaa

SEQ ID NO: 2277 - DNA, 20 bp, Artificial Sequence
  Synthetic Construct
gggtggcaaccctcagattc

SEQ ID NO: 2278 - DNA, 24 bp, Artificial Sequence
  Synthetic Construct
cttgtttgccagatttacctgtgt

SEQ ID NO: 2279 - DNA, 20 bp, Artificial Sequence
  Synthetic Construct
gcttgtggtcctgggtgtca

SEQ ID NO: 2280 - DNA, 22 bp, Artificial Sequence
  Synthetic Construct
aaggcgaggtcacctgagtaag

SEQ ID NO: 2281 - DNA, 23 bp, Artificial Sequence
  Synthetic Construct
ccagaagaggtgtggcctgaaag

SEQ ID NO: 2282 - DNA, 21 bp, Artificial Sequence
  Synthetic Construct
cagtcagtagagggcgctgtt

SEQ ID NO: 2283 - DNA, 24 bp, Artificial Sequence
  Synthetic Construct
ggatgggaatgggtaaggcacaga

SEQ ID NO: 2284 - DNA, 23 bp, Artificial Sequence
  Synthetic Construct
ggagcttttgactggggttcact

SEQ ID NO: 2285 - DNA, 22 bp, Artificial Sequence
  Synthetic Construct
ccaaggtccctggtctggaagt

SEQ ID NO: 2286 - DNA, 20 bp, Artificial Sequence
  Synthetic Construct
gggcagagcaatagccgaaa

SEQ ID NO: 2287 - DNA, 21 bp, Artificial Sequence
  Synthetic Construct
ggcccacgtggtcagattgtt

SEQ ID NO: 2288 - DNA, 23 bp, Artificial Sequence
  Synthetic Construct
cgagagcctgagcatgtacaaat

SEQ ID NO: 2289 - DNA, 28 bp, Artificial Sequence
  Synthetic Construct
gttatcttctcactgtcctgttccttag

SEQ ID NO: 2290 - DNA, 22 bp, Artificial Sequence
  Synthetic Construct
gcttctgcccagtgctcaagat

SEQ ID NO: 2291 - DNA, 25 bp, Artificial Sequence
  Synthetic Construct
ggctctgtagggcttctagaatgtt

SEQ ID NO: 2292 - DNA, 22 bp, Artificial Sequence
  Synthetic Construct
gggtgtagagcaggatgggtta

SEQ ID NO: 2293 - DNA, 24 bp, Artificial Sequence
  Synthetic Construct
gtccccgaaacccacactgtattc

SEQ ID NO: 2294 - DNA, 21 bp, Artificial Sequence
  Synthetic Construct
cccaaaactgaggtggagctt

SEQ ID NO: 2295 - DNA, 21 bp, Artificial Sequence
  Synthetic Construct
gtgaccagtgctagctgacaa

SEQ ID NO: 2296 - DNA, 22 bp, Artificial Sequence
  Synthetic Construct
ttccggaggtcagatcccaaga

SEQ ID NO: 2297 - DNA, 19 bp, Artificial Sequence
  Synthetic Construct
cagctcatccgcccacaga

SEQ ID NO: 2298 - DNA, 19 bp, Artificial Sequence
  Synthetic Construct
agggagcagcgcgactgaa

SEQ ID NO: 2299 - DNA, 23 bp, Artificial Sequence
  Synthetic Construct
ggcagtggggtccatttgaaaca

SEQ ID NO: 2300 - DNA, 21 bp, Artificial Sequence
  Synthetic Construct
tctccagaagcctcgccttga

SEQ ID NO: 2301 - DNA, 23 bp, Artificial Sequence
  Synthetic Construct
gccgcatgtctctacttcttctt

SEQ ID NO: 2302 - DNA, 20 bp, Artificial Sequence
  Synthetic Construct
aggccgagcagctttagtct

SEQ ID NO: 2303 - DNA, 23 bp, Artificial Sequence
  Synthetic Construct
tcaagatggagcacaacaaccaa

SEQ ID NO: 2304 - DNA, 22 bp, Artificial Sequence
  Synthetic Construct
gtgttgagcaggcaacttgtga

SEQ ID NO: 2305 - DNA, 21 bp, Artificial Sequence
  Synthetic Construct
actcatcaccttggcatgctt

SEQ ID NO: 2306 - DNA, 25 bp, Artificial Sequence
  Synthetic Construct
tcagccaagaaggtatttgttggaa

SEQ ID NO: 2307 - DNA, 23 bp, Artificial Sequence
  Synthetic Construct
caatgcaggagcttctccacaaa

SEQ ID NO: 2308 - DNA, 22 bp, Artificial Sequence
  Synthetic Construct
cccaccaaagggagccaattct

SEQ ID NO: 2309 - DNA, 21 bp, Artificial Sequence
  Synthetic Construct
ctttgccctggcatctgaaac

SEQ ID NO: 2310 - DNA, 20 bp, Artificial Sequence
  Synthetic Construct
ctctggcacctggaaacact

SEQ ID NO: 2311 - DNA, 24 bp, Artificial Sequence
  Synthetic Construct
tcatccatcctgagccaaatttct

SEQ ID NO: 2312 - DNA, 24 bp, Artificial Sequence
  Synthetic Construct
aaatccagccacaggatgatacaa

SEQ ID NO: 2313 - DNA, 23 bp, Artificial Sequence
  Synthetic Construct
gcaccaaggaagcatcaggtact

SEQ ID NO: 2314 - DNA, 20 bp, Artificial Sequence
  Synthetic Construct
ctgctcaggggccagacttc

SEQ ID NO: 2315 - DNA, 27 bp, Artificial Sequence
  Synthetic Construct
gaagagcagtttcacttatctgtgtca

SEQ ID NO: 2316 - DNA, 23 bp, Artificial Sequence
  Synthetic Construct
gcctccggatctgttgctagtga

SEQ ID NO: 2317 - DNA, 22 bp, Artificial Sequence
  Synthetic Construct
aggggagcctcagcatcctaaa

SEQ ID NO: 2318 - DNA, 19 bp, Artificial Sequence
  Synthetic Construct
cggctgactgcagttgtct

SEQ ID NO: 2319 - DNA, 20 bp, Artificial Sequence
  Synthetic Construct
tcgcttcgggctttcagcaa

SEQ ID NO: 2320 - DNA, 23 bp, Artificial Sequence
  Synthetic Construct
gatcagaactcctggcatgatga

SEQ ID NO: 2321 - DNA, 20 bp, Artificial Sequence
  Synthetic Construct
gagagcccctcaggctcttg

SEQ ID NO: 2322 - DNA, 22 bp, Artificial Sequence
  Synthetic Construct
ccccaggagagctggtgtatga

SEQ ID NO: 2323 - DNA, 21 bp, Artificial Sequence
  Synthetic Construct
actgtcctgttccacccttca

SEQ ID NO: 2324 - DNA, 22 bp, Artificial Sequence
  Synthetic Construct
agggcccctactaccactttag

SEQ ID NO: 2325 - DNA, 24 bp, Artificial Sequence
  Synthetic Construct
gaccagggaagaaagacctctgaa

SEQ ID NO: 2326 - DNA, 22 bp, Artificial Sequence
  Synthetic Construct
tggacactgccgtaaggtgaag

SEQ ID NO: 2327 - DNA, 22 bp, Artificial Sequence
  Synthetic Construct
gcctttccacctcgatgtcttc

SEQ ID NO: 2328 - DNA, 20 bp, Artificial Sequence
  Synthetic Construct
ttcccatggcagatgctgtt

SEQ ID NO: 2329 - DNA, 24 bp, Artificial Sequence
  Synthetic Construct
ggggataaatgtcacaagctggat

SEQ ID NO: 2330 - DNA, 26 bp, Artificial Sequence
  Synthetic Construct
ggcttactatgcctgctaaacattac

SEQ ID NO: 2331 - DNA, 23 bp, Artificial Sequence
  Synthetic Construct
tggtacctgatatgcagccattg

SEQ ID NO: 2332 - DNA, 21 bp, Artificial Sequence
  Synthetic Construct
aggcagggcaaatggtgtatc

SEQ ID NO: 2333 - DNA, 24 bp, Artificial Sequence
  Synthetic Construct
gcagacctactgacccctttggtt

SEQ ID NO: 2334 - DNA, 25 bp, Artificial Sequence
  Synthetic Construct
cagtactgagtcccttgtgtttttg

SEQ ID NO: 2335 - DNA, 21 bp, Artificial Sequence
  Synthetic Construct
catcactcccctctgctgcta

SEQ ID NO: 2336 - DNA, 20 bp, Artificial Sequence
  Synthetic Construct
aggccactgccttctacctt

SEQ ID NO: 2337 - DNA, 18 bp, Artificial Sequence
  Synthetic Construct
acgagggctggcacgaaa

SEQ ID NO: 2338 - DNA, 24 bp, Artificial Sequence
  Synthetic Construct
gacagcttgcagtcaagaccttct

SEQ ID NO: 2339 - DNA, 23 bp, Artificial Sequence
  Synthetic Construct
catggggaatgggtcagtacagt

SEQ ID NO: 2340 - DNA, 24 bp, Artificial Sequence
  Synthetic Construct
gccagtggaggtagtagcatttac

SEQ ID NO: 2341 - DNA, 23 bp, Artificial Sequence
  Synthetic Construct
gttacagcatcaagtgcaacagt

SEQ ID NO: 2342 - DNA, 22 bp, Artificial Sequence
  Synthetic Construct
tgaggatttcctgggacacaga

SEQ ID NO: 2343 - DNA, 20 bp, Artificial Sequence
  Synthetic Construct
agcggctgtgtgcagaatca

SEQ ID NO: 2344 - DNA, 22 bp, Artificial Sequence
  Synthetic Construct
actgcctccaatgacccaggat

SEQ ID NO: 2345 - DNA, 20 bp, Artificial Sequence
  Synthetic Construct
tccctgcgttgcttctcact

SEQ ID NO: 2346 - DNA, 21 bp, Artificial Sequence
  Synthetic Construct
ttggactccagtgctttgcat

SEQ ID NO: 2347 - DNA, 24 bp, Artificial Sequence
  Synthetic Construct
tcttttggcactacgagctatgaa

SEQ ID NO: 2348 - DNA, 23 bp, Artificial Sequence
  Synthetic Construct
ccaaagcacattagcctgtgatg

SEQ ID NO: 2349 - DNA, 19 bp, Artificial Sequence
  Synthetic Construct
tggcccaggtccattctct

SEQ ID NO: 2350 - DNA, 25 bp, Artificial Sequence
  Synthetic Construct
ggaaaacaacttgtccctcactttg

SEQ ID NO: 2351 - DNA, 21 bp, Artificial Sequence
  Synthetic Construct
aggagggtacctccgtctcta

SEQ ID NO: 2352 - DNA, 24 bp, Artificial Sequence
  Synthetic Construct
gtaggcttccaatgccaagaaatg

SEQ ID NO: 2353 - DNA, 23 bp, Artificial Sequence
  Synthetic Construct
ctcaggcatggacacctatcttc

SEQ ID NO: 2354 - DNA, 20 bp, Artificial Sequence
  Synthetic Construct
agctcccactccaactcaga

SEQ ID NO: 2355 - DNA, 20 bp, Artificial Sequence
  Synthetic Construct
gcaggcgagactccccaaac

SEQ ID NO: 2356 - DNA, 20 bp, Artificial Sequence
  Synthetic Construct
tgcactcttgcggaggaaaa

SEQ ID NO: 2357 - DNA, 19 bp, Artificial Sequence
  Synthetic Construct
gctcaggctggcttgaaca

SEQ ID NO: 2358 - DNA, 22 bp, Artificial Sequence
  Synthetic Construct
ggctggacagttggttgctgat

SEQ ID NO: 2359 - DNA, 20 bp, Artificial Sequence
  Synthetic Construct
agatcagcgaccctgaggaa

SEQ ID NO: 2360 - DNA, 20 bp, Artificial Sequence
  Synthetic Construct
aggcaccccttactgtgaga

SEQ ID NO: 2361 - DNA, 23 bp, Artificial Sequence
  Synthetic Construct
ccaggatggagaatgcagacaca

SEQ ID NO: 2362 - DNA, 23 bp, Artificial Sequence
  Synthetic Construct
agaccagaatggatggaggtgta

SEQ ID NO: 2363 - DNA, 22 bp, Artificial Sequence
  Synthetic Construct
cgctacctcctcaagccagaaa

SEQ ID NO: 2364 - DNA, 20 bp, Artificial Sequence
  Synthetic Construct
tggcagccctccaccatttt

SEQ ID NO: 2365 - DNA, 22 bp, Artificial Sequence
  Synthetic Construct
tggcaggtgacaaggtgaattt

SEQ ID NO: 2366 - DNA, 24 bp, Artificial Sequence
  Synthetic Construct
aattccctacggagtgaaacacaa

SEQ ID NO: 2367 - DNA, 25 bp, Artificial Sequence
  Synthetic Construct
tgtgtaagggcaggataaaacaact

SEQ ID NO: 2368 - DNA, 22 bp, Artificial Sequence
  Synthetic Construct
acctcaacctctgtgtgtgttc

SEQ ID NO: 2369 - DNA, 23 bp, Artificial Sequence
  Synthetic Construct
ccacagtgagggtgaacaatcat

SEQ ID NO: 2370 - DNA, 20 bp, Artificial Sequence
  Synthetic Construct
cctcactcccctcctgtctt

SEQ ID NO: 2371 - DNA, 27 bp, Artificial Sequence
  Synthetic Construct
acagctagtctggataaaacctagaga

SEQ ID NO: 2372 - DNA, 25 bp, Artificial Sequence
  Synthetic Construct
cattctctgtacattggagggaact

SEQ ID NO: 2373 - DNA, 23 bp, Artificial Sequence
  Synthetic Construct
ggtgggacgagtcaatcactaag

SEQ ID NO: 2374 - DNA, 19 bp, Artificial Sequence
  Synthetic Construct
caccgtgcccagcctgtaa

SEQ ID NO: 2375 - DNA, 23 bp, Artificial Sequence
  Synthetic Construct
ggcatgttagcgagcattttaca

SEQ ID NO: 2376 - DNA, 23 bp, Artificial Sequence
  Synthetic Construct
gttctcgttcagacagtggttct

SEQ ID NO: 2377 - DNA, 25 bp, Artificial Sequence
  Synthetic Construct
caggaacctcatcctgagttgattt

SEQ ID NO: 2378 - DNA, 21 bp, Artificial Sequence
  Synthetic Construct
tcttgctggaccagagtgtga

SEQ ID NO: 2379 - DNA, 21 bp, Artificial Sequence
  Synthetic Construct
aggcccgagggagtttgtttg

SEQ ID NO: 2380 - DNA, 22 bp, Artificial Sequence
  Synthetic Construct
ggccctcaaagtggtgaagagt

SEQ ID NO: 2381 - DNA, 22 bp, Artificial Sequence
  Synthetic Construct
ccttgcctgagctggtatttct

SEQ ID NO: 2382 - DNA, 21 bp, Artificial Sequence
  Synthetic Construct
tgtggctacaactcaggcaaa

SEQ ID NO: 2383 - DNA, 23 bp, Artificial Sequence
  Synthetic Construct
gacattgcttgacttgggtgtgt

SEQ ID NO: 2384 - DNA, 23 bp, Artificial Sequence
  Synthetic Construct
ctcaccgctcccatgaatgaatc

SEQ ID NO: 2385 - DNA, 21 bp, Artificial Sequence
  Synthetic Construct
tgtgtgctgacaggtttgtga

SEQ ID NO: 2386 - DNA, 22 bp, Artificial Sequence
  Synthetic Construct
gcaacaggagctacttgccaaa

SEQ ID NO: 2387 - DNA, 20 bp, Artificial Sequence
  Synthetic Construct
gcccctgttgttgtgctgat

SEQ ID NO: 2388 - DNA, 22 bp, Artificial Sequence
  Synthetic Construct
ggctgcagcataaggaatgtga

SEQ ID NO: 2389 - DNA, 24 bp, Artificial Sequence
  Synthetic Construct
gcagaccattgcttggaggagata

SEQ ID NO: 2390 - DNA, 22 bp, Artificial Sequence
  Synthetic Construct
ctgagctgggaagactcaaact

SEQ ID NO: 2391 - DNA, 22 bp, Artificial Sequence
  Synthetic Construct
gcaactttaggccagctgagtt

SEQ ID NO: 2392 - DNA, 22 bp, Artificial Sequence
  Synthetic Construct
aagacagggtgggagatgtagt

SEQ ID NO: 2393 - DNA, 22 bp, Artificial Sequence
  Synthetic Construct
cctggatttgggcatacgtgaa

SEQ ID NO: 2394 - DNA, 22 bp, Artificial Sequence
  Synthetic Construct
ttccctgaactcttgctggttt

SEQ ID NO: 2395 - DNA, 23 bp, Artificial Sequence
  Synthetic Construct
gggttgaaactggaggcttgttc

SEQ ID NO: 2396 - DNA, 24 bp, Artificial Sequence
  Synthetic Construct
actctgtaccgggtatttcacact

SEQ ID NO: 2397 - DNA, 23 bp, Artificial Sequence
  Synthetic Construct
gcccatccagacccttctaattg

SEQ ID NO: 2398 - DNA, 19 bp, Artificial Sequence
  Synthetic Construct
cagcctcgtgcagcagttg

SEQ ID NO: 2399 - DNA, 24 bp, Artificial Sequence
  Synthetic Construct
agaaccccatacctgcattacaaa

SEQ ID NO: 2400 - DNA, 21 bp, Artificial Sequence
  Synthetic Construct
tcccctggaacctccaaaact

SEQ ID NO: 2401 - DNA, 24 bp, Artificial Sequence
  Synthetic Construct
gcttaagccacagaaaggcacaac

SEQ ID NO: 2402 - DNA, 21 bp, Artificial Sequence
  Synthetic Construct
cgagtgccctggaacctgaaa

SEQ ID NO: 2403 - DNA, 21 bp, Artificial Sequence
  Synthetic Construct
agccaccactcctgcttctga

SEQ ID NO: 2404 - DNA, 20 bp, Artificial Sequence
  Synthetic Construct
ttggggacccctggactaag

SEQ ID NO: 2405 - DNA, 26 bp, Artificial Sequence
  Synthetic Construct
cctccccagtatcttaccactacaac

SEQ ID NO: 2406 - DNA, 22 bp, Artificial Sequence
  Synthetic Construct
caccaagccctcaactcctaaa

SEQ ID NO: 2407 - DNA, 25 bp, Artificial Sequence
  Synthetic Construct
gaagtgaaagaaaatggcaggaact

SEQ ID NO: 2408 - DNA, 27 bp, Artificial Sequence
  Synthetic Construct
gctggtattgttttggggatagaggtt

SEQ ID NO: 2409 - DNA, 26 bp, Artificial Sequence
  Synthetic Construct
gtggaggaaattagatgtctgcttct

SEQ ID NO: 2410 - DNA, 21 bp, Artificial Sequence
  Synthetic Construct
gggcaagtccctcacaccttt

SEQ ID NO: 2411 - DNA, 21 bp, Artificial Sequence
  Synthetic Construct
tgaggtctggctgcaggagta

SEQ ID NO: 2412 - DNA, 22 bp, Artificial Sequence
  Synthetic Construct
ctgaagcccaagtggcaagaag

SEQ ID NO: 2413 - DNA, 22 bp, Artificial Sequence
  Synthetic Construct
aagtcctgagcctgagttcttg

SEQ ID NO: 2414 - DNA, 21 bp, Artificial Sequence
  Synthetic Construct
tctcagggtgcctggaaaaag

SEQ ID NO: 2415 - DNA, 24 bp, Artificial Sequence
  Synthetic Construct
gcactgcaaaagaagaggctattg

SEQ ID NO: 2416 - DNA, 20 bp, Artificial Sequence
  Synthetic Construct
tgggaaccagccctttggaa

SEQ ID NO: 2417 - DNA, 29 bp, Artificial Sequence
  Synthetic Construct
ggcttcactatcaagaagggccttgattt

SEQ ID NO: 2418 - DNA, 18 bp, Artificial Sequence
  Synthetic Construct
aagaggccacccgcttct

SEQ ID NO: 2419 - DNA, 19 bp, Artificial Sequence
  Synthetic Construct
tggagcaggctggcgctaa

SEQ ID NO: 2420 - DNA, 21 bp, Artificial Sequence
  Synthetic Construct
ccgaaaaccttccccgcttct

SEQ ID NO: 2421 - DNA, 24 bp, Artificial Sequence
  Synthetic Construct
ggaaggggaatttgtcagcgttta

SEQ ID NO: 2422 - DNA, 24 bp, Artificial Sequence
  Synthetic Construct
gcagtctcagcctttcctttgcat

SEQ ID NO: 2423 - DNA, 24 bp, Artificial Sequence
  Synthetic Construct
gttgggaagcatcttcctagacat

SEQ ID NO: 2424 - DNA, 24 bp, Artificial Sequence
  Synthetic Construct
gcctattttggagtcccaagtcaa

SEQ ID NO: 2425 - DNA, 18 bp, Artificial Sequence
  Synthetic Construct
tgggccacgttgcctact

SEQ ID NO: 2426 - DNA, 29 bp, Artificial Sequence
  Synthetic Construct
caccttattactaccttcctctcacaatg

SEQ ID NO: 2427 - DNA, 21 bp, Artificial Sequence
  Synthetic Construct
actggggtaaaggctggttgt

SEQ ID NO: 2428 - DNA, 21 bp, Artificial Sequence
  Synthetic Construct
aagcctcgtggccgactcaat

SEQ ID NO: 2429 - DNA, 21 bp, Artificial Sequence
  Synthetic Construct
aacagggcgtgagttttcctt

SEQ ID NO: 2430 - DNA, 23 bp, Artificial Sequence
  Synthetic Construct
ggagaggccagggcatttctaag

SEQ ID NO: 2431 - DNA, 23 bp, Artificial Sequence
  Synthetic Construct
cagcctgctaggaacacactgta

SEQ ID NO: 2432 - DNA, 23 bp, Artificial Sequence
  Synthetic Construct
ggtgattctggccgaacttgtct

SEQ ID NO: 2433 - DNA, 22 bp, Artificial Sequence
  Synthetic Construct
tggatcggaaacaccagactca

SEQ ID NO: 2434 - DNA, 26 bp, Artificial Sequence
  Synthetic Construct
cctgagaccgttgctagagaaacaag

SEQ ID NO: 2435 - DNA, 19 bp, Artificial Sequence
  Synthetic Construct
tgggatgcgggcatagaga

SEQ ID NO: 2436 - DNA, 20 bp, Artificial Sequence
  Synthetic Construct
tctcccaggcttcagtcctt

SEQ ID NO: 2437 - DNA, 23 bp, Artificial Sequence
  Synthetic Construct
ccaagttatgcctgctgctcaga

SEQ ID NO: 2438 - DNA, 24 bp, Artificial Sequence
  Synthetic Construct
gggaacctggaaagacctttactt

SEQ ID NO: 2439 - DNA, 25 bp, Artificial Sequence
  Synthetic Construct
ggtgggatagttgagaagggagtaa

SEQ ID NO: 2440 - DNA, 20 bp, Artificial Sequence
  Synthetic Construct
cctcagctcccgcctctaaa

SEQ ID NO: 2441 - DNA, 23 bp, Artificial Sequence
  Synthetic Construct
ggatgagcataagcagtggttca

SEQ ID NO: 2442 - DNA, 24 bp, Artificial Sequence
  Synthetic Construct
aggagtgagaagggagactcaatc

SEQ ID NO: 2443 - DNA, 19 bp, Artificial Sequence
  Synthetic Construct
tcaagtcccggctgccatt

SEQ ID NO: 2444 - DNA, 22 bp, Artificial Sequence
  Synthetic Construct
gacagagagatgagggctgagt

SEQ ID NO: 2445 - DNA, 24 bp, Artificial Sequence
  Synthetic Construct
aattgccagctgtattctccttct

SEQ ID NO: 2446 - DNA, 20 bp, Artificial Sequence
  Synthetic Construct
acagaggatggggcaccaaa

SEQ ID NO: 2447 - DNA, 25 bp, Artificial Sequence
  Synthetic Construct
gcatgaggatggaatggactcatca

SEQ ID NO: 2448 - DNA, 23 bp, Artificial Sequence
  Synthetic Construct
gaccttcaaggggagctcagtat

SEQ ID NO: 2449 - DNA, 24 bp, Artificial Sequence
  Synthetic Construct
tctgatatggaacccagggattgt

SEQ ID NO: 2450 - DNA, 20 bp, Artificial Sequence
  Synthetic Construct
tgcaccatcgctaggccatt

SEQ ID NO: 2451 - DNA, 24 bp, Artificial Sequence
  Synthetic Construct
gtcagttcacacgacacccttaga

SEQ ID NO: 2452 - DNA, 20 bp, Artificial Sequence
  Synthetic Construct
agcctggaaagctggcacaa

SEQ ID NO: 2453 - DNA, 21 bp, Artificial Sequence
  Synthetic Construct
ttcccagcctcctctgcatct

SEQ ID NO: 2454 - DNA, 22 bp, Artificial Sequence
  Synthetic Construct
ctcaaaggggaagaacgtcagt

SEQ ID NO: 2455 - DNA, 21 bp, Artificial Sequence
  Synthetic Construct
tctgcgtctcacttcctggta

SEQ ID NO: 2456 - DNA, 23 bp, Artificial Sequence
  Synthetic Construct
aaggtgacagaggtcttccaaag

SEQ ID NO: 2457 - DNA, 21 bp, Artificial Sequence
  Synthetic Construct
tcccaaatcctgagcctgtca

SEQ ID NO: 2458 - DNA, 22 bp, Artificial Sequence
  Synthetic Construct
ggagaaagagtggagagcaaca

SEQ ID NO: 2459 - DNA, 29 bp, Artificial Sequence
  Synthetic Construct
gactatacgataccaaatagccctacaag

SEQ ID NO: 2460 - DNA, 20 bp, Artificial Sequence
  Synthetic Construct
gtcacaagggaggcacttca

SEQ ID NO: 2461 - DNA, 20 bp, Artificial Sequence
  Synthetic Construct
agagctgccctggaactgaa

SEQ ID NO: 2462 - DNA, 24 bp, Artificial Sequence
  Synthetic Construct
ggaaaggtaccccagaatgaggtt

SEQ ID NO: 2463 - DNA, 23 bp, Artificial Sequence
  Synthetic Construct
ggtggtagaggctcatgtctctt

SEQ ID NO: 2464 - DNA, 22 bp, Artificial Sequence
  Synthetic Construct
tccccaaatcctttggcaatgt

SEQ ID NO: 2465 - DNA, 22 bp, Artificial Sequence
  Synthetic Construct
gtgtcaaagggcctgttcttgt

SEQ ID NO: 2466 - DNA, 24 bp, Artificial Sequence
  Synthetic Construct
ctctcatcagctgtttgctgttac

SEQ ID NO: 2467 - DNA, 25 bp, Artificial Sequence
  Synthetic Construct
gacctctttctccctgcacatgtaa

SEQ ID NO: 2468 - DNA, 24 bp, Artificial Sequence
  Synthetic Construct
ccttccttgaacttgcctctggta

SEQ ID NO: 2469 - DNA, 23 bp, Artificial Sequence
  Synthetic Construct
gctgtcaccaagactgagactga

SEQ ID NO: 2470 - DNA, 24 bp, Artificial Sequence
  Synthetic Construct
tgaaagctattgggacaacaggat

SEQ ID NO: 2471 - DNA, 27 bp, Artificial Sequence
  Synthetic Construct
caggaagataagtactgagccatgtgt

SEQ ID NO: 2472 - DNA, 23 bp, Artificial Sequence
  Synthetic Construct
gcacatgtctgcgacctcacttt

SEQ ID NO: 2473 - DNA, 22 bp, Artificial Sequence
  Synthetic Construct
cagcagagcagagtgctattgt

SEQ ID NO: 2474 - DNA, 21 bp, Artificial Sequence
  Synthetic Construct
gctgttgcactgtgaacttgt

SEQ ID NO: 2475 - DNA, 22 bp, Artificial Sequence
  Synthetic Construct
gcagcagacagctggagatgaa

SEQ ID NO: 2476 - DNA, 23 bp, Artificial Sequence
  Synthetic Construct
ctctgctgttccctcacctgtaa

SEQ ID NO: 2477 - DNA, 20 bp, Artificial Sequence
  Synthetic Construct
tctggcttctcagtgcgttt

SEQ ID NO: 2478 - DNA, 27 bp, Artificial Sequence
  Synthetic Construct
tgtcaagggactaagtttctaggtttc

SEQ ID NO: 2479 - DNA, 24 bp, Artificial Sequence
  Synthetic Construct
ggctcatgcttgtgataggagaca

SEQ ID NO: 2480 - DNA, 25 bp, Artificial Sequence
  Synthetic Construct
gccgaggagaatatgggttggaaac

SEQ ID NO: 2481 - DNA, 24 bp, Artificial Sequence
  Synthetic Construct
gcatcttgtggttgcccttagcaa

SEQ ID NO: 2482 - DNA, 19 bp, Artificial Sequence
  Synthetic Construct
gtccattgggcagccttct

SEQ ID NO: 2483 - DNA, 22 bp, Artificial Sequence
  Synthetic Construct
cctgatgctccctctgccaaaa

SEQ ID NO: 2484 - DNA, 25 bp, Artificial Sequence
  Synthetic Construct
gcctcattctcgcacacatccaatc

SEQ ID NO: 2485 - DNA, 22 bp, Artificial Sequence
  Synthetic Construct
gcccttcctcttgctgaacagt

SEQ ID NO: 2486 - DNA, 20 bp, Artificial Sequence
  Synthetic Construct
acctgaagccaggcactttc

SEQ ID NO: 2487 - DNA, 20 bp, Artificial Sequence
  Synthetic Construct
tgggagaaaaagcccacgtt

SEQ ID NO: 2488 - DNA, 23 bp, Artificial Sequence
  Synthetic Construct
gcaaggctcagtagggtgaaaag

SEQ ID NO: 2489 - DNA, 24 bp, Artificial Sequence
  Synthetic Construct
gccaaactgcttcttgctggatct

SEQ ID NO: 2490 - DNA, 23 bp, Artificial Sequence
  Synthetic Construct
ggaaaggcggtggtaatgtggtt

SEQ ID NO: 2491 - DNA, 21 bp, Artificial Sequence
  Synthetic Construct
tctgaccaagtccgcctctca

SEQ ID NO: 2492 - DNA, 24 bp, Artificial Sequence
  Synthetic Construct
cctcacactttcctgtccttgact

SEQ ID NO: 2493 - DNA, 26 bp, Artificial Sequence
  Synthetic Construct
cagctgatctatgcattggaggacat

SEQ ID NO: 2494 - DNA, 26 bp, Artificial Sequence
  Synthetic Construct
gcatctacccaatcactacagttaga

SEQ ID NO: 2495 - DNA, 21 bp, Artificial Sequence
  Synthetic Construct
ctcatcagacacaggcagctt

SEQ ID NO: 2496 - DNA, 23 bp, Artificial Sequence
  Synthetic Construct
agggcaaaagctttccagagtag

SEQ ID NO: 2497 - DNA, 24 bp, Artificial Sequence
  Synthetic Construct
gcaaagtttcatggccaagtgtca

SEQ ID NO: 2498 - DNA, 20 bp, Artificial Sequence
  Synthetic Construct
tgctgccaggctgctgaaat

SEQ ID NO: 2499 - DNA, 20 bp, Artificial Sequence
  Synthetic Construct
tccccaggcacctgctccaa

SEQ ID NO: 2500 - DNA, 27 bp, Artificial Sequence
  Synthetic Construct
tcacctacctaggattaaaggtgaaag

SEQ ID NO: 2501 - DNA, 20 bp, Artificial Sequence
  Synthetic Construct
ggacaggttggtgccagatt

SEQ ID NO: 2502 - DNA, 19 bp, Artificial Sequence
  Synthetic Construct
aaggaggtcctggggcaat

SEQ ID NO: 2503 - DNA, 22 bp, Artificial Sequence
  Synthetic Construct
cttgcctaggaagggcattaca

SEQ ID NO: 2504 - DNA, 20 bp, Artificial Sequence
  Synthetic Construct
gttgcagcctggaggagaaa

SEQ ID NO: 2505 - DNA, 30 bp, Artificial Sequence
  Synthetic Construct
gctggtcaattctgttaaatcaaggagaca

SEQ ID NO: 2506 - DNA, 19 bp, Artificial Sequence
  Synthetic Construct
tgggtgagggcggatcttc

SEQ ID NO: 2507 - DNA, 24 bp, Artificial Sequence
  Synthetic Construct
cccagagaggctggatactgtgta

SEQ ID NO: 2508 - DNA, 26 bp, Artificial Sequence
  Synthetic Construct
cctgtggctcctgagagagaaatcaa

SEQ ID NO: 2509 - DNA, 20 bp, Artificial Sequence
  Synthetic Construct
tgggacacttcaggccaaga

SEQ ID NO: 2510 - DNA, 22 bp, Artificial Sequence
  Synthetic Construct
ggctagcattcggcgaaaatga

SEQ ID NO: 2511 - DNA, 28 bp, Artificial Sequence
  Synthetic Construct
gctcagatgtgtaaaggaaggcagtaca

SEQ ID NO: 2512 - DNA, 20 bp, Artificial Sequence
  Synthetic Construct
ttcccggtgttctggcgatt

SEQ ID NO: 2513 - DNA, 26 bp, Artificial Sequence
  Synthetic Construct
ggcatgtaagggtgacaaaggagttg

SEQ ID NO: 2514 - DNA, 20 bp, Artificial Sequence
  Synthetic Construct
ccctcccaggcttctcatct

SEQ ID NO: 2515 - DNA, 22 bp, Artificial Sequence
  Synthetic Construct
cctgcctacggtcctaaagtgt

SEQ ID NO: 2516 - DNA, 21 bp, Artificial Sequence
  Synthetic Construct
tccctcaaaccccagctcctt

SEQ ID NO: 2517 - DNA, 23 bp, Artificial Sequence
  Synthetic Construct
ggcatgcttttcattgtgagtga

SEQ ID NO: 2518 - DNA, 25 bp, Artificial Sequence
  Synthetic Construct
ggatcttccttctgggtcataaagt

SEQ ID NO: 2519 - DNA, 25 bp, Artificial Sequence
  Synthetic Construct
gcttttaaaaacccagctgtgaatg

SEQ ID NO: 2520 - DNA, 20 bp, Artificial Sequence
  Synthetic Construct
tcttcccgctccgtccctta

SEQ ID NO: 2521 - DNA, 20 bp, Artificial Sequence
  Synthetic Construct
ctgtccgcagaagccaaaag

SEQ ID NO: 2522 - DNA, 23 bp, Artificial Sequence
  Synthetic Construct
ctgtactgcctcctttcctctca

SEQ ID NO: 2523 - DNA, 20 bp, Artificial Sequence
  Synthetic Construct
cctgagcaagggcacagaag

SEQ ID NO: 2524 - DNA, 20 bp, Artificial Sequence
  Synthetic Construct
aggttcatgggccctcattg

SEQ ID NO: 2525 - DNA, 21 bp, Artificial Sequence
  Synthetic Construct
gggctcccactttcctgagat

SEQ ID NO: 2526 - DNA, 26 bp, Artificial Sequence
  Synthetic Construct
gcaggctcgatatctaattccagaga

SEQ ID NO: 2527 - DNA, 20 bp, Artificial Sequence
  Synthetic Construct
gcagaatcgcctgtggttgt

SEQ ID NO: 2528 - DNA, 23 bp, Artificial Sequence
  Synthetic Construct
gagaagctaaatggtccccaaga

SEQ ID NO: 2529 - DNA, 21 bp, Artificial Sequence
  Synthetic Construct
ggactgaggggctctctggaa

SEQ ID NO: 2530 - DNA, 22 bp, Artificial Sequence
  Synthetic Construct
gcccctgtagtacatccacact

SEQ ID NO: 2531 - DNA, 24 bp, Artificial Sequence
  Synthetic Construct
cctttcgcatgaattgtgcagtga

SEQ ID NO: 2532 - DNA, 24 bp, Artificial Sequence
  Synthetic Construct
gagctctagctgtgagtaggatct

SEQ ID NO: 2533 - DNA, 20 bp, Artificial Sequence
  Synthetic Construct
cctctttgccaggtcacaca

SEQ ID NO: 2534 - DNA, 24 bp, Artificial Sequence
  Synthetic Construct
actgggtgaataaaggacccaaga

SEQ ID NO: 2535 - DNA, 18 bp, Artificial Sequence
  Synthetic Construct
agaggctcgtgggtgtga

SEQ ID NO: 2536 - DNA, 19 bp, Artificial Sequence
  Synthetic Construct
tgggctctgctgcctgttg

SEQ ID NO: 2537 - DNA, 20 bp, Artificial Sequence
  Synthetic Construct
gatggtccccagagggatga

SEQ ID NO: 2538 - DNA, 21 bp, Artificial Sequence
  Synthetic Construct
acccctgatgggctcaagtca

SEQ ID NO: 2539 - DNA, 25 bp, Artificial Sequence
  Synthetic Construct
gtcaatactgtggacagctgcttct

SEQ ID NO: 2540 - DNA, 19 bp, Artificial Sequence
  Synthetic Construct
ggaagcatcccgccagcat

SEQ ID NO: 2541 - DNA, 27 bp, Artificial Sequence
  Synthetic Construct
actaggatctatttcaacccagaccat

SEQ ID NO: 2542 - DNA, 22 bp, Artificial Sequence
  Synthetic Construct
gcctctgcctgcaaagaaccat

SEQ ID NO: 2543 - DNA, 26 bp, Artificial Sequence
  Synthetic Construct
gctcaccatcttcctcatcaaacaga

SEQ ID NO: 2544 - DNA, 26 bp, Artificial Sequence
  Synthetic Construct
gggagagacaggttaagaggccattg

SEQ ID NO: 2545 - DNA, 20 bp, Artificial Sequence
  Synthetic Construct
ccagcaagcatggggttcaa

SEQ ID NO: 2546 - DNA, 20 bp, Artificial Sequence
  Synthetic Construct
cgccaggaattcgtgcctta

SEQ ID NO: 2547 - DNA, 24 bp, Artificial Sequence
  Synthetic Construct
ggctctcaaaaccctcaggtctca

SEQ ID NO: 2548 - DNA, 21 bp, Artificial Sequence
  Synthetic Construct
atgcttagtgcctgacacaca

SEQ ID NO: 2549 - DNA, 21 bp, Artificial Sequence
  Synthetic Construct
accgactcctgtccctctttg

SEQ ID NO: 2550 - DNA, 25 bp, Artificial Sequence
  Synthetic Construct
caggaggtggtctttacctcaattc

SEQ ID NO: 2551 - DNA, 26 bp, Artificial Sequence
  Synthetic Construct
caccttagaaaaatgcctacccttga

SEQ ID NO: 2552 - DNA, 29 bp, Artificial Sequence
  Synthetic Construct
ggaaatagatttcagggactagccaaaag

SEQ ID NO: 2553 - DNA, 21 bp, Artificial Sequence
  Synthetic Construct
gccttctcactgctgaacctt

SEQ ID NO: 2554 - DNA, 20 bp, Artificial Sequence
  Synthetic Construct
agcctcctcactgccaaatc

SEQ ID NO: 2555 - DNA, 27 bp, Artificial Sequence
  Synthetic Construct
cccactacacgagaattacacccatct

SEQ ID NO: 2556 - DNA, 21 bp, Artificial Sequence
  Synthetic Construct
tttagcagggcaagggctaag

SEQ ID NO: 2557 - DNA, 29 bp, Artificial Sequence
  Synthetic Construct
cagggaaaaagactgaatcctaactccta

SEQ ID NO: 2558 - DNA, 21 bp, Artificial Sequence
  Synthetic Construct
atgaggacgaggccgggacta

SEQ ID NO: 2559 - DNA, 27 bp, Artificial Sequence
  Synthetic Construct
gagttagatgacccttactttctgcta

SEQ ID NO: 2560 - DNA, 22 bp, Artificial Sequence
  Synthetic Construct
ccattagtggcgcacagacatc

SEQ ID NO: 2561 - DNA, 21 bp, Artificial Sequence
  Synthetic Construct
tcctggctgtcactactgtgt

SEQ ID NO: 2562 - DNA, 21 bp, Artificial Sequence
  Synthetic Construct
ctgggaacaaagccgcctaat

SEQ ID NO: 2563 - DNA, 22 bp, Artificial Sequence
  Synthetic Construct
cgtctccgctgatgttctgtag

SEQ ID NO: 2564 - DNA, 19 bp, Artificial Sequence
  Synthetic Construct
gtgccaactgtggctgtga

SEQ ID NO: 2565 - DNA, 22 bp, Artificial Sequence
  Synthetic Construct
tggctagtggggaagccagata

SEQ ID NO: 2566 - DNA, 24 bp, Artificial Sequence
  Synthetic Construct
ttggtaccagaagtgggattcaaa

SEQ ID NO: 2567 - DNA, 23 bp, Artificial Sequence
  Synthetic Construct
ctgtggtttgtgtaggcccaaag

SEQ ID NO: 2568 - DNA, 21 bp, Artificial Sequence
  Synthetic Construct
gggccaacacatgagggatgt

SEQ ID NO: 2569 - DNA, 22 bp, Artificial Sequence
  Synthetic Construct
ccactggatcactgggtgctta

SEQ ID NO: 2570 - DNA, 21 bp, Artificial Sequence
  Synthetic Construct
tgggacagtgattcccagctt

SEQ ID NO: 2571 - DNA, 20 bp, Artificial Sequence
  Synthetic Construct
agggacagggcagccagtca

SEQ ID NO: 2572 - DNA, 21 bp, Artificial Sequence
  Synthetic Construct
ttatagccgctgcctcctaga

SEQ ID NO: 2573 - DNA, 22 bp, Artificial Sequence
  Synthetic Construct
gctcatccaggaccccatcttt

SEQ ID NO: 2574 - DNA, 20 bp, Artificial Sequence
  Synthetic Construct
ctcattggcgtcagccgata

SEQ ID NO: 2575 - DNA, 24 bp, Artificial Sequence
  Synthetic Construct
cctcgatgttggtagggactcttc

SEQ ID NO: 2576 - DNA, 22 bp, Artificial Sequence
  Synthetic Construct
gcgagtcacctctgccatgttt

SEQ ID NO: 2577 - DNA, 21 bp, Artificial Sequence
  Synthetic Construct
aggccactcagggctttgtga

SEQ ID NO: 2578 - DNA, 28 bp, Artificial Sequence
  Synthetic Construct
ctggggagatgatattaaagctgactct

SEQ ID NO: 2579 - DNA, 20 bp, Artificial Sequence
  Synthetic Construct
gctgcctctgtggtcacatc

SEQ ID NO: 2580 - DNA, 20 bp, Artificial Sequence
  Synthetic Construct
ccaaggcagcacttgaggta

SEQ ID NO: 2581 - DNA, 21 bp, Artificial Sequence
  Synthetic Construct
gccaactgctgtgttgtcttg

SEQ ID NO: 2582 - DNA, 21 bp, Artificial Sequence
  Synthetic Construct
acaacctcacctttgcagaca

SEQ ID NO: 2583 - DNA, 25 bp, Artificial Sequence
  Synthetic Construct
gtcatttgctttcatgaccctcctt

SEQ ID NO: 2584 - DNA, 20 bp, Artificial Sequence
  Synthetic Construct
agtgcgcagcccttttcctt

SEQ ID NO: 2585 - DNA, 19 bp, Artificial Sequence
  Synthetic Construct
atggcgaagcgcaggaaga

SEQ ID NO: 2586 - DNA, 22 bp, Artificial Sequence
  Synthetic Construct
ttgccagaggttccccagattg

SEQ ID NO: 2587 - DNA, 25 bp, Artificial Sequence
  Synthetic Construct
caaataaaggccctccttcaacaac

SEQ ID NO: 2588 - DNA, 22 bp, Artificial Sequence
  Synthetic Construct
caaggaggaggaccaagtctca

SEQ ID NO: 2589 - DNA, 23 bp, Artificial Sequence
  Synthetic Construct
gcatctgtatgcacactgggttt

SEQ ID NO: 2590 - DNA, 20 bp, Artificial Sequence
  Synthetic Construct
aaggtgccagggcaactcaa

SEQ ID NO: 2591 - DNA, 20 bp, Artificial Sequence
  Synthetic Construct
gttctgcagctggtcactgt

SEQ ID NO: 2592 - DNA, 20 bp, Artificial Sequence
  Synthetic Construct
tgctgcagccatgcttccta

SEQ ID NO: 2593 - DNA, 18 bp, Artificial Sequence
  Synthetic Construct
agaagcggctggctccat

SEQ ID NO: 2594 - DNA, 21 bp, Artificial Sequence
  Synthetic Construct
gccttcagggaagctttgaca

SEQ ID NO: 2595 - DNA, 22 bp, Artificial Sequence
  Synthetic Construct
gcagcaccgctctctagttaag

SEQ ID NO: 2596 - DNA, 22 bp, Artificial Sequence
  Synthetic Construct
gacactaagtgcggctgtcatc

SEQ ID NO: 2597 - DNA, 20 bp, Artificial Sequence
  Synthetic Construct
gctaccaggaacgggagtca

SEQ ID NO: 2598 - DNA, 20 bp, Artificial Sequence
  Synthetic Construct
accctgttccctctgtcagt

SEQ ID NO: 2599 - DNA, 22 bp, Artificial Sequence
  Synthetic Construct
gcccagctttagcggatgaagt

SEQ ID NO: 2600 - DNA, 21 bp, Artificial Sequence
  Synthetic Construct
gctgcgcccatttgtttgcat

SEQ ID NO: 2601 - DNA, 19 bp, Artificial Sequence
  Synthetic Construct
ggcacaaagccctctgcat

SEQ ID NO: 2602 - DNA, 21 bp, Artificial Sequence
  Synthetic Construct
tgggcccatggtccatccaaa

SEQ ID NO: 2603 - DNA, 20 bp, Artificial Sequence
  Synthetic Construct
ttgccgctcctctttctgtt

SEQ ID NO: 2604 - DNA, 22 bp, Artificial Sequence
  Synthetic Construct
tcttccccaaatgggaccttca

SEQ ID NO: 2605 - DNA, 24 bp, Artificial Sequence
  Synthetic Construct
ccacatagctctccatctggctat

SEQ ID NO: 2606 - DNA, 21 bp, Artificial Sequence
  Synthetic Construct
ggagtttccgaaggcaacagt

SEQ ID NO: 2607 - DNA, 20 bp, Artificial Sequence
  Synthetic Construct
tcctggcctaaggggtgttt

SEQ ID NO: 2608 - DNA, 20 bp, Artificial Sequence
  Synthetic Construct
gtgctcaggttgtggagaca

SEQ ID NO: 2609 - DNA, 22 bp, Artificial Sequence
  Synthetic Construct
ctcttcaagcaaggctgtctct

SEQ ID NO: 2610 - DNA, 24 bp, Artificial Sequence
  Synthetic Construct
gtgtacagtgaaggccatgtgttc

SEQ ID NO: 2611 - DNA, 23 bp, Artificial Sequence
  Synthetic Construct
tccatggctcaggagggacatag

SEQ ID NO: 2612 - DNA, 22 bp, Artificial Sequence
  Synthetic Construct
accacgatccacacctcctaac

SEQ ID NO: 2613 - DNA, 20 bp, Artificial Sequence
  Synthetic Construct
ttggctggagggctctggaa

SEQ ID NO: 2614 - DNA, 20 bp, Artificial Sequence
  Synthetic Construct
gcaccactggagccaagatt

SEQ ID NO: 2615 - DNA, 25 bp, Artificial Sequence
  Synthetic Construct
gctggaactctgtcataggctgaag

SEQ ID NO: 2616 - DNA, 21 bp, Artificial Sequence
  Synthetic Construct
agtgggagtggtctggtcaac

SEQ ID NO: 2617 - DNA, 20 bp, Artificial Sequence
  Synthetic Construct
actggagcgcttgaggtaga

SEQ ID NO: 2618 - DNA, 24 bp, Artificial Sequence
  Synthetic Construct
gcacaccagaagataacccagctt

SEQ ID NO: 2619 - DNA, 27 bp, Artificial Sequence
  Synthetic Construct
gggcattattgaatgctctgctttctt

SEQ ID NO: 2620 - DNA, 22 bp, Artificial Sequence
  Synthetic Construct
accctggagctcccttccaaaa

SEQ ID NO: 2621 - DNA, 21 bp, Artificial Sequence
  Synthetic Construct
ggcctcctggtgcattgaaac

SEQ ID NO: 2622 - DNA, 24 bp, Artificial Sequence
  Synthetic Construct
gtgcatacacttgactgcttgaca

SEQ ID NO: 2623 - DNA, 21 bp, Artificial Sequence
  Synthetic Construct
tgtaagtgccagccagctaga

SEQ ID NO: 2624 - DNA, 23 bp, Artificial Sequence
  Synthetic Construct
gacctgagtgtggtgaaatgtct

SEQ ID NO: 2625 - DNA, 21 bp, Artificial Sequence
  Synthetic Construct
cagggtgcctcatctcaggat

SEQ ID NO: 2626 - DNA, 22 bp, Artificial Sequence
  Synthetic Construct
agctgaggctatggggatgact

SEQ ID NO: 2627 - DNA, 22 bp, Artificial Sequence
  Synthetic Construct
gcttgtttccacccacctcgtt

SEQ ID NO: 2628 - DNA, 21 bp, Artificial Sequence
  Synthetic Construct
gctgagtgcctttctgccttt

SEQ ID NO: 2629 - DNA, 23 bp, Artificial Sequence
  Synthetic Construct
agtgacagagtatggggtgagaa

SEQ ID NO: 2630 - DNA, 22 bp, Artificial Sequence
  Synthetic Construct
gcttcccagatcccacagttag

SEQ ID NO: 2631 - DNA, 22 bp, Artificial Sequence
  Synthetic Construct
cccaggactgtcattcccaaga

SEQ ID NO: 2632 - DNA, 20 bp, Artificial Sequence
  Synthetic Construct
gggttatgggcaccttcaca

SEQ ID NO: 2633 - DNA, 21 bp, Artificial Sequence
  Synthetic Construct
ggcagacacaacttggggaaa

SEQ ID NO: 2634 - DNA, 21 bp, Artificial Sequence
  Synthetic Construct
gacgtgctcagtgggatttgt

SEQ ID NO: 2635 - DNA, 23 bp, Artificial Sequence
  Synthetic Construct
gcaataacccatcggtggagcaa

SEQ ID NO: 2636 - DNA, 22 bp, Artificial Sequence
  Synthetic Construct
tggtgagatcttggctctccat

SEQ ID NO: 2637 - DNA, 22 bp, Artificial Sequence
  Synthetic Construct
gccctctttccattgcccagaa

SEQ ID NO: 2638 - DNA, 22 bp, Artificial Sequence
  Synthetic Construct
gtctctgtctgcccatcagtct

SEQ ID NO: 2639 - DNA, 20 bp, Artificial Sequence
  Synthetic Construct
gcagggaaagcccagtcatc

SEQ ID NO: 2640 - DNA, 27 bp, Artificial Sequence
  Synthetic Construct
ccccacatttcttcagacagtggaatc

SEQ ID NO: 2641 - DNA, 18 bp, Artificial Sequence
  Synthetic Construct
tcccgcccactgctatct

SEQ ID NO: 2642 - DNA, 19 bp, Artificial Sequence
  Synthetic Construct
tgtctcggggtgccacaca

SEQ ID NO: 2643 - DNA, 23 bp, Artificial Sequence
  Synthetic Construct
gcacgtggagagtgttcatccat

SEQ ID NO: 2644 - DNA, 25 bp, Artificial Sequence
  Synthetic Construct
tgaaatgaacagaccagctaacctt

SEQ ID NO: 2645 - DNA, 22 bp, Artificial Sequence
  Synthetic Construct
cctgggctatgctgtcatccat

SEQ ID NO: 2646 - DNA, 25 bp, Artificial Sequence
  Synthetic Construct
gagactgcctgaataccatggaaga

SEQ ID NO: 2647 - DNA, 20 bp, Artificial Sequence
  Synthetic Construct
tgggagggtgccacctcttg

SEQ ID NO: 2648 - DNA, 20 bp, Artificial Sequence
  Synthetic Construct
ctttggttgcaggccacaga

SEQ ID NO: 2649 - DNA, 20 bp, Artificial Sequence
  Synthetic Construct
ggctgccttgggacacatct

SEQ ID NO: 2650 - DNA, 22 bp, Artificial Sequence
  Synthetic Construct
gccaggaacactgcttgtgatg

SEQ ID NO: 2651 - DNA, 22 bp, Artificial Sequence
  Synthetic Construct
gagaggggtttgcttccctctt

SEQ ID NO: 2652 - DNA, 19 bp, Artificial Sequence
  Synthetic Construct
aggggcctgcactgtgatt

SEQ ID NO: 2653 - DNA, 23 bp, Artificial Sequence
  Synthetic Construct
ccatcagcagattcacactcaga

SEQ ID NO: 2654 - DNA, 24 bp, Artificial Sequence
  Synthetic Construct
cagggaaaacagggatgaaagaca

SEQ ID NO: 2655 - DNA, 26 bp, Artificial Sequence
  Synthetic Construct
ctgctgtgaagctggagactttttac

SEQ ID NO: 2656 - DNA, 19 bp, Artificial Sequence
  Synthetic Construct
tcgccgcgttgaccagtgt

SEQ ID NO: 2657 - DNA, 22 bp, Artificial Sequence
  Synthetic Construct
ggacaggtactaggtgctgctt

SEQ ID NO: 2658 - DNA, 22 bp, Artificial Sequence
  Synthetic Construct
gaagccggtttaactggtgttg

SEQ ID NO: 2659 - DNA, 22 bp, Artificial Sequence
  Synthetic Construct
cagcaggagggaaaaggctatg

SEQ ID NO: 2660 - DNA, 22 bp, Artificial Sequence
  Synthetic Construct
ctcaaaaggcaggtgcttgaca

SEQ ID NO: 2661 - DNA, 21 bp, Artificial Sequence
  Synthetic Construct
tggttcccaaggggctcagat

SEQ ID NO: 2662 - DNA, 26 bp, Artificial Sequence
  Synthetic Construct
gtggtgaaagtaatggcatcaagcat

SEQ ID NO: 2663 - DNA, 21 bp, Artificial Sequence
  Synthetic Construct
tgctgtggtgtggtcatttgt

SEQ ID NO: 2664 - DNA, 20 bp, Artificial Sequence
  Synthetic Construct
tcccagtgcaagggcattag

SEQ ID NO: 2665 - DNA, 19 bp, Artificial Sequence
  Synthetic Construct
aggctggcctcccacttac

SEQ ID NO: 2666 - DNA, 26 bp, Artificial Sequence
  Synthetic Construct
agagtaaacttggaaggatgggtttc

SEQ ID NO: 2667 - DNA, 19 bp, Artificial Sequence
  Synthetic Construct
gcaatccctgcgaccacat

SEQ ID NO: 2668 - DNA, 20 bp, Artificial Sequence
  Synthetic Construct
aggccaaagtccctgtgaac

SEQ ID NO: 2669 - DNA, 25 bp, Artificial Sequence
  Synthetic Construct
ggatgagattcccttcctccacact

SEQ ID NO: 2670 - DNA, 21 bp, Artificial Sequence
  Synthetic Construct
gctgtttctctgtcgctcctt

SEQ ID NO: 2671 - DNA, 22 bp, Artificial Sequence
  Synthetic Construct
gggtgctgggaaacatgaggaa

SEQ ID NO: 2672 - DNA, 22 bp, Artificial Sequence
  Synthetic Construct
cagccttctgtccactccttag

SEQ ID NO: 2673 - DNA, 20 bp, Artificial Sequence
  Synthetic Construct
tgcttccagagccccacact

SEQ ID NO: 2674 - DNA, 20 bp, Artificial Sequence
  Synthetic Construct
cactccgcattgttgtgcat

SEQ ID NO: 2675 - DNA, 20 bp, Artificial Sequence
  Synthetic Construct
acaccctgtggggccgatga

SEQ ID NO: 2676 - DNA, 24 bp, Artificial Sequence
  Synthetic Construct
gtggtagttagacctccccgaaag

SEQ ID NO: 2677 - DNA, 21 bp, Artificial Sequence
  Synthetic Construct
gggcagaagtggatggtgaga

SEQ ID NO: 2678 - DNA, 21 bp, Artificial Sequence
  Synthetic Construct
gcccctaccctgttcctccat

SEQ ID NO: 2679 - DNA, 24 bp, Artificial Sequence
  Synthetic Construct
acttccaggagcacctttgaatag

SEQ ID NO: 2680 - DNA, 26 bp, Artificial Sequence
  Synthetic Construct
ccatcaaagaggtaacaagccagtga

SEQ ID NO: 2681 - DNA, 20 bp, Artificial Sequence
  Synthetic Construct
aaccccgtcttggctcgatt

SEQ ID NO: 2682 - DNA, 19 bp, Artificial Sequence
  Synthetic Construct
gctacacgctgggcaccaa

SEQ ID NO: 2683 - DNA, 22 bp, Artificial Sequence
  Synthetic Construct
gccctatggcaaaggctcacta

SEQ ID NO: 2684 - DNA, 20 bp, Artificial Sequence
  Synthetic Construct
aagcctctggctggtgtttc

SEQ ID NO: 2685 - DNA, 20 bp, Artificial Sequence
  Synthetic Construct
cctgtggttttgggcaggtt

SEQ ID NO: 2686 - DNA, 20 bp, Artificial Sequence
  Synthetic Construct
tggttaccaccctgggatca

SEQ ID NO: 2687 - DNA, 21 bp, Artificial Sequence
  Synthetic Construct
tctggtactcccagggtgcat

SEQ ID NO: 2688 - DNA, 20 bp, Artificial Sequence
  Synthetic Construct
tggatacaccgggcttgtct

SEQ ID NO: 2689 - DNA, 20 bp, Artificial Sequence
  Synthetic Construct
aagacaccgcgctgcctagt

SEQ ID NO: 2690 - DNA, 21 bp, Artificial Sequence
  Synthetic Construct
tccagaggcaggagacaatca

SEQ ID NO: 2691 - DNA, 27 bp, Artificial Sequence
  Synthetic Construct
ccgcaattggagctgaattcttaaatc

SEQ ID NO: 2692 - DNA, 20 bp, Artificial Sequence
  Synthetic Construct
ccttggggtggcccacttag

SEQ ID NO: 2693 - DNA, 21 bp, Artificial Sequence
  Synthetic Construct
ttttccctgacgatcggcttt

SEQ ID NO: 2694 - DNA, 23 bp, Artificial Sequence
  Synthetic Construct
gtcagggagaacctatggaccta

SEQ ID NO: 2695 - DNA, 24 bp, Artificial Sequence
  Synthetic Construct
ccccagacagatgtaagtccaaca

SEQ ID NO: 2696 - DNA, 20 bp, Artificial Sequence
  Synthetic Construct
ctgcatgcctggaacacact

SEQ ID NO: 2697 - DNA, 22 bp, Artificial Sequence
  Synthetic Construct
ctggactgctcactctggaact

SEQ ID NO: 2698 - DNA, 20 bp, Artificial Sequence
  Synthetic Construct
tgcccgaagaggcatgaaac

SEQ ID NO: 2699 - DNA, 23 bp, Artificial Sequence
  Synthetic Construct
tcttctccaaagtcagggtgtct

SEQ ID NO: 2700 - DNA, 20 bp, Artificial Sequence
  Synthetic Construct
gcagtgccaggagcaaaaga

SEQ ID NO: 2701 - DNA, 25 bp, Artificial Sequence
  Synthetic Construct
agccttaaaaactgccttctacaca

SEQ ID NO: 2702 - DNA, 25 bp, Artificial Sequence
  Synthetic Construct
gggattcactagtgttgtggattga

SEQ ID NO: 2703 - DNA, 22 bp, Artificial Sequence
  Synthetic Construct
ccaatggtggaaacagcctaca

SEQ ID NO: 2704 - DNA, 23 bp, Artificial Sequence
  Synthetic Construct
gctagatgagggaggctggaaac

SEQ ID NO: 2705 - DNA, 20 bp, Artificial Sequence
  Synthetic Construct
cctggatgtggctggcagta

SEQ ID NO: 2706 - DNA, 20 bp, Artificial Sequence
  Synthetic Construct
cattggcaacccagctcaca

SEQ ID NO: 2707 - DNA, 21 bp, Artificial Sequence
  Synthetic Construct
agcccgagcctcctacaactt

SEQ ID NO: 2708 - DNA, 20 bp, Artificial Sequence
  Synthetic Construct
acagggctccaggcgagtgt

SEQ ID NO: 2709 - DNA, 21 bp, Artificial Sequence
  Synthetic Construct
tgggaggtgaaccagggacat

SEQ ID NO: 2710 - DNA, 22 bp, Artificial Sequence
  Synthetic Construct
gggctgcagagataagctcgtt

SEQ ID NO: 2711 - DNA, 22 bp, Artificial Sequence
  Synthetic Construct
cgtcacagccagttctcacaca

SEQ ID NO: 2712 - DNA, 20 bp, Artificial Sequence
  Synthetic Construct
tctgacctgcgggcagtttg

SEQ ID NO: 2713 - DNA, 23 bp, Artificial Sequence
  Synthetic Construct
gcgagaaacaccactgacatttg

SEQ ID NO: 2714 - DNA, 22 bp, Artificial Sequence
  Synthetic Construct
cccaatggtagctggcatgctt

SEQ ID NO: 2715 - DNA, 21 bp, Artificial Sequence
  Synthetic Construct
acctccccagggacactcact

SEQ ID NO: 2716 - DNA, 22 bp, Artificial Sequence
  Synthetic Construct
aggcagtggcctcctctttgta

SEQ ID NO: 2717 - DNA, 20 bp, Artificial Sequence
  Synthetic Construct
ttgccggtggatcctgactt

SEQ ID NO: 2718 - DNA, 22 bp, Artificial Sequence
  Synthetic Construct
tgcaattgatcgttggctccta

SEQ ID NO: 2719 - DNA, 22 bp, Artificial Sequence
  Synthetic Construct
ggccgctttcttagggtgtaag

SEQ ID NO: 2720 - DNA, 24 bp, Artificial Sequence
  Synthetic Construct
ggtgaaaggtgaggatcaatcaga

SEQ ID NO: 2721 - DNA, 20 bp, Artificial Sequence
  Synthetic Construct
tgtgccttctgggagaccat

SEQ ID NO: 2722 - DNA, 25 bp, Artificial Sequence
  Synthetic Construct
ggttctccagaatggtcctgtcgtt

SEQ ID NO: 2723 - DNA, 20 bp, Artificial Sequence
  Synthetic Construct
gcagccttagggctagcaaa

SEQ ID NO: 2724 - DNA, 22 bp, Artificial Sequence
  Synthetic Construct
cccctaaacctgggccaaatga

SEQ ID NO: 2725 - DNA, 20 bp, Artificial Sequence
  Synthetic Construct
tgacaggccatgccacaaag

SEQ ID NO: 2726 - DNA, 26 bp, Artificial Sequence
  Synthetic Construct
cccatcctattaccccaaacgtcttc

SEQ ID NO: 2727 - DNA, 20 bp, Artificial Sequence
  Synthetic Construct
actgcagcccctgtgaatac

SEQ ID NO: 2728 - DNA, 23 bp, Artificial Sequence
  Synthetic Construct
ggagacgtcctgcctgcagtctt

SEQ ID NO: 2729 - DNA, 20 bp, Artificial Sequence
  Synthetic Construct
gcgcacagcagaatggagat

SEQ ID NO: 2730 - DNA, 23 bp, Artificial Sequence
  Synthetic Construct
gcatgcagtggtgtatgttgtag

SEQ ID NO: 2731 - DNA, 25 bp, Artificial Sequence
  Synthetic Construct
gcctaatgtttgtggggtagtggta

SEQ ID NO: 2732 - DNA, 20 bp, Artificial Sequence
  Synthetic Construct
gggagaccaggcccctaaga

SEQ ID NO: 2733 - DNA, 20 bp, Artificial Sequence
  Synthetic Construct
tccctgcaaggaccctcagt

SEQ ID NO: 2734 - DNA, 22 bp, Artificial Sequence
  Synthetic Construct
tctcacctgaccctgaggtctt

SEQ ID NO: 2735 - DNA, 22 bp, Artificial Sequence
  Synthetic Construct
gacgcagcttgccttagacttc

SEQ ID NO: 2736 - DNA, 24 bp, Artificial Sequence
  Synthetic Construct
gggtgcagctgacttcctagtctt

SEQ ID NO: 2737 - DNA, 22 bp, Artificial Sequence
  Synthetic Construct
gtgcggtcaaggtttacaggtt

SEQ ID NO: 2738 - DNA, 22 bp, Artificial Sequence
  Synthetic Construct
tcacaagctccactccctcaag

SEQ ID NO: 2739 - DNA, 18 bp, Artificial Sequence
  Synthetic Construct
tctgcgtgtgcgtgtgtt

SEQ ID NO: 2740 - DNA, 21 bp, Artificial Sequence
  Synthetic Construct
cagtgacatgtggcccagttt

SEQ ID NO: 2741 - DNA, 25 bp, Artificial Sequence
  Synthetic Construct
tgttcaatgatactggtgcaggatt

SEQ ID NO: 2742 - DNA, 24 bp, Artificial Sequence
  Synthetic Construct
ggcgtggagttgcttcatctcctt

SEQ ID NO: 2743 - DNA, 19 bp, Artificial Sequence
  Synthetic Construct
tggggtggcacagccaact

SEQ ID NO: 2744 - DNA, 22 bp, Artificial Sequence
  Synthetic Construct
accacgtgacaggtgtgaggat

SEQ ID NO: 2745 - DNA, 24 bp, Artificial Sequence
  Synthetic Construct
ggagtagctctgtagggagagttg

SEQ ID NO: 2746 - DNA, 23 bp, Artificial Sequence
  Synthetic Construct
acatgattgatgccaaggggtaa

SEQ ID NO: 2747 - DNA, 22 bp, Artificial Sequence
  Synthetic Construct
tgcgtgctcagagtcacataag

SEQ ID NO: 2748 - DNA, 20 bp, Artificial Sequence
  Synthetic Construct
agcacacccctcctgcactt

SEQ ID NO: 2749 - DNA, 19 bp, Artificial Sequence
  Synthetic Construct
ccaggcggctccaagaagt

SEQ ID NO: 2750 - DNA, 20 bp, Artificial Sequence
  Synthetic Construct
aaacctggcagaggttgcat

SEQ ID NO: 2751 - DNA, 22 bp, Artificial Sequence
  Synthetic Construct
caggatctgaacgggaggtttc

SEQ ID NO: 2752 - DNA, 24 bp, Artificial Sequence
  Synthetic Construct
ggtggaaatctaccccaggcaact

SEQ ID NO: 2753 - DNA, 22 bp, Artificial Sequence
  Synthetic Construct
ctgccggtgaactgagagtaga

SEQ ID NO: 2754 - DNA, 19 bp, Artificial Sequence
  Synthetic Construct
atccctggccatgctgcta

SEQ ID NO: 2755 - DNA, 24 bp, Artificial Sequence
  Synthetic Construct
agtgactcatcctgaagtcctgaa

SEQ ID NO: 2756 - DNA, 20 bp, Artificial Sequence
  Synthetic Construct
acaggaaggcaccacgttga

SEQ ID NO: 2757 - DNA, 19 bp, Artificial Sequence
  Synthetic Construct
gaggggccaagtgcagaag

SEQ ID NO: 2758 - DNA, 21 bp, Artificial Sequence
  Synthetic Construct
agaggtgaccaggccctttga

SEQ ID NO: 2759 - DNA, 22 bp, Artificial Sequence
  Synthetic Construct
gtgacgcgacctgctcataagt

SEQ ID NO: 2760 - DNA, 22 bp, Artificial Sequence
  Synthetic Construct
acctgggctccatcctgtgaat

SEQ ID NO: 2761 - DNA, 23 bp, Artificial Sequence
  Synthetic Construct
gctcaattcctcccactgcttct

SEQ ID NO: 2762 - DNA, 22 bp, Artificial Sequence
  Synthetic Construct
ctcttctggagaaggggagagt

SEQ ID NO: 2763 - DNA, 27 bp, Artificial Sequence
  Synthetic Construct
gtccaactccttccatctgaattcttc

SEQ ID NO: 2764 - DNA, 24 bp, Artificial Sequence
  Synthetic Construct
cacgtaggcctctgttttctggtt

SEQ ID NO: 2765 - DNA, 22 bp, Artificial Sequence
  Synthetic Construct
cccctggctaagctcaaagtca

SEQ ID NO: 2766 - DNA, 22 bp, Artificial Sequence
  Synthetic Construct
ggaaaacacaccgccagagaag

SEQ ID NO: 2767 - DNA, 23 bp, Artificial Sequence
  Synthetic Construct
gcaaactcctaggctctgtgctt

SEQ ID NO: 2768 - DNA, 23 bp, Artificial Sequence
  Synthetic Construct
gtgagaggatgtgtgcgttccat

SEQ ID NO: 2769 - DNA, 23 bp, Artificial Sequence
  Synthetic Construct
cattaccccagttggcagaaaac

SEQ ID NO: 2770 - DNA, 22 bp, Artificial Sequence
  Synthetic Construct
gacaagttgggtggacagtctt

SEQ ID NO: 2771 - DNA, 19 bp, Artificial Sequence
  Synthetic Construct
aaggggtgctctcccttga

SEQ ID NO: 2772 - DNA, 23 bp, Artificial Sequence
  Synthetic Construct
ccccgtgaaatgatggtggaaac

SEQ ID NO: 2773 - DNA, 25 bp, Artificial Sequence
  Synthetic Construct
ggtaatcaaccctcagtctctcatc

SEQ ID NO: 2774 - DNA, 19 bp, Artificial Sequence
  Synthetic Construct
aggccagccctctgacttc

SEQ ID NO: 2775 - DNA, 20 bp, Artificial Sequence
  Synthetic Construct
gcttgggactctggggttga

SEQ ID NO: 2776 - DNA, 21 bp, Artificial Sequence
  Synthetic Construct
cctggctttgccccttcatct

SEQ ID NO: 2777 - DNA, 18 bp, Artificial Sequence
  Synthetic Construct
agccagcctctgcacctt

SEQ ID NO: 2778 - DNA, 21 bp, Artificial Sequence
  Synthetic Construct
cctctgaaaggcggaaaccaa

SEQ ID NO: 2779 - DNA, 18 bp, Artificial Sequence
  Synthetic Construct
agtggccagcaggagcaa

SEQ ID NO: 2780 - DNA, 23 bp, Artificial Sequence
  Synthetic Construct
ccagggcaggactctaaccattg

SEQ ID NO: 2781 - DNA, 24 bp, Artificial Sequence
  Synthetic Construct
gttaggaaagggtcccctaaggtt

SEQ ID NO: 2782 - DNA, 20 bp, Artificial Sequence
  Synthetic Construct
ggtggcttggattgcctact

SEQ ID NO: 2783 - DNA, 20 bp, Artificial Sequence
  Synthetic Construct
tccaccctggccccagcatt

SEQ ID NO: 2784 - DNA, 21 bp, Artificial Sequence
  Synthetic Construct
cgtggaggggaggaagtcttg

SEQ ID NO: 2785 - DNA, 20 bp, Artificial Sequence
  Synthetic Construct
accaatgggaggcaccatca

SEQ ID NO: 2786 - DNA, 24 bp, Artificial Sequence
  Synthetic Construct
gagttgcacttgtactctgtcagt

SEQ ID NO: 2787 - DNA, 25 bp, Artificial Sequence
  Synthetic Construct
ggctttttggctttccaggttgatg

SEQ ID NO: 2788 - DNA, 20 bp, Artificial Sequence
  Synthetic Construct
cccgcaagggttggggaaat

SEQ ID NO: 2789 - DNA, 20 bp, Artificial Sequence
  Synthetic Construct
tccaacaccatccgctcttc

SEQ ID NO: 2790 - DNA, 22 bp, Artificial Sequence
  Synthetic Construct
gtgggtgccagagttgagattc

SEQ ID NO: 2791 - DNA, 19 bp, Artificial Sequence
  Synthetic Construct
ggccgggaaaagggagcat

SEQ ID NO: 2792 - DNA, 28 bp, Artificial Sequence
  Synthetic Construct
gtcttccccatagttaagttgtctcttc

SEQ ID NO: 2793 - DNA, 28 bp, Artificial Sequence
  Synthetic Construct
gcagctacgcatacaaatcactcacatc

SEQ ID NO: 2794 - DNA, 21 bp, Artificial Sequence
  Synthetic Construct
actggactcagggagcagcat

SEQ ID NO: 2795 - DNA, 19 bp, Artificial Sequence
  Synthetic Construct
aggccactgcctcgcatca

SEQ ID NO: 2796 - DNA, 25 bp, Artificial Sequence
  Synthetic Construct
ggacttttgttttccccgtttgaag

SEQ ID NO: 2797 - DNA, 25 bp, Artificial Sequence
  Synthetic Construct
tctaaatgttctctgggtgctgttc

SEQ ID NO: 2798 - DNA, 22 bp, Artificial Sequence
  Synthetic Construct
ggggtctaatggctgtggttgt

SEQ ID NO: 2799 - DNA, 22 bp, Artificial Sequence
  Synthetic Construct
ggctgttagccctgtggaacaa

SEQ ID NO: 2800 - DNA, 20 bp, Artificial Sequence
  Synthetic Construct
acggcagagcaaaggcttgt

SEQ ID NO: 2801 - DNA, 28 bp, Artificial Sequence
  Synthetic Construct
ggacaaggccctttaattcataccaaga

SEQ ID NO: 2802 - DNA, 18 bp, Artificial Sequence
  Synthetic Construct
agcccagagcagcgttca

SEQ ID NO: 2803 - DNA, 21 bp, Artificial Sequence
  Synthetic Construct
tggtagtgtagaggggcaact

SEQ ID NO: 2804 - DNA, 20 bp, Artificial Sequence
  Synthetic Construct
gggccaagcgttcagactac

SEQ ID NO: 2805 - DNA, 18 bp, Artificial Sequence
  Synthetic Construct
atgctcaggctgcgttgt

SEQ ID NO: 2806 - DNA, 21 bp, Artificial Sequence
  Synthetic Construct
tggctccctgaggagtgtttg

SEQ ID NO: 2807 - DNA, 25 bp, Artificial Sequence
  Synthetic Construct
cagaaaagtctagtgaagccagaca

SEQ ID NO: 2808 - DNA, 22 bp, Artificial Sequence
  Synthetic Construct
cacagacaactggagggtgaac

SEQ ID NO: 2809 - DNA, 23 bp, Artificial Sequence
  Synthetic Construct
acatacctgctgtaccccaaatg

SEQ ID NO: 2810 - DNA, 24 bp, Artificial Sequence
  Synthetic Construct
gcaatgaacaacgacaggctttca

SEQ ID NO: 2811 - DNA, 22 bp, Artificial Sequence
  Synthetic Construct
gactgagcttgtgaggcaggaa

SEQ ID NO: 2812 - DNA, 25 bp, Artificial Sequence
  Synthetic Construct
gcatactaaaggagctttggagaca

SEQ ID NO: 2813 - DNA, 19 bp, Artificial Sequence
  Synthetic Construct
gccaaccaggccagcatca

SEQ ID NO: 2814 - DNA, 21 bp, Artificial Sequence
  Synthetic Construct
acagagcggtacagcggaatc

SEQ ID NO: 2815 - DNA, 26 bp, Artificial Sequence
  Synthetic Construct
gagaaagtgagcatttgccatgaaag

SEQ ID NO: 2816 - DNA, 26 bp, Artificial Sequence
  Synthetic Construct
ggtcttaccttcagagttctgtccta

SEQ ID NO: 2817 - DNA, 27 bp, Artificial Sequence
  Synthetic Construct
ggggaacatttcagaccagataacact

SEQ ID NO: 2818 - DNA, 20 bp, Artificial Sequence
  Synthetic Construct
agggccaatcctggaacact

SEQ ID NO: 2819 - DNA, 29 bp, Artificial Sequence
  Synthetic Construct
ccttgcaccaaaaatagaagtgtgagcta

SEQ ID NO: 2820 - DNA, 18 bp, Artificial Sequence
  Synthetic Construct
actgccaagtggctgcaa

SEQ ID NO: 2821 - DNA, 22 bp, Artificial Sequence
  Synthetic Construct
cacagctgaacctcaggcaatc

SEQ ID NO: 2822 - DNA, 22 bp, Artificial Sequence
  Synthetic Construct
caacagccgggatcttctgaac

SEQ ID NO: 2823 - DNA, 24 bp, Artificial Sequence
  Synthetic Construct
gggcctaggtgtgtgtatccagtt

SEQ ID NO: 2824 - DNA, 25 bp, Artificial Sequence
  Synthetic Construct
cctgtcggaatgttttctccaccaa

SEQ ID NO: 2825 - DNA, 22 bp, Artificial Sequence
  Synthetic Construct
gggtctaaggacaccgggtcta

SEQ ID NO: 2826 - DNA, 21 bp, Artificial Sequence
  Synthetic Construct
tttccggtggggccaatgtgt

SEQ ID NO: 2827 - DNA, 23 bp, Artificial Sequence
  Synthetic Construct
gcattgtcaggcttctctctttg

SEQ ID NO: 2828 - DNA, 25 bp, Artificial Sequence
  Synthetic Construct
cagaaatcagaagctctcagggaaa

SEQ ID NO: 2829 - DNA, 24 bp, Artificial Sequence
  Synthetic Construct
actcttttgcctgggatttaccat

SEQ ID NO: 2830 - DNA, 20 bp, Artificial Sequence
  Synthetic Construct
atctggcccgtgctccactt

SEQ ID NO: 2831 - DNA, 19 bp, Artificial Sequence
  Synthetic Construct
aacacctggggaggcaaca

SEQ ID NO: 2832 - DNA, 19 bp, Artificial Sequence
  Synthetic Construct
aggcagggagcacagagat

SEQ ID NO: 2833 - DNA, 23 bp, Artificial Sequence
  Synthetic Construct
ggttttggggcatagtccacagt

SEQ ID NO: 2834 - DNA, 20 bp, Artificial Sequence
  Synthetic Construct
cctcccctcccagcatgaag

SEQ ID NO: 2835 - DNA, 22 bp, Artificial Sequence
  Synthetic Construct
tccctgggtggtctgtctgatt

SEQ ID NO: 2836 - DNA, 22 bp, Artificial Sequence
  Synthetic Construct
ccccatcccattgcttctcagt

SEQ ID NO: 2837 - DNA, 21 bp, Artificial Sequence
  Synthetic Construct
tggcttcaaggtagggaggtt

SEQ ID NO: 2838 - DNA, 19 bp, Artificial Sequence
  Synthetic Construct
ggagggtggcagtgtggta

SEQ ID NO: 2839 - DNA, 23 bp, Artificial Sequence
  Synthetic Construct
gctgtatccagggaggtgacaag

SEQ ID NO: 2840 - DNA, 25 bp, Artificial Sequence
  Synthetic Construct
cctgcgtgtcaaatactcctttcta

SEQ ID NO: 2841 - DNA, 24 bp, Artificial Sequence
  Synthetic Construct
gctgttgtggttaagagcctggat

SEQ ID NO: 2842 - DNA, 23 bp, Artificial Sequence
  Synthetic Construct
accaggcatagtggagataggaa

SEQ ID NO: 2843 - DNA, 20 bp, Artificial Sequence
  Synthetic Construct
tgccggcctcccagtctcat

SEQ ID NO: 2844 - DNA, 19 bp, Artificial Sequence
  Synthetic Construct
tgctcgggcagggtgagaa

SEQ ID NO: 2845 - DNA, 22 bp, Artificial Sequence
  Synthetic Construct
ggcacccgtttggccttaattg

SEQ ID NO: 2846 - DNA, 20 bp, Artificial Sequence
  Synthetic Construct
tggtgggcaggagaggctaa

SEQ ID NO: 2847 - DNA, 22 bp, Artificial Sequence
  Synthetic Construct
aagtgggtgctacagaagcatt

SEQ ID NO: 2848 - DNA, 27 bp, Artificial Sequence
  Synthetic Construct
gggctaagaatgagtgattgggtcata

SEQ ID NO: 2849 - DNA, 22 bp, Artificial Sequence
  Synthetic Construct
ttcaggctctgagacacgaaag

SEQ ID NO: 2850 - DNA, 20 bp, Artificial Sequence
  Synthetic Construct
actcctgaccgagggaatgt

SEQ ID NO: 2851 - DNA, 22 bp, Artificial Sequence
  Synthetic Construct
cccaaaggaaaccatcccatgt

SEQ ID NO: 2852 - DNA, 22 bp, Artificial Sequence
  Synthetic Construct
cacaggttccctcccacttact

SEQ ID NO: 2853 - DNA, 22 bp, Artificial Sequence
  Synthetic Construct
agccggggaatgtcctgtattc

SEQ ID NO: 2854 - DNA, 25 bp, Artificial Sequence
  Synthetic Construct
ccttctgatgcttggataccgcaaa

SEQ ID NO: 2855 - DNA, 23 bp, Artificial Sequence
  Synthetic Construct
gcagatcaggattgcaggctttg

SEQ ID NO: 2856 - DNA, 21 bp, Artificial Sequence
  Synthetic Construct
ggcctcagaagccaggataag

SEQ ID NO: 2857 - DNA, 22 bp, Artificial Sequence
  Synthetic Construct
ggtttcgctcatgcctctgttg

SEQ ID NO: 2858 - DNA, 20 bp, Artificial Sequence
  Synthetic Construct
ttcctgagagggctgtgcta

SEQ ID NO: 2859 - DNA, 21 bp, Artificial Sequence
  Synthetic Construct
accagctccttcctcccttct

SEQ ID NO: 2860 - DNA, 21 bp, Artificial Sequence
  Synthetic Construct
gcacagctaggaatgggaaca

SEQ ID NO: 2861 - DNA, 27 bp, Artificial Sequence
  Synthetic Construct
gctaatgctcaaagggaaaagtgtctt

SEQ ID NO: 2862 - DNA, 24 bp, Artificial Sequence
  Synthetic Construct
gtggcattgtggaaacaagcaaag

SEQ ID NO: 2863 - DNA, 22 bp, Artificial Sequence
  Synthetic Construct
cctgccagcagggcatttttct

SEQ ID NO: 2864 - DNA, 21 bp, Artificial Sequence
  Synthetic Construct
cctcagatggctgagggaaga

SEQ ID NO: 2865 - DNA, 20 bp, Artificial Sequence
  Synthetic Construct
gttcaggcctgcagggaaaa

SEQ ID NO: 2866 - DNA, 26 bp, Artificial Sequence
  Synthetic Construct
gggtacaaatagcctttacagcattg

SEQ ID NO: 2867 - DNA, 22 bp, Artificial Sequence
  Synthetic Construct
aggcagcttaggccactagtct

SEQ ID NO: 2868 - DNA, 25 bp, Artificial Sequence
  Synthetic Construct
gaactccacccagttctaaggatag

SEQ ID NO: 2869 - DNA, 22 bp, Artificial Sequence
  Synthetic Construct
ccctggaagaaggagagggaat

SEQ ID NO: 2870 - DNA, 21 bp, Artificial Sequence
  Synthetic Construct
agggcagtgagcactgagttg

SEQ ID NO: 2871 - DNA, 21 bp, Artificial Sequence
  Synthetic Construct
atccccacggacaccaacgat

SEQ ID NO: 2872 - DNA, 21 bp, Artificial Sequence
  Synthetic Construct
gcagccattccctcaccacat

SEQ ID NO: 2873 - DNA, 19 bp, Artificial Sequence
  Synthetic Construct
ccccgggcaaacacatact

SEQ ID NO: 2874 - DNA, 20 bp, Artificial Sequence
  Synthetic Construct
atcctggtcctgggcagtaa

SEQ ID NO: 2875 - DNA, 22 bp, Artificial Sequence
  Synthetic Construct
accaggtgccagctccctatac

SEQ ID NO: 2876 - DNA, 24 bp, Artificial Sequence
  Synthetic Construct
gtggagcaggactagctgagaatc

SEQ ID NO: 2877 - DNA, 23 bp, Artificial Sequence
  Synthetic Construct
gccagaaatccacaccatacaag

SEQ ID NO: 2878 - DNA, 24 bp, Artificial Sequence
  Synthetic Construct
ggggacagtttcaagtggatgaga

SEQ ID NO: 2879 - DNA, 21 bp, Artificial Sequence
  Synthetic Construct
aggtgagggcttgaggcagtt

SEQ ID NO: 2880 - DNA, 23 bp, Artificial Sequence
  Synthetic Construct
tgagggaaaccaaaactgcattc

SEQ ID NO: 2881 - DNA, 22 bp, Artificial Sequence
  Synthetic Construct
aggccttttccactctccctta

SEQ ID NO: 2882 - DNA, 24 bp, Artificial Sequence
  Synthetic Construct
cccttacaaaccacagatgcaaag

SEQ ID NO: 2883 - DNA, 24 bp, Artificial Sequence
  Synthetic Construct
cactcttaggaagggagtgtctgt

SEQ ID NO: 2884 - DNA, 22 bp, Artificial Sequence
  Synthetic Construct
atagggaagtggtgtggtcaac

SEQ ID NO: 2885 - DNA, 18 bp, Artificial Sequence
  Synthetic Construct
tccctgcctgggtcttgt

SEQ ID NO: 2886 - DNA, 22 bp, Artificial Sequence
  Synthetic Construct
caggagctgaggctttggtttg

SEQ ID NO: 2887 - DNA, 22 bp, Artificial Sequence
  Synthetic Construct
tgttttctgtgtgccagtgtgt

SEQ ID NO: 2888 - DNA, 20 bp, Artificial Sequence
  Synthetic Construct
gcagggttcaggccagtaga

SEQ ID NO: 2889 - DNA, 22 bp, Artificial Sequence
  Synthetic Construct
agctgggatggagggacattga

SEQ ID NO: 2890 - DNA, 27 bp, Artificial Sequence
  Synthetic Construct
ggtgtacaattgctggatcctaagaca

SEQ ID NO: 2891 - DNA, 22 bp, Artificial Sequence
  Synthetic Construct
cagcctccaggcaaatttccaa

SEQ ID NO: 2892 - DNA, 23 bp, Artificial Sequence
  Synthetic Construct
gcaagtttggccatctcttgtga

SEQ ID NO: 2893 - DNA, 25 bp, Artificial Sequence
  Synthetic Construct
cgtccatgaaggaatagctggtgtt

SEQ ID NO: 2894 - DNA, 23 bp, Artificial Sequence
  Synthetic Construct
acccggctatacgagaactcttt

SEQ ID NO: 2895 - DNA, 25 bp, Artificial Sequence
  Synthetic Construct
gttcatgaaagtgaaagagccatga

SEQ ID NO: 2896 - DNA, 23 bp, Artificial Sequence
  Synthetic Construct
gggacaaaatcggctccttcaga

SEQ ID NO: 2897 - DNA, 20 bp, Artificial Sequence
  Synthetic Construct
atgccctgaatcgcccttgt

SEQ ID NO: 2898 - DNA, 21 bp, Artificial Sequence
  Synthetic Construct
cccacacctcttgccaaggaa

SEQ ID NO: 2899 - DNA, 20 bp, Artificial Sequence
  Synthetic Construct
gcccatgggtaaggcaggaa

SEQ ID NO: 2900 - DNA, 19 bp, Artificial Sequence
  Synthetic Construct
actggccggtggtcctgtt

SEQ ID NO: 2901 - DNA, 22 bp, Artificial Sequence
  Synthetic Construct
cgctgtcctggaagtgttgttc

SEQ ID NO: 2902 - DNA, 21 bp, Artificial Sequence
  Synthetic Construct
tggcccacagaaagggtctca

SEQ ID NO: 2903 - DNA, 24 bp, Artificial Sequence
  Synthetic Construct
tctctggttaacagatgccagatg

SEQ ID NO: 2904 - DNA, 22 bp, Artificial Sequence
  Synthetic Construct
cccaaaaggctctgaggtcatc

SEQ ID NO: 2905 - DNA, 21 bp, Artificial Sequence
  Synthetic Construct
ggacatgactccctgggacaa

SEQ ID NO: 2906 - DNA, 20 bp, Artificial Sequence
  Synthetic Construct
tgtcttagctgcgcctctgt

SEQ ID NO: 2907 - DNA, 19 bp, Artificial Sequence
  Synthetic Construct
gccaagggcaggtgggata

SEQ ID NO: 2908 - DNA, 25 bp, Artificial Sequence
  Synthetic Construct
cctttccaactccatcatctggtta

SEQ ID NO: 2909 - DNA, 25 bp, Artificial Sequence
  Synthetic Construct
cctgcctgataccttcttgatgact

SEQ ID NO: 2910 - DNA, 22 bp, Artificial Sequence
  Synthetic Construct
ggcctaaaggccaaggagtgaa

SEQ ID NO: 2911 - DNA, 20 bp, Artificial Sequence
  Synthetic Construct
cactgcttagcgacctgtgt

SEQ ID NO: 2912 - DNA, 20 bp, Artificial Sequence
  Synthetic Construct
tggtcagcgtgaagctctgt

SEQ ID NO: 2913 - DNA, 20 bp, Artificial Sequence
  Synthetic Construct
aggctccacaggaggtcatt

SEQ ID NO: 2914 - DNA, 25 bp, Artificial Sequence
  Synthetic Construct
tgtgaaagaaagggcagacattgta

SEQ ID NO: 2915 - DNA, 22 bp, Artificial Sequence
  Synthetic Construct
ccagtgtgggatctcaggcatt

SEQ ID NO: 2916 - DNA, 25 bp, Artificial Sequence
  Synthetic Construct
gaatttactctgaccaccacaccta

SEQ ID NO: 2917 - DNA, 19 bp, Artificial Sequence
  Synthetic Construct
tgctgtgtgcagggactgt

SEQ ID NO: 2918 - DNA, 22 bp, Artificial Sequence
  Synthetic Construct
tcaggtgacaggtggggtaaca

SEQ ID NO: 2919 - DNA, 20 bp, Artificial Sequence
  Synthetic Construct
gaaaccaactgccggagact

SEQ ID NO: 2920 - DNA, 20 bp, Artificial Sequence
  Synthetic Construct
aaggaagtggccgcagtatg

SEQ ID NO: 2921 - DNA, 19 bp, Artificial Sequence
  Synthetic Construct
agcgctgggccatgtcatt

SEQ ID NO: 2922 - DNA, 27 bp, Artificial Sequence
  Synthetic Construct
ggttagttccctttattgccccaagat

SEQ ID NO: 2923 - DNA, 23 bp, Artificial Sequence
  Synthetic Construct
gtgtgcagttggtaaaggcaaag

SEQ ID NO: 2924 - DNA, 24 bp, Artificial Sequence
  Synthetic Construct
gtgattttccagcacctcccacta

SEQ ID NO: 2925 - DNA, 27 bp, Artificial Sequence
  Synthetic Construct
gggaaaccctgtaataactcactctgt

SEQ ID NO: 2926 - DNA, 23 bp, Artificial Sequence
  Synthetic Construct
gtcagtgcttttcatggcatctt

SEQ ID NO: 2927 - DNA, 24 bp, Artificial Sequence
  Synthetic Construct
aaattactccatggtgggaagtgt

SEQ ID NO: 2928 - DNA, 22 bp, Artificial Sequence
  Synthetic Construct
gcctgattgaacccctacaaca

SEQ ID NO: 2929 - DNA, 19 bp, Artificial Sequence
  Synthetic Construct
cggcgtccaggagacagtt

SEQ ID NO: 2930 - DNA, 23 bp, Artificial Sequence
  Synthetic Construct
ccagggtctttccaagagcattc

SEQ ID NO: 2931 - DNA, 25 bp, Artificial Sequence
  Synthetic Construct
gtttctcaggataagcagctcaaac

SEQ ID NO: 2932 - DNA, 20 bp, Artificial Sequence
  Synthetic Construct
tgaccaggcagagggctgat

SEQ ID NO: 2933 - DNA, 21 bp, Artificial Sequence
  Synthetic Construct
ttggccacccagagcagtcat

SEQ ID NO: 2934 - DNA, 21 bp, Artificial Sequence
  Synthetic Construct
gcagtgatgcgatgtgagtct

SEQ ID NO: 2935 - DNA, 27 bp, Artificial Sequence
  Synthetic Construct
gaaacctaaggatatcaaagggctgat

SEQ ID NO: 2936 - DNA, 22 bp, Artificial Sequence
  Synthetic Construct
caggcccaataggcccatttac

SEQ ID NO: 2937 - DNA, 22 bp, Artificial Sequence
  Synthetic Construct
ctgggtcagctcaagtggattg

SEQ ID NO: 2938 - DNA, 20 bp, Artificial Sequence
  Synthetic Construct
tgtgccgctgtgtgacattc

SEQ ID NO: 2939 - DNA, 22 bp, Artificial Sequence
  Synthetic Construct
gcccaggcatccaatccctaag

SEQ ID NO: 2940 - DNA, 23 bp, Artificial Sequence
  Synthetic Construct
tgatgtgcctctcttgttccaat

SEQ ID NO: 2941 - DNA, 21 bp, Artificial Sequence
  Synthetic Construct
aggaactctggggagatgcaa

SEQ ID NO: 2942 - DNA, 22 bp, Artificial Sequence
  Synthetic Construct
cgttgctgcaatcaaggtgttg

SEQ ID NO: 2943 - DNA, 25 bp, Artificial Sequence
  Synthetic Construct
gacacctcctctatcctgtggaatg

SEQ ID NO: 2944 - DNA, 25 bp, Artificial Sequence
  Synthetic Construct
aaaggtaatgtccattcggctagat

SEQ ID NO: 2945 - DNA, 29 bp, Artificial Sequence
  Synthetic Construct
cggagaaaattggttttcctatcggtgtt

SEQ ID NO: 2946 - DNA, 20 bp, Artificial Sequence
  Synthetic Construct
gcactaaacgccagggtgat

SEQ ID NO: 2947 - DNA, 21 bp, Artificial Sequence
  Synthetic Construct
aaaggggacctgccaccttca

SEQ ID NO: 2948 - DNA, 22 bp, Artificial Sequence
  Synthetic Construct
tggtgtcagcctcgttccttct

SEQ ID NO: 2949 - DNA, 20 bp, Artificial Sequence
  Synthetic Construct
caccacacaggtgcatcaca

SEQ ID NO: 2950 - DNA, 22 bp, Artificial Sequence
  Synthetic Construct
cccattgccaaaagcaaactgt

SEQ ID NO: 2951 - DNA, 20 bp, Artificial Sequence
  Synthetic Construct
agggccacagcagaggagat

SEQ ID NO: 2952 - DNA, 23 bp, Artificial Sequence
  Synthetic Construct
ctgcgtttgtgttcaggctaaag

SEQ ID NO: 2953 - DNA, 21 bp, Artificial Sequence
  Synthetic Construct
atgttcccaggccctgctctt

SEQ ID NO: 2954 - DNA, 20 bp, Artificial Sequence
  Synthetic Construct
cacgcggaactagcaaccta

SEQ ID NO: 2955 - DNA, 21 bp, Artificial Sequence
  Synthetic Construct
atgtgctgcctaccccacttg

SEQ ID NO: 2956 - DNA, 18 bp, Artificial Sequence
  Synthetic Construct
tgggtgcaccaggagtgt

SEQ ID NO: 2957 - DNA, 25 bp, Artificial Sequence
  Synthetic Construct
ctcagggactaagtgtctctgacaa

SEQ ID NO: 2958 - DNA, 28 bp, Artificial Sequence
  Synthetic Construct
cctaaatacagggagtgggatgtagaag

SEQ ID NO: 2959 - DNA, 23 bp, Artificial Sequence
  Synthetic Construct
gcttcctccaccccgtgattaag

SEQ ID NO: 2960 - DNA, 22 bp, Artificial Sequence
  Synthetic Construct
ggagaacctccgaccacagaaa

SEQ ID NO: 2961 - DNA, 20 bp, Artificial Sequence
  Synthetic Construct
agtccccagggaggcagctt

SEQ ID NO: 2962 - DNA, 18 bp, Artificial Sequence
  Synthetic Construct
accccagagcctgctgtt

SEQ ID NO: 2963 - DNA, 23 bp, Artificial Sequence
  Synthetic Construct
ctcgagctgaacacttgtgtgat

SEQ ID NO: 2964 - DNA, 19 bp, Artificial Sequence
  Synthetic Construct
tggaagggacgcccgcaat

SEQ ID NO: 2965 - DNA, 22 bp, Artificial Sequence
  Synthetic Construct
atttggcctggaggggctgagt

SEQ ID NO: 2966 - DNA, 22 bp, Artificial Sequence
  Synthetic Construct
gaagtcagtggtcagagcatca

SEQ ID NO: 2967 - DNA, 22 bp, Artificial Sequence
  Synthetic Construct
caccgtgtctctaagggtcagt

SEQ ID NO: 2968 - DNA, 24 bp, Artificial Sequence
  Synthetic Construct
ggagccacagaattagcacagtca

SEQ ID NO: 2969 - DNA, 24 bp, Artificial Sequence
  Synthetic Construct
cagatttggctggcatttcagaag

SEQ ID NO: 2970 - DNA, 24 bp, Artificial Sequence
  Synthetic Construct
cctgtctgcttttgtgtcaacagt

SEQ ID NO: 2971 - DNA, 20 bp, Artificial Sequence
  Synthetic Construct
agagaggtgagacggtgcaa

SEQ ID NO: 2972 - DNA, 21 bp, Artificial Sequence
  Synthetic Construct
cgacaggggagcaggagagat

SEQ ID NO: 2973 - DNA, 24 bp, Artificial Sequence
  Synthetic Construct
gctggatggtctaggatggcttca

SEQ ID NO: 2974 - DNA, 22 bp, Artificial Sequence
  Synthetic Construct
ccaacttcagcacatgcacttc

SEQ ID NO: 2975 - DNA, 20 bp, Artificial Sequence
  Synthetic Construct
gcacgcacctcttgcaaatc

SEQ ID NO: 2976 - DNA, 26 bp, Artificial Sequence
  Synthetic Construct
cacaccttttctcaggtacaccttca

SEQ ID NO: 2977 - DNA, 19 bp, Artificial Sequence
  Synthetic Construct
tggcgtctgcactcactca

SEQ ID NO: 2978 - DNA, 20 bp, Artificial Sequence
  Synthetic Construct
gctatgaggcagtgcgtgtt

SEQ ID NO: 2979 - DNA, 20 bp, Artificial Sequence
  Synthetic Construct
agatggggcagcagcattca

SEQ ID NO: 2980 - DNA, 24 bp, Artificial Sequence
  Synthetic Construct
ctcatgacctttgcatttgctgat

SEQ ID NO: 2981 - DNA, 20 bp, Artificial Sequence
  Synthetic Construct
tgcctcccactcttggtgtt

SEQ ID NO: 2982 - DNA, 22 bp, Artificial Sequence
  Synthetic Construct
ggcttctgcacccctaagtttg

SEQ ID NO: 2983 - DNA, 20 bp, Artificial Sequence
  Synthetic Construct
cttgctgtgccccttccaat

SEQ ID NO: 2984 - DNA, 22 bp, Artificial Sequence
  Synthetic Construct
agtacaggccacaggggatgaa

SEQ ID NO: 2985 - DNA, 23 bp, Artificial Sequence
  Synthetic Construct
aaaagccacaaagatgggtcaag

SEQ ID NO: 2986 - DNA, 22 bp, Artificial Sequence
  Synthetic Construct
gcagccctgaattggaagttct

SEQ ID NO: 2987 - DNA, 21 bp, Artificial Sequence
  Synthetic Construct
cccattcccacagagcaggaa

SEQ ID NO: 2988 - DNA, 22 bp, Artificial Sequence
  Synthetic Construct
cccacaggagcaggtgttttag

SEQ ID NO: 2989 - DNA, 24 bp, Artificial Sequence
  Synthetic Construct
cagtaaatggtgaggccacagttg

SEQ ID NO: 2990 - DNA, 20 bp, Artificial Sequence
  Synthetic Construct
accaaccagtggacccagat

SEQ ID NO: 2991 - DNA, 30 bp, Artificial Sequence
  Synthetic Construct
ctccagttcactaaggaacatgaaatgctt

SEQ ID NO: 2992 - DNA, 23 bp, Artificial Sequence
  Synthetic Construct
ggtccttccatgtccctcagtct

SEQ ID NO: 2993 - DNA, 20 bp, Artificial Sequence
  Synthetic Construct
tcctgtggctgaaggacaga

SEQ ID NO: 2994 - DNA, 20 bp, Artificial Sequence
  Synthetic Construct
aactgagcgaggggctttgt

SEQ ID NO: 2995 - DNA, 19 bp, Artificial Sequence
  Synthetic Construct
ggagccacaggggatggaa

SEQ ID NO: 2996 - DNA, 20 bp, Artificial Sequence
  Synthetic Construct
tccagcaggctgaggcattg

SEQ ID NO: 2997 - DNA, 20 bp, Artificial Sequence
  Synthetic Construct
tcctggtccgggagaacgat

SEQ ID NO: 2998 - DNA, 20 bp, Artificial Sequence
  Synthetic Construct
agggaagcctgcatgtctct

SEQ ID NO: 2999 - DNA, 22 bp, Artificial Sequence
  Synthetic Construct
gtctggaacccgcacaacttac

SEQ ID NO: 3000 - DNA, 23 bp, Artificial Sequence
  Synthetic Construct
tgggtttttccaccatagcaaga

SEQ ID NO: 3001 - DNA, 19 bp, Artificial Sequence
  Synthetic Construct
ggaccgcacggtgtcttct

SEQ ID NO: 3002 - DNA, 20 bp, Artificial Sequence
  Synthetic Construct
ggtgggtcccttgtgagcat

SEQ ID NO: 3003 - DNA, 24 bp, Artificial Sequence
  Synthetic Construct
cacctcgttcatatccaggtgagt

SEQ ID NO: 3004 - DNA, 20 bp, Artificial Sequence
  Synthetic Construct
tggaactgcaccagcacaga

SEQ ID NO: 3005 - DNA, 19 bp, Artificial Sequence
  Synthetic Construct
gtaccctccagcccaggaa

SEQ ID NO: 3006 - DNA, 20 bp, Artificial Sequence
  Synthetic Construct
aggaggggctcagcatggat

SEQ ID NO: 3007 - DNA, 19 bp, Artificial Sequence
  Synthetic Construct
tggacgtgcagacctcaca

SEQ ID NO: 3008 - DNA, 24 bp, Artificial Sequence
  Synthetic Construct
tcaaggaaatgcagtggtatgtgt

SEQ ID NO: 3009 - DNA, 25 bp, Artificial Sequence
  Synthetic Construct
gggcagtgggtaagaagaacccatt

SEQ ID NO: 3010 - DNA, 20 bp, Artificial Sequence
  Synthetic Construct
taggccacggagccacttta

SEQ ID NO: 3011 - DNA, 24 bp, Artificial Sequence
  Synthetic Construct
cgcttctgtttaatgccttagcaa

SEQ ID NO: 3012 - DNA, 25 bp, Artificial Sequence
  Synthetic Construct
gggcgagtttcagaacaagggaaag

SEQ ID NO: 3013 - DNA, 24 bp, Artificial Sequence
  Synthetic Construct
ctgtatctgtgggcttttccttca

SEQ ID NO: 3014 - DNA, 23 bp, Artificial Sequence
  Synthetic Construct
tctatcccatggaagggcaaaag

SEQ ID NO: 3015 - DNA, 25 bp, Artificial Sequence
  Synthetic Construct
tcaaaacagagtctcactgtcactt

SEQ ID NO: 3016 - DNA, 20 bp, Artificial Sequence
  Synthetic Construct
ggccctctctgggcactttg

SEQ ID NO: 3017 - DNA, 21 bp, Artificial Sequence
  Synthetic Construct
cctcatattgctccgccacaa

SEQ ID NO: 3018 - DNA, 20 bp, Artificial Sequence
  Synthetic Construct
ccttgttctccggcgatgtt

SEQ ID NO: 3019 - DNA, 27 bp, Artificial Sequence
  Synthetic Construct
ctgatgtgtaccccgaaatcattgaac

SEQ ID NO: 3020 - DNA, 25 bp, Artificial Sequence
  Synthetic Construct
ggctcctccatttccttccacctaa

SEQ ID NO: 3021 - DNA, 26 bp, Artificial Sequence
  Synthetic Construct
cacatcagaaacgtttgggctgatac

SEQ ID NO: 3022 - DNA, 21 bp, Artificial Sequence
  Synthetic Construct
tcgggccagcccagatttact

SEQ ID NO: 3023 - DNA, 25 bp, Artificial Sequence
  Synthetic Construct
caagaatttccctgtctggaaccaa

SEQ ID NO: 3024 - DNA, 22 bp, Artificial Sequence
  Synthetic Construct
ggccagcccagagtagtaacaa

SEQ ID NO: 3025 - DNA, 22 bp, Artificial Sequence
  Synthetic Construct
gacagagggctaaggtcagcaa

SEQ ID NO: 3026 - DNA, 21 bp, Artificial Sequence
  Synthetic Construct
cagccatcaccacagaagtca

SEQ ID NO: 3027 - DNA, 20 bp, Artificial Sequence
  Synthetic Construct
tgccaggtgctggagaaaga

SEQ ID NO: 3028 - DNA, 25 bp, Artificial Sequence
  Synthetic Construct
agcatacccttagctctacttcaca

SEQ ID NO: 3029 - DNA, 24 bp, Artificial Sequence
  Synthetic Construct
cctttgttgttgctcttccagttc

SEQ ID NO: 3030 - DNA, 20 bp, Artificial Sequence
  Synthetic Construct
cagtttccccagccttgctt

SEQ ID NO: 3031 - DNA, 20 bp, Artificial Sequence
  Synthetic Construct
ttcactgaggggcagggaat

SEQ ID NO: 3032 - DNA, 28 bp, Artificial Sequence
  Synthetic Construct
ggccaacttggtgtaaaaatcccttgaa

SEQ ID NO: 3033 - DNA, 24 bp, Artificial Sequence
  Synthetic Construct
gagttaccagtgaggtgtggaaac

SEQ ID NO: 3034 - DNA, 20 bp, Artificial Sequence
  Synthetic Construct
cgcctccacggcttgattga

SEQ ID NO: 3035 - DNA, 29 bp, Artificial Sequence
  Synthetic Construct
ggcaccaacactaaaaatcaacccgaaga

SEQ ID NO: 3036 - DNA, 22 bp, Artificial Sequence
  Synthetic Construct
tgctttcttgggcatgggaata

SEQ ID NO: 3037 - DNA, 22 bp, Artificial Sequence
  Synthetic Construct
aagcctgagggcaggagacttg

SEQ ID NO: 3038 - DNA, 24 bp, Artificial Sequence
  Synthetic Construct
gcagaatagccagcagttttgaag

SEQ ID NO: 3039 - DNA, 23 bp, Artificial Sequence
  Synthetic Construct
gcagctacttgcaaggtctgagt

SEQ ID NO: 3040 - DNA, 24 bp, Artificial Sequence
  Synthetic Construct
cctccattctggatgccacttttg

SEQ ID NO: 3041 - DNA, 23 bp, Artificial Sequence
  Synthetic Construct
gcacttcaccaagctctgtctca

SEQ ID NO: 3042 - DNA, 24 bp, Artificial Sequence
  Synthetic Construct
ggcgtggaaggatgtctaacaagt

SEQ ID NO: 3043 - DNA, 20 bp, Artificial Sequence
  Synthetic Construct
ccaaatgggcaggtgggaaa

SEQ ID NO: 3044 - DNA, 20 bp, Artificial Sequence
  Synthetic Construct
actcctgggctcaagcaatc

SEQ ID NO: 3045 - DNA, 21 bp, Artificial Sequence
  Synthetic Construct
ctgcattgtcagtccctctgt

SEQ ID NO: 3046 - DNA, 24 bp, Artificial Sequence
  Synthetic Construct
gcagaagttatagcagggatgaca

SEQ ID NO: 3047 - DNA, 23 bp, Artificial Sequence
  Synthetic Construct
ccagcaacctttttggagtgttt

SEQ ID NO: 3048 - DNA, 23 bp, Artificial Sequence
  Synthetic Construct
aacagcttgatgtcttccctgaa

SEQ ID NO: 3049 - DNA, 25 bp, Artificial Sequence
  Synthetic Construct
ggacagaacaatatcctggtgagaa

SEQ ID NO: 3050 - DNA, 24 bp, Artificial Sequence
  Synthetic Construct
ccaccagagcaggtcttctacaac

SEQ ID NO: 3051 - DNA, 25 bp, Artificial Sequence
  Synthetic Construct
ccaaatgtgaggatcaacccaggaa

SEQ ID NO: 3052 - DNA, 24 bp, Artificial Sequence
  Synthetic Construct
ggagctaaggccagaaggtagttc

SEQ ID NO: 3053 - DNA, 20 bp, Artificial Sequence
  Synthetic Construct
acagagtgggctggcacata

SEQ ID NO: 3054 - DNA, 20 bp, Artificial Sequence
  Synthetic Construct
gtgtgttcagggcgacaaca

SEQ ID NO: 3055 - DNA, 20 bp, Artificial Sequence
  Synthetic Construct
gccgcccctctcttttctca

SEQ ID NO: 3056 - DNA, 20 bp, Artificial Sequence
  Synthetic Construct
gaatggggctgcactgcata

SEQ ID NO: 3057 - DNA, 24 bp, Artificial Sequence
  Synthetic Construct
ttcaccacactagtaaggcaaagt

SEQ ID NO: 3058 - DNA, 27 bp, Artificial Sequence
  Synthetic Construct
gtgagaatccattggaaatctgagcat

SEQ ID NO: 3059 - DNA, 26 bp, Artificial Sequence
  Synthetic Construct
gggccctgaataaccaatagcgatac

SEQ ID NO: 3060 - DNA, 21 bp, Artificial Sequence
  Synthetic Construct
gccaggagaggaaggccattt

SEQ ID NO: 3061 - DNA, 20 bp, Artificial Sequence
  Synthetic Construct
caaagctgcccttggtctgt

SEQ ID NO: 3062 - DNA, 27 bp, Artificial Sequence
  Synthetic Construct
ggccttaaagaggacatcgagagaaag

SEQ ID NO: 3063 - DNA, 21 bp, Artificial Sequence
  Synthetic Construct
tatggctccaccctgcctaac

SEQ ID NO: 3064 - DNA, 22 bp, Artificial Sequence
  Synthetic Construct
gggtggtgaggtttggtggaaa

SEQ ID NO: 3065 - DNA, 24 bp, Artificial Sequence
  Synthetic Construct
ggagacaaacagaccaagcgaaca

SEQ ID NO: 3066 - DNA, 22 bp, Artificial Sequence
  Synthetic Construct
gctctctcactgggatggacta

SEQ ID NO: 3067 - DNA, 27 bp, Artificial Sequence
  Synthetic Construct
acaacctaggaagaattagggcttttc

SEQ ID NO: 3068 - DNA, 21 bp, Artificial Sequence
  Synthetic Construct
cctaccccaggacagaagcat

SEQ ID NO: 3069 - DNA, 25 bp, Artificial Sequence
  Synthetic Construct
gtcaaggataggcaagagacgaagt

SEQ ID NO: 3070 - DNA, 21 bp, Artificial Sequence
  Synthetic Construct
ctgaagcaagctgggtgaagt

SEQ ID NO: 3071 - DNA, 24 bp, Artificial Sequence
  Synthetic Construct
ggtccccaaattctctgccagttg

SEQ ID NO: 3072 - DNA, 23 bp, Artificial Sequence
  Synthetic Construct
ccggaaagaatcggcctccttag

SEQ ID NO: 3073 - DNA, 25 bp, Artificial Sequence
  Synthetic Construct
gaaaaagagctgaacaaacggaaac

SEQ ID NO: 3074 - DNA, 20 bp, Artificial Sequence
  Synthetic Construct
tgctgctccagccataggtt

SEQ ID NO: 3075 - DNA, 20 bp, Artificial Sequence
  Synthetic Construct
aacaccctgggaggcatagt

SEQ ID NO: 3076 - DNA, 22 bp, Artificial Sequence
  Synthetic Construct
ggccctccaaactcatggaagt

SEQ ID NO: 3077 - DNA, 24 bp, Artificial Sequence
  Synthetic Construct
gctctcacaaaggaggttcaaaga

SEQ ID NO: 3078 - DNA, 25 bp, Artificial Sequence
  Synthetic Construct
catgcctatctcccttagtcctact

SEQ ID NO: 3079 - DNA, 21 bp, Artificial Sequence
  Synthetic Construct
agtcagctcaggggtgacctt

SEQ ID NO: 3080 - DNA, 21 bp, Artificial Sequence
  Synthetic Construct
ccacagcactgactgccatct

SEQ ID NO: 3081 - DNA, 24 bp, Artificial Sequence
  Synthetic Construct
acatgctgaaagccaaaacctcta

SEQ ID NO: 3082 - DNA, 24 bp, Artificial Sequence
  Synthetic Construct
cagaatagcacagagtgtcacaga

SEQ ID NO: 3083 - DNA, 22 bp, Artificial Sequence
  Synthetic Construct
ccacatcctgccataggagcta

SEQ ID NO: 3084 - DNA, 20 bp, Artificial Sequence
  Synthetic Construct
tagggcaaagagcgcctagt

SEQ ID NO: 3085 - DNA, 27 bp, Artificial Sequence
  Synthetic Construct
ggaattctgtaagctaagaagccaagt

SEQ ID NO: 3086 - DNA, 20 bp, Artificial Sequence
  Synthetic Construct
gctcccaaccccagaacact

SEQ ID NO: 3087 - DNA, 22 bp, Artificial Sequence
  Synthetic Construct
ggcattccagcagtgaccatag

SEQ ID NO: 3088 - DNA, 23 bp, Artificial Sequence
  Synthetic Construct
ccatgggcacaatccaagcctat

SEQ ID NO: 3089 - DNA, 19 bp, Artificial Sequence
  Synthetic Construct
ggggccctttctggaggta

SEQ ID NO: 3090 - DNA, 19 bp, Artificial Sequence
  Synthetic Construct
aacggcaggtgagcagtct

SEQ ID NO: 3091 - DNA, 25 bp, Artificial Sequence
  Synthetic Construct
gtggttgctttcaccctacttcttc

SEQ ID NO: 3092 - DNA, 21 bp, Artificial Sequence
  Synthetic Construct
gactcctggcttggaacagaa

SEQ ID NO: 3093 - DNA, 27 bp, Artificial Sequence
  Synthetic Construct
gcaaagatgacataagcaaaggcttga

SEQ ID NO: 3094 - DNA, 25 bp, Artificial Sequence
  Synthetic Construct
ggagtatcactttagcactggagtt

SEQ ID NO: 3095 - DNA, 20 bp, Artificial Sequence
  Synthetic Construct
aggatcggtcaggccagtgt

SEQ ID NO: 3096 - DNA, 18 bp, Artificial Sequence
  Synthetic Construct
tccaagccaccgccatca

SEQ ID NO: 3097 - DNA, 26 bp, Artificial Sequence
  Synthetic Construct
cctccactctaccaaagcttataaca

SEQ ID NO: 3098 - DNA, 21 bp, Artificial Sequence
  Synthetic Construct
tacgctgaccaccctgacact

SEQ ID NO: 3099 - DNA, 23 bp, Artificial Sequence
  Synthetic Construct
gtgggtactactctgtgcaggaa

SEQ ID NO: 3100 - DNA, 25 bp, Artificial Sequence
  Synthetic Construct
tgaggcatttgagtcaaggtgatac

SEQ ID NO: 3101 - DNA, 20 bp, Artificial Sequence
  Synthetic Construct
tgcctgggttaaggcgcata

SEQ ID NO: 3102 - DNA, 29 bp, Artificial Sequence
  Synthetic Construct
gggaaccttactgatcactagtacaaaac

SEQ ID NO: 3103 - DNA, 22 bp, Artificial Sequence
  Synthetic Construct
ctcctgacacatgcccagtaaa

SEQ ID NO: 3104 - DNA, 19 bp, Artificial Sequence
  Synthetic Construct
agtgtggggccacctggaa

SEQ ID NO: 3105 - DNA, 21 bp, Artificial Sequence
  Synthetic Construct
atgtccggtcggaggtacagt

SEQ ID NO: 3106 - DNA, 23 bp, Artificial Sequence
  Synthetic Construct
aatactgccctccccggactaca

SEQ ID NO: 3107 - DNA, 22 bp, Artificial Sequence
  Synthetic Construct
cactgcagcaaaggctttcaac

SEQ ID NO: 3108 - DNA, 23 bp, Artificial Sequence
  Synthetic Construct
ctcagctctgtgcctggataatg

SEQ ID NO: 3109 - DNA, 25 bp, Artificial Sequence
  Synthetic Construct
ctgatgaattgctggggtggttaag

SEQ ID NO: 3110 - DNA, 26 bp, Artificial Sequence
  Synthetic Construct
ggtttaggtcctccatagtgagcata

SEQ ID NO: 3111 - DNA, 25 bp, Artificial Sequence
  Synthetic Construct
cgggttctttcttgacaggggatct

SEQ ID NO: 3112 - DNA, 20 bp, Artificial Sequence
  Synthetic Construct
aggcttcccctggtgactgt

SEQ ID NO: 3113 - DNA, 20 bp, Artificial Sequence
  Synthetic Construct
agagctggcaggctcaagta

SEQ ID NO: 3114 - DNA, 20 bp, Artificial Sequence
  Synthetic Construct
ctggggcctgcagtttgatt

SEQ ID NO: 3115 - DNA, 22 bp, Artificial Sequence
  Synthetic Construct
gcagcctgaatcttggcagaca

SEQ ID NO: 3116 - DNA, 30 bp, Artificial Sequence
  Synthetic Construct
gagctgtccactaaccattaattaggtcat

SEQ ID NO: 3117 - DNA, 21 bp, Artificial Sequence
  Synthetic Construct
tctcaccttagcctcccaagt

SEQ ID NO: 3118 - DNA, 21 bp, Artificial Sequence
  Synthetic Construct
tggctgccctccttccatgat

SEQ ID NO: 3119 - DNA, 25 bp, Artificial Sequence
  Synthetic Construct
cccaggagtgtatcttggtcctaca

SEQ ID NO: 3120 - DNA, 23 bp, Artificial Sequence
  Synthetic Construct
gcggattttgaagccagagatga

SEQ ID NO: 3121 - DNA, 23 bp, Artificial Sequence
  Synthetic Construct
ccatatgagctctccctgtgcta

SEQ ID NO: 3122 - DNA, 20 bp, Artificial Sequence
  Synthetic Construct
gcgtggtgcagatggtgttt

SEQ ID NO: 3123 - DNA, 20 bp, Artificial Sequence
  Synthetic Construct
tggtctcctggaagctcctt

SEQ ID NO: 3124 - DNA, 24 bp, Artificial Sequence
  Synthetic Construct
tgtaaaacagggaagatgcactca

SEQ ID NO: 3125 - DNA, 25 bp, Artificial Sequence
  Synthetic Construct
cctcctgtgaggatcaaagttcaag

SEQ ID NO: 3126 - DNA, 20 bp, Artificial Sequence
  Synthetic Construct
ggaaaatccgccaccagcat

SEQ ID NO: 3127 - DNA, 22 bp, Artificial Sequence
  Synthetic Construct
agcagtcagtcagttccagcta

SEQ ID NO: 3128 - DNA, 23 bp, Artificial Sequence
  Synthetic Construct
cctcaatgattaccggggctttc

SEQ ID NO: 3129 - DNA, 20 bp, Artificial Sequence
  Synthetic Construct
ggctctcttggccacaggtt

SEQ ID NO: 3130 - DNA, 23 bp, Artificial Sequence
  Synthetic Construct
cacgcccagaatcaaagccaaag

SEQ ID NO: 3131 - DNA, 24 bp, Artificial Sequence
  Synthetic Construct
cctcttagctgtccctcttgtttc

SEQ ID NO: 3132 - DNA, 20 bp, Artificial Sequence
  Synthetic Construct
acacaccccacagcttcttc

SEQ ID NO: 3133 - DNA, 21 bp, Artificial Sequence
  Synthetic Construct
ggctggagggcaaatctgtgt

SEQ ID NO: 3134 - DNA, 24 bp, Artificial Sequence
  Synthetic Construct
gccatcacagaggggttacaggtt

SEQ ID NO: 3135 - DNA, 27 bp, Artificial Sequence
  Synthetic Construct
tcactaagtataaggcctagcctacaa

SEQ ID NO: 3136 - DNA, 25 bp, Artificial Sequence
  Synthetic Construct
gggtccaatgtgaaaagcacagagt

SEQ ID NO: 3137 - DNA, 22 bp, Artificial Sequence
  Synthetic Construct
caaggccataaggccaatgagt

SEQ ID NO: 3138 - DNA, 21 bp, Artificial Sequence
  Synthetic Construct
cctgaggtgaggggtgctagt

SEQ ID NO: 3139 - DNA, 25 bp, Artificial Sequence
  Synthetic Construct
ggcatgctcttcagggagaagttag

SEQ ID NO: 3140 - DNA, 22 bp, Artificial Sequence
  Synthetic Construct
tgtccccagcaccagtaagttc

SEQ ID NO: 3141 - DNA, 24 bp, Artificial Sequence
  Synthetic Construct
gcgggaattggacacagactggta

SEQ ID NO: 3142 - DNA, 27 bp, Artificial Sequence
  Synthetic Construct
ggcttcttcaactccaagtccaggata

SEQ ID NO: 3143 - DNA, 22 bp, Artificial Sequence
  Synthetic Construct
gggctccattgtgttcctcaac

SEQ ID NO: 3144 - DNA, 23 bp, Artificial Sequence
  Synthetic Construct
ggttctgagggagcaaacctctt

SEQ ID NO: 3145 - DNA, 25 bp, Artificial Sequence
  Synthetic Construct
accctcttaattgctttggggtttt

SEQ ID NO: 3146 - DNA, 24 bp, Artificial Sequence
  Synthetic Construct
cgtggagaggtattttggcagtgt

SEQ ID NO: 3147 - DNA, 27 bp, Artificial Sequence
  Synthetic Construct
ggctgatttctgctgtccttcaagcta

SEQ ID NO: 3148 - DNA, 23 bp, Artificial Sequence
  Synthetic Construct
cagttgcctgcatcttgatctgt

SEQ ID NO: 3149 - DNA, 24 bp, Artificial Sequence
  Synthetic Construct
gcactggtggaagagacagcaaag

SEQ ID NO: 3150 - DNA, 20 bp, Artificial Sequence
  Synthetic Construct
acccatgacagccgactctt

SEQ ID NO: 3151 - DNA, 24 bp, Artificial Sequence
  Synthetic Construct
ccttagaaggcctctcttctctgt

SEQ ID NO: 3152 - DNA, 23 bp, Artificial Sequence
  Synthetic Construct
cggtctgaacggaaactgccata

SEQ ID NO: 3153 - DNA, 21 bp, Artificial Sequence
  Synthetic Construct
accctggtctgccttgccttt

SEQ ID NO: 3154 - DNA, 22 bp, Artificial Sequence
  Synthetic Construct
gctcaatcgaggcaggactaac

SEQ ID NO: 3155 - DNA, 22 bp, Artificial Sequence
  Synthetic Construct
ggagttggcccagaacttccat

SEQ ID NO: 3156 - DNA, 23 bp, Artificial Sequence
  Synthetic Construct
ctaagggcttggagaagagcaaa

SEQ ID NO: 3157 - DNA, 21 bp, Artificial Sequence
  Synthetic Construct
agccaaccaggacccagaagt

SEQ ID NO: 3158 - DNA, 23 bp, Artificial Sequence
  Synthetic Construct
agacacatttgcatgcctaccat

SEQ ID NO: 3159 - DNA, 30 bp, Artificial Sequence
  Synthetic Construct
cactccattaaagccatttgggaatagaag

SEQ ID NO: 3160 - DNA, 24 bp, Artificial Sequence
  Synthetic Construct
gcagccaaaagggcttgttaaatg

SEQ ID NO: 3161 - DNA, 22 bp, Artificial Sequence
  Synthetic Construct
tgggtaccagttaagccacagt

SEQ ID NO: 3162 - DNA, 24 bp, Artificial Sequence
  Synthetic Construct
agagggacttatgtgcagtgaatg

SEQ ID NO: 3163 - DNA, 23 bp, Artificial Sequence
  Synthetic Construct
gctggttttctcacaagcctaga

SEQ ID NO: 3164 - DNA, 21 bp, Artificial Sequence
  Synthetic Construct
agactgcctgctgtttcatca

SEQ ID NO: 3165 - DNA, 21 bp, Artificial Sequence
  Synthetic Construct
gcaggggctgtaaagggtgta

SEQ ID NO: 3166 - DNA, 23 bp, Artificial Sequence
  Synthetic Construct
ctgggtcttctatggccttgttg

SEQ ID NO: 3167 - DNA, 22 bp, Artificial Sequence
  Synthetic Construct
ggtgcctcacttcatagtgtca

SEQ ID NO: 3168 - DNA, 23 bp, Artificial Sequence
  Synthetic Construct
agatggagggcagatttcagaag

SEQ ID NO: 3169 - DNA, 23 bp, Artificial Sequence
  Synthetic Construct
cacacagagcctgggcttatatc

SEQ ID NO: 3170 - DNA, 25 bp, Artificial Sequence
  Synthetic Construct
gcctgggatctctgaagaacagttg

SEQ ID NO: 3171 - DNA, 25 bp, Artificial Sequence
  Synthetic Construct
ccctttgtaaagcatggccctatac

SEQ ID NO: 3172 - DNA, 25 bp, Artificial Sequence
  Synthetic Construct
ttctcatacacaggtgatagcaaca

SEQ ID NO: 3173 - DNA, 21 bp, Artificial Sequence
  Synthetic Construct
cctctttgcccttgggtggaa

SEQ ID NO: 3174 - DNA, 19 bp, Artificial Sequence
  Synthetic Construct
gttgttggccaggcaccat

SEQ ID NO: 3175 - DNA, 21 bp, Artificial Sequence
  Synthetic Construct
ccctggctactgcccatgttt

SEQ ID NO: 3176 - DNA, 22 bp, Artificial Sequence
  Synthetic Construct
gccttgctgtcagctccaatgt

SEQ ID NO: 3177 - DNA, 22 bp, Artificial Sequence
  Synthetic Construct
catctttgtggggctggagttc

SEQ ID NO: 3178 - DNA, 20 bp, Artificial Sequence
  Synthetic Construct
gagcccacatcccgtgaaca

SEQ ID NO: 3179 - DNA, 20 bp, Artificial Sequence
  Synthetic Construct
gaatgtgtccgccagtctgt

SEQ ID NO: 3180 - DNA, 23 bp, Artificial Sequence
  Synthetic Construct
cctggaagccagctagaaaccat

SEQ ID NO: 3181 - DNA, 22 bp, Artificial Sequence
  Synthetic Construct
ggagaggaagacagtggcatct

SEQ ID NO: 3182 - DNA, 22 bp, Artificial Sequence
  Synthetic Construct
gggtgaatgccggtagttgtga

SEQ ID NO: 3183 - DNA, 20 bp, Artificial Sequence
  Synthetic Construct
agccgggcgtacttcctttt

SEQ ID NO: 3184 - DNA, 22 bp, Artificial Sequence
  Synthetic Construct
gctgtatgtctgcaggtcaagt

SEQ ID NO: 3185 - DNA, 24 bp, Artificial Sequence
  Synthetic Construct
tcctcacatgagagtttcctgttc

SEQ ID NO: 3186 - DNA, 22 bp, Artificial Sequence
  Synthetic Construct
ctccagcatctggaaggagaca

SEQ ID NO: 3187 - DNA, 20 bp, Artificial Sequence
  Synthetic Construct
cgggaggcttgcctgagaaa

SEQ ID NO: 3188 - DNA, 20 bp, Artificial Sequence
  Synthetic Construct
tagccagctcccacacacaa

SEQ ID NO: 3189 - DNA, 21 bp, Artificial Sequence
  Synthetic Construct
tgggcgtagcacaagaaatca

SEQ ID NO: 3190 - DNA, 22 bp, Artificial Sequence
  Synthetic Construct
tgggttgctctttgctgttcaa

SEQ ID NO: 3191 - DNA, 24 bp, Artificial Sequence
  Synthetic Construct
gtggcaaacaactctgaggctaac

SEQ ID NO: 3192 - DNA, 24 bp, Artificial Sequence
  Synthetic Construct
gggaagaatgctgtgtcctcacaa

SEQ ID NO: 3193 - DNA, 20 bp, Artificial Sequence
  Synthetic Construct
atttcctgccgtgccacctt

SEQ ID NO: 3194 - DNA, 20 bp, Artificial Sequence
  Synthetic Construct
cacagaaagctggggcaaca

SEQ ID NO: 3195 - DNA, 23 bp, Artificial Sequence
  Synthetic Construct
ccagtacatgctttcccaacaca

SEQ ID NO: 3196 - DNA, 27 bp, Artificial Sequence
  Synthetic Construct
cctttttaaaggagtggatgcagaagt

SEQ ID NO: 3197 - DNA, 23 bp, Artificial Sequence
  Synthetic Construct
gagccccaaatgtacactagcaa

SEQ ID NO: 3198 - DNA, 27 bp, Artificial Sequence
  Synthetic Construct
gcccagtgcttttcttaattgctttga

SEQ ID NO: 3199 - DNA, 23 bp, Artificial Sequence
  Synthetic Construct
ccactggactactggactacact

SEQ ID NO: 3200 - DNA, 24 bp, Artificial Sequence
  Synthetic Construct
caatagccagggtctgaattgcat

SEQ ID NO: 3201 - DNA, 23 bp, Artificial Sequence
  Synthetic Construct
gagtgcagaagaatgggttctga

SEQ ID NO: 3202 - DNA, 20 bp, Artificial Sequence
  Synthetic Construct
aagccctaaacccgcgttac

SEQ ID NO: 3203 - DNA, 25 bp, Artificial Sequence
  Synthetic Construct
agcagaaatcacacaatggcaatac

SEQ ID NO: 3204 - DNA, 20 bp, Artificial Sequence
  Synthetic Construct
tgccttcactgcctggtgat

SEQ ID NO: 3205 - DNA, 20 bp, Artificial Sequence
  Synthetic Construct
accctccccgccatcaagta

SEQ ID NO: 3206 - DNA, 27 bp, Artificial Sequence
  Synthetic Construct
cgtctttctccagtttctgagccctat

SEQ ID NO: 3207 - DNA, 25 bp, Artificial Sequence
  Synthetic Construct
ggtcagctgtgtcaataaggactga

SEQ ID NO: 3208 - DNA, 20 bp, Artificial Sequence
  Synthetic Construct
ggaagcaggtgtcagtgtga

SEQ ID NO: 3209 - DNA, 24 bp, Artificial Sequence
  Synthetic Construct
ggtctgcttctggagtctgcagtt

SEQ ID NO: 3210 - DNA, 25 bp, Artificial Sequence
  Synthetic Construct
cacactcggttcctgtttcaggatt

SEQ ID NO: 3211 - DNA, 25 bp, Artificial Sequence
  Synthetic Construct
acacccatcccaaagggattaaaag

SEQ ID NO: 3212 - DNA, 22 bp, Artificial Sequence
  Synthetic Construct
cctgtctcccttgccagatcaa

SEQ ID NO: 3213 - DNA, 23 bp, Artificial Sequence
  Synthetic Construct
aggcttccctgagcagagatatt

SEQ ID NO: 3214 - DNA, 20 bp, Artificial Sequence
  Synthetic Construct
tctctggctccagcgtctga

SEQ ID NO: 3215 - DNA, 19 bp, Artificial Sequence
  Synthetic Construct
agggatatggccggcttct

SEQ ID NO: 3216 - DNA, 20 bp, Artificial Sequence
  Synthetic Construct
gtggtggtggttgtgctact

SEQ ID NO: 3217 - DNA, 24 bp, Artificial Sequence
  Synthetic Construct
ccttccttttcactaagcctgtct

SEQ ID NO: 3218 - DNA, 24 bp, Artificial Sequence
  Synthetic Construct
gagagattggaaggggagagattg

SEQ ID NO: 3219 - DNA, 26 bp, Artificial Sequence
  Synthetic Construct
ggtggagtaaaaacagcactggacta

SEQ ID NO: 3220 - DNA, 25 bp, Artificial Sequence
  Synthetic Construct
ccttcagggcagtgagttctcttct

SEQ ID NO: 3221 - DNA, 22 bp, Artificial Sequence
  Synthetic Construct
tccaggaaaaggaactgcaaca

SEQ ID NO: 3222 - DNA, 26 bp, Artificial Sequence
  Synthetic Construct
cgcatgtgtaccttaatgatgtcaac

SEQ ID NO: 3223 - DNA, 21 bp, Artificial Sequence
  Synthetic Construct
ccctgaatgttccaccagctt

SEQ ID NO: 3224 - DNA, 23 bp, Artificial Sequence
  Synthetic Construct
gcctccagagctagggatggtta

SEQ ID NO: 3225 - DNA, 19 bp, Artificial Sequence
  Synthetic Construct
tggaggggaccgggttcta

SEQ ID NO: 3226 - DNA, 24 bp, Artificial Sequence
  Synthetic Construct
cctggatttgtctcctgtcacttc

SEQ ID NO: 3227 - DNA, 24 bp, Artificial Sequence
  Synthetic Construct
ggggacacgtcttactgtagtctt

SEQ ID NO: 3228 - DNA, 22 bp, Artificial Sequence
  Synthetic Construct
tcagcaggaaaagcacttgact

SEQ ID NO: 3229 - DNA, 24 bp, Artificial Sequence
  Synthetic Construct
gtttccttccttgtttgcagagtt

SEQ ID NO: 3230 - DNA, 27 bp, Artificial Sequence
  Synthetic Construct
ccataccagacacaaactacagtcaca

SEQ ID NO: 3231 - DNA, 28 bp, Artificial Sequence
  Synthetic Construct
cctgactttctagttcaactcagccttt

SEQ ID NO: 3232 - DNA, 22 bp, Artificial Sequence
  Synthetic Construct
gttgatgctctggctactgcta

SEQ ID NO: 3233 - DNA, 24 bp, Artificial Sequence
  Synthetic Construct
caagggctattcaggactcacaaa

SEQ ID NO: 3234 - DNA, 25 bp, Artificial Sequence
  Synthetic Construct
cactgcataccagcaaatgagttgt

SEQ ID NO: 3235 - DNA, 20 bp, Artificial Sequence
  Synthetic Construct
actgcatggcagagcagctt

SEQ ID NO: 3236 - DNA, 21 bp, Artificial Sequence
  Synthetic Construct
gcagagctcctcaaagggaaa

SEQ ID NO: 3237 - DNA, 25 bp, Artificial Sequence
  Synthetic Construct
ccaccactaccatcatcactatgaa

SEQ ID NO: 3238 - DNA, 22 bp, Artificial Sequence
  Synthetic Construct
gtgagtgaatgggtgggaggta

SEQ ID NO: 3239 - DNA, 25 bp, Artificial Sequence
  Synthetic Construct
catgtgctctagcaagacaatcaaa

SEQ ID NO: 3240 - DNA, 24 bp, Artificial Sequence
  Synthetic Construct
ggagaccacaatgcacaggtctac

SEQ ID NO: 3241 - DNA, 22 bp, Artificial Sequence
  Synthetic Construct
agctctgtaggagggcaaggat

SEQ ID NO: 3242 - DNA, 20 bp, Artificial Sequence
  Synthetic Construct
tccatggctctggctgctat

SEQ ID NO: 3243 - DNA, 22 bp, Artificial Sequence
  Synthetic Construct
ccgtgactagtgcttcgtgctt

SEQ ID NO: 3244 - DNA, 22 bp, Artificial Sequence
  Synthetic Construct
ggaccaatggctggaagaccaa

SEQ ID NO: 3245 - DNA, 24 bp, Artificial Sequence
  Synthetic Construct
cagaagtgtggtggggttacttac

SEQ ID NO: 3246 - DNA, 21 bp, Artificial Sequence
  Synthetic Construct
ggctgttgcagaagcatcact

SEQ ID NO: 3247 - DNA, 21 bp, Artificial Sequence
  Synthetic Construct
ccaaacctgctcctccaccat

SEQ ID NO: 3248 - DNA, 20 bp, Artificial Sequence
  Synthetic Construct
gcccaggtctcgtctccatt

SEQ ID NO: 3249 - DNA, 21 bp, Artificial Sequence
  Synthetic Construct
tgagccttgcagtggggtaac

SEQ ID NO: 3250 - DNA, 30 bp, Artificial Sequence
  Synthetic Construct
gcatagctctttgtagaaacttgaccctta

SEQ ID NO: 3251 - DNA, 22 bp, Artificial Sequence
  Synthetic Construct
ccacagtgaagcctggagaaca

SEQ ID NO: 3252 - DNA, 20 bp, Artificial Sequence
  Synthetic Construct
ggacatgggcgaggcaattt

SEQ ID NO: 3253 - DNA, 23 bp, Artificial Sequence
  Synthetic Construct
atcccagggaggagaggtgacat

SEQ ID NO: 3254 - DNA, 22 bp, Artificial Sequence
  Synthetic Construct
cgctggcccttctagtgaatgt

SEQ ID NO: 3255 - DNA, 24 bp, Artificial Sequence
  Synthetic Construct
ctgcaattccccaacaatctctgt

SEQ ID NO: 3256 - DNA, 20 bp, Artificial Sequence
  Synthetic Construct
ggctgtcctccctgcctaaa

SEQ ID NO: 3257 - DNA, 21 bp, Artificial Sequence
  Synthetic Construct
gctgtggggtttgagggctat

SEQ ID NO: 3258 - DNA, 23 bp, Artificial Sequence
  Synthetic Construct
ccctgagagtggtagctactgaa

SEQ ID NO: 3259 - DNA, 25 bp, Artificial Sequence
  Synthetic Construct
gccagatcaaatcattccaggtgaa

SEQ ID NO: 3260 - DNA, 24 bp, Artificial Sequence
  Synthetic Construct
cacagaagggcagataaagcaaaa

SEQ ID NO: 3261 - DNA, 23 bp, Artificial Sequence
  Synthetic Construct
gccatgtggatttccaggtcact

SEQ ID NO: 3262 - DNA, 24 bp, Artificial Sequence
  Synthetic Construct
cgctgtagctgaagcactgtccta

SEQ ID NO: 3263 - DNA, 22 bp, Artificial Sequence
  Synthetic Construct
ctgctgattcaggaccacagaa

SEQ ID NO: 3264 - DNA, 22 bp, Artificial Sequence
  Synthetic Construct
agcacagggcaacagaagtaac

SEQ ID NO: 3265 - DNA, 25 bp, Artificial Sequence
  Synthetic Construct
gggcccaacatctagttctgctaca

SEQ ID NO: 3266 - DNA, 25 bp, Artificial Sequence
  Synthetic Construct
gagaaagcaggtactgaccttttca

SEQ ID NO: 3267 - DNA, 23 bp, Artificial Sequence
  Synthetic Construct
ccagtctccatctggaggaccaa

SEQ ID NO: 3268 - DNA, 28 bp, Artificial Sequence
  Synthetic Construct
ggcaagcccatcatagattttagtgaca

SEQ ID NO: 3269 - DNA, 22 bp, Artificial Sequence
  Synthetic Construct
ccccacctctttctgggatttg

SEQ ID NO: 3270 - DNA, 22 bp, Artificial Sequence
  Synthetic Construct
agtggctgaacagaccgtctac

SEQ ID NO: 3271 - DNA, 24 bp, Artificial Sequence
  Synthetic Construct
cagcctagtgagggtgtaagacta

SEQ ID NO: 3272 - DNA, 19 bp, Artificial Sequence
  Synthetic Construct
gggtgtggggcgtagtgaa

SEQ ID NO: 3273 - DNA, 19 bp, Artificial Sequence
  Synthetic Construct
gcagaggcaccaccacact

SEQ ID NO: 3274 - DNA, 22 bp, Artificial Sequence
  Synthetic Construct
cctgcatacggagaggtcaaag

SEQ ID NO: 3275 - DNA, 22 bp, Artificial Sequence
  Synthetic Construct
gcgccatctttttgaggcatag

SEQ ID NO: 3276 - DNA, 26 bp, Artificial Sequence
  Synthetic Construct
ggaaggttctgacagacaatggaact

SEQ ID NO: 3277 - DNA, 20 bp, Artificial Sequence
  Synthetic Construct
catcttccacgcctgagctt

SEQ ID NO: 3278 - DNA, 21 bp, Artificial Sequence
  Synthetic Construct
gctcatgggcagggttcactt

SEQ ID NO: 3279 - DNA, 20 bp, Artificial Sequence
  Synthetic Construct
gcagaagcactgtccagact

SEQ ID NO: 3280 - DNA, 26 bp, Artificial Sequence
  Synthetic Construct
ccttctatcagtagcaaggagacagt

SEQ ID NO: 3281 - DNA, 20 bp, Artificial Sequence
  Synthetic Construct
agcgggttggactcactgtt

SEQ ID NO: 3282 - DNA, 23 bp, Artificial Sequence
  Synthetic Construct
ggctaactgagccctggtgaatg

SEQ ID NO: 3283 - DNA, 22 bp, Artificial Sequence
  Synthetic Construct
ctggagacgtacatgccagtca

SEQ ID NO: 3284 - DNA, 22 bp, Artificial Sequence
  Synthetic Construct
ccgcccatctctcctgtttgtt

SEQ ID NO: 3285 - DNA, 21 bp, Artificial Sequence
  Synthetic Construct
ggggaacagctggaaaagcat

SEQ ID NO: 3286 - DNA, 21 bp, Artificial Sequence
  Synthetic Construct
agtctggcctgtggtgtctgt

SEQ ID NO: 3287 - DNA, 22 bp, Artificial Sequence
  Synthetic Construct
agggaccccatcacccatttac

SEQ ID NO: 3288 - DNA, 30 bp, Artificial Sequence
  Synthetic Construct
ggaactacaatagacataaactggctgtca

SEQ ID NO: 3289 - DNA, 24 bp, Artificial Sequence
  Synthetic Construct
tgttttagcagcacgagatgaact

SEQ ID NO: 3290 - DNA, 22 bp, Artificial Sequence
  Synthetic Construct
aggcaaatggcaggagggaatg

SEQ ID NO: 3291 - DNA, 24 bp, Artificial Sequence
  Synthetic Construct
gagattacaggagcatgccacttc

SEQ ID NO: 3292 - DNA, 22 bp, Artificial Sequence
  Synthetic Construct
tgctttcgagaaaagccacact

SEQ ID NO: 3293 - DNA, 23 bp, Artificial Sequence
  Synthetic Construct
gcagcggctatagacagatccaa

SEQ ID NO: 3294 - DNA, 20 bp, Artificial Sequence
  Synthetic Construct
gcactgcctctgcctcaaaa

SEQ ID NO: 3295 - DNA, 23 bp, Artificial Sequence
  Synthetic Construct
taccaccagggctgatccagaga

SEQ ID NO: 3296 - DNA, 22 bp, Artificial Sequence
  Synthetic Construct
gtggtctgcagtcacatcttga

SEQ ID NO: 3297 - DNA, 23 bp, Artificial Sequence
  Synthetic Construct
gtccatcagccagatgtggagtt

SEQ ID NO: 3298 - DNA, 22 bp, Artificial Sequence
  Synthetic Construct
gggtctgtcgcctgacttaaca

SEQ ID NO: 3299 - DNA, 21 bp, Artificial Sequence
  Synthetic Construct
agaggtcagggtgaagcacta

SEQ ID NO: 3300 - DNA, 27 bp, Artificial Sequence
  Synthetic Construct
ggaaaaagtggaggcactgattcattc

SEQ ID NO: 3301 - DNA, 26 bp, Artificial Sequence
  Synthetic Construct
agagaatagtacctcccatgggtaaa

SEQ ID NO: 3302 - DNA, 20 bp, Artificial Sequence
  Synthetic Construct
gcagagccaggcctcaaaac

SEQ ID NO: 3303 - DNA, 19 bp, Artificial Sequence
  Synthetic Construct
tgagtcctgccgcttcaca

SEQ ID NO: 3304 - DNA, 22 bp, Artificial Sequence
  Synthetic Construct
gtgggaagcgggttaggaagat

SEQ ID NO: 3305 - DNA, 22 bp, Artificial Sequence
  Synthetic Construct
ggagccagacttcttggtcctt

SEQ ID NO: 3306 - DNA, 21 bp, Artificial Sequence
  Synthetic Construct
gcgttgtggtgctttcctttc

SEQ ID NO: 3307 - DNA, 25 bp, Artificial Sequence
  Synthetic Construct
aattttcagaggaaagggaggaaca

SEQ ID NO: 3308 - DNA, 21 bp, Artificial Sequence
  Synthetic Construct
gcaccacataggtgacagcaa

SEQ ID NO: 3309 - DNA, 18 bp, Artificial Sequence
  Synthetic Construct
agtgcacgtccgccgtaa

SEQ ID NO: 3310 - DNA, 24 bp, Artificial Sequence
  Synthetic Construct
tcctcaggttgttaggcattttga

SEQ ID NO: 3311 - DNA, 21 bp, Artificial Sequence
  Synthetic Construct
ggcactggggaagacgaagaa

SEQ ID NO: 3312 - DNA, 21 bp, Artificial Sequence
  Synthetic Construct
tcctgcttgcctctggggaat

SEQ ID NO: 3313 - DNA, 20 bp, Artificial Sequence
  Synthetic Construct
accctggtgggatccagaaa

SEQ ID NO: 3314 - DNA, 23 bp, Artificial Sequence
  Synthetic Construct
cgagcccctatccagaaagaaaa

SEQ ID NO: 3315 - DNA, 23 bp, Artificial Sequence
  Synthetic Construct
gctcaaatcaccttcctgcaagt

SEQ ID NO: 3316 - DNA, 27 bp, Artificial Sequence
  Synthetic Construct
ggtacttttacttttgccgtaggtagt

SEQ ID NO: 3317 - DNA, 22 bp, Artificial Sequence
  Synthetic Construct
gggctgttacctcatcctcttg

SEQ ID NO: 3318 - DNA, 22 bp, Artificial Sequence
  Synthetic Construct
catcatgcccaagtagcgttca

SEQ ID NO: 3319 - DNA, 24 bp, Artificial Sequence
  Synthetic Construct
gggatttttgagcccctgaaattg

SEQ ID NO: 3320 - DNA, 20 bp, Artificial Sequence
  Synthetic Construct
acaccggcgacttctccaat

SEQ ID NO: 3321 - DNA, 22 bp, Artificial Sequence
  Synthetic Construct
tggcctcaggcaacactctgta

SEQ ID NO: 3322 - DNA, 28 bp, Artificial Sequence
  Synthetic Construct
ctcaaggctaaagtaactccttggaaag

SEQ ID NO: 3323 - DNA, 20 bp, Artificial Sequence
  Synthetic Construct
agtctgcagagacccgtgta

SEQ ID NO: 3324 - DNA, 22 bp, Artificial Sequence
  Synthetic Construct
tgctgggtaggtgtgtggtaca

SEQ ID NO: 3325 - DNA, 20 bp, Artificial Sequence
  Synthetic Construct
aacacaggcctggctctcaa

SEQ ID NO: 3326 - DNA, 20 bp, Artificial Sequence
  Synthetic Construct
ggaaagggagggaggtgctt

SEQ ID NO: 3327 - DNA, 22 bp, Artificial Sequence
  Synthetic Construct
gctctcctggctctgtgaggat

SEQ ID NO: 3328 - DNA, 22 bp, Artificial Sequence
  Synthetic Construct
acaacctagtgccaggggaagt

SEQ ID NO: 3329 - DNA, 21 bp, Artificial Sequence
  Synthetic Construct
acaagccccacagggtagact

SEQ ID NO: 3330 - DNA, 24 bp, Artificial Sequence
  Synthetic Construct
gaaccagtttcctttctcctggaa

SEQ ID NO: 3331 - DNA, 18 bp, Artificial Sequence
  Synthetic Construct
ggaagccactcgctgcat

SEQ ID NO: 3332 - DNA, 18 bp, Artificial Sequence
  Synthetic Construct
tgggtgcctcggatgctt

SEQ ID NO: 3333 - DNA, 23 bp, Artificial Sequence
  Synthetic Construct
gctcattaatgcacgcagacaca

SEQ ID NO: 3334 - DNA, 28 bp, Artificial Sequence
  Synthetic Construct
ggtggtacagaatacaatggctgtgatg

SEQ ID NO: 3335 - DNA, 22 bp, Artificial Sequence
  Synthetic Construct
tctggtagcaggagggagaaag

SEQ ID NO: 3336 - DNA, 26 bp, Artificial Sequence
  Synthetic Construct
ggatgtgttcatccgtctcttcacta

SEQ ID NO: 3337 - DNA, 20 bp, Artificial Sequence
  Synthetic Construct
agacatgggtccctctgctt

SEQ ID NO: 3338 - DNA, 28 bp, Artificial Sequence
  Synthetic Construct
cctggtacctgatatgatgttagctgta

SEQ ID NO: 3339 - DNA, 21 bp, Artificial Sequence
  Synthetic Construct
ggtccacccatagccctctga

SEQ ID NO: 3340 - DNA, 25 bp, Artificial Sequence
  Synthetic Construct
ggtaggcatttttcgatggcagaga

SEQ ID NO: 3341 - DNA, 20 bp, Artificial Sequence
  Synthetic Construct
agtagaggcagggtcacaca

SEQ ID NO: 3342 - DNA, 23 bp, Artificial Sequence
  Synthetic Construct
actaaggaagcctcttgggttct

SEQ ID NO: 3343 - DNA, 24 bp, Artificial Sequence
  Synthetic Construct
ctcttccctgaagacaaccaactt

SEQ ID NO: 3344 - DNA, 23 bp, Artificial Sequence
  Synthetic Construct
ccttccaggttgatggtcgcatt

SEQ ID NO: 3345 - DNA, 20 bp, Artificial Sequence
  Synthetic Construct
cactgcccagatggcagaag

SEQ ID NO: 3346 - DNA, 22 bp, Artificial Sequence
  Synthetic Construct
cgtggctgcatctgatcctttc

SEQ ID NO: 3347 - DNA, 20 bp, Artificial Sequence
  Synthetic Construct
tgtgagaggccgttgggaaa

SEQ ID NO: 3348 - DNA, 26 bp, Artificial Sequence
  Synthetic Construct
ggaaatgtttgactcatgccctgatg

SEQ ID NO: 3349 - DNA, 20 bp, Artificial Sequence
  Synthetic Construct
agtcagccagatgcccagaa

SEQ ID NO: 3350 - DNA, 20 bp, Artificial Sequence
  Synthetic Construct
agctcaggactgcgttcttc

SEQ ID NO: 3351 - DNA, 24 bp, Artificial Sequence
  Synthetic Construct
ccatgtacccaggagaggtgatga

SEQ ID NO: 3352 - DNA, 20 bp, Artificial Sequence
  Synthetic Construct
tgtgtgctgcagtggagctt

SEQ ID NO: 3353 - DNA, 25 bp, Artificial Sequence
  Synthetic Construct
ggcgtaacattagggtaccttctct

SEQ ID NO: 3354 - DNA, 24 bp, Artificial Sequence
  Synthetic Construct
gggtctgggagagggataacttca

SEQ ID NO: 3355 - DNA, 23 bp, Artificial Sequence
  Synthetic Construct
gtggtaactgcacgaggacaaag

SEQ ID NO: 3356 - DNA, 21 bp, Artificial Sequence
  Synthetic Construct
ggagcctcttggttcctgtgt

SEQ ID NO: 3357 - DNA, 21 bp, Artificial Sequence
  Synthetic Construct
aagacctctcgcaggccgatt

SEQ ID NO: 3358 - DNA, 20 bp, Artificial Sequence
  Synthetic Construct
agtgaaggccctctcctgaa

SEQ ID NO: 3359 - DNA, 24 bp, Artificial Sequence
  Synthetic Construct
cctcgattcagtctggggacattc

SEQ ID NO: 3360 - DNA, 22 bp, Artificial Sequence
  Synthetic Construct
tcactttccacctctcgaggaa

SEQ ID NO: 3361 - DNA, 22 bp, Artificial Sequence
  Synthetic Construct
aggtgaagcagagcaggacttc

SEQ ID NO: 3362 - DNA, 23 bp, Artificial Sequence
  Synthetic Construct
gcctcctcatctcatgggtttca

SEQ ID NO: 3363 - DNA, 21 bp, Artificial Sequence
  Synthetic Construct
aacccctttggtcttgcacat

SEQ ID NO: 3364 - DNA, 26 bp, Artificial Sequence
  Synthetic Construct
gctgctatggtggtatcagggagttc

SEQ ID NO: 3365 - DNA, 22 bp, Artificial Sequence
  Synthetic Construct
gcaggagcaggtttagctgaca

SEQ ID NO: 3366 - DNA, 20 bp, Artificial Sequence
  Synthetic Construct
ctcacacttgggcactgctt

SEQ ID NO: 3367 - DNA, 21 bp, Artificial Sequence
  Synthetic Construct
gctccccagtgatgggctttt

SEQ ID NO: 3368 - DNA, 27 bp, Artificial Sequence
  Synthetic Construct
cctctgtctacacagtgaacagcattg

SEQ ID NO: 3369 - DNA, 21 bp, Artificial Sequence
  Synthetic Construct
agcacccctgagcatgtggat

SEQ ID NO: 3370 - DNA, 21 bp, Artificial Sequence
  Synthetic Construct
cgatgcaggccatgacagaca

SEQ ID NO: 3371 - DNA, 23 bp, Artificial Sequence
  Synthetic Construct
ataatcagcctgcctcaaacaga

SEQ ID NO: 3372 - DNA, 23 bp, Artificial Sequence
  Synthetic Construct
gctgccaagagaaatgggacact

SEQ ID NO: 3373 - DNA, 22 bp, Artificial Sequence
  Synthetic Construct
gccatctcaaactcggccaatg

SEQ ID NO: 3374 - DNA, 22 bp, Artificial Sequence
  Synthetic Construct
gcagcttgcatgctttggaaca

SEQ ID NO: 3375 - DNA, 25 bp, Artificial Sequence
  Synthetic Construct
gtgaatggaaggtgcatgtaagaag

SEQ ID NO: 3376 - DNA, 25 bp, Artificial Sequence
  Synthetic Construct
ggggagaaacataatgctgggtctt

SEQ ID NO: 3377 - DNA, 22 bp, Artificial Sequence
  Synthetic Construct
gacagaccaagcctggagatca

SEQ ID NO: 3378 - DNA, 26 bp, Artificial Sequence
  Synthetic Construct
gcttcactaacaccagggtaggtatc

SEQ ID NO: 3379 - DNA, 22 bp, Artificial Sequence
  Synthetic Construct
gctggaactgggatttcagcaa

SEQ ID NO: 3380 - DNA, 24 bp, Artificial Sequence
  Synthetic Construct
gtccataacaggaccttagagcaa

SEQ ID NO: 3381 - DNA, 22 bp, Artificial Sequence
  Synthetic Construct
gctcttgggagtaggtggaaac

SEQ ID NO: 3382 - DNA, 24 bp, Artificial Sequence
  Synthetic Construct
ggttttgggacctagaagcagtca

SEQ ID NO: 3383 - DNA, 23 bp, Artificial Sequence
  Synthetic Construct
gggatagcaggtctctgttccaa

SEQ ID NO: 3384 - DNA, 23 bp, Artificial Sequence
  Synthetic Construct
ctcttctggagctctacccaact

SEQ ID NO: 3385 - DNA, 23 bp, Artificial Sequence
  Synthetic Construct
ccctttttccctgaagagctgaa

SEQ ID NO: 3386 - DNA, 24 bp, Artificial Sequence
  Synthetic Construct
ggactggtgaggaaggtgtaggaa

SEQ ID NO: 3387 - DNA, 22 bp, Artificial Sequence
  Synthetic Construct
gcaaaactccgggatcctcaac

SEQ ID NO: 3388 - DNA, 21 bp, Artificial Sequence
  Synthetic Construct
ttccctcccaggcaaggagtt

SEQ ID NO: 3389 - DNA, 18 bp, Artificial Sequence
  Synthetic Construct
tgcccaggtggagggttt

SEQ ID NO: 3390 - DNA, 22 bp, Artificial Sequence
  Synthetic Construct
aatcagccccaaagcaaagaac

SEQ ID NO: 3391 - DNA, 21 bp, Artificial Sequence
  Synthetic Construct
ccaaagtcgggagaagccaaa

SEQ ID NO: 3392 - DNA, 20 bp, Artificial Sequence
  Synthetic Construct
cctcaacacagcagccaaga

SEQ ID NO: 3393 - DNA, 23 bp, Artificial Sequence
  Synthetic Construct
cccacttcggtacaagtcagaca

SEQ ID NO: 3394 - DNA, 21 bp, Artificial Sequence
  Synthetic Construct
gccagtgtcactcccaagtca

SEQ ID NO: 3395 - DNA, 20 bp, Artificial Sequence
  Synthetic Construct
gggtagacagcagccgtaca

SEQ ID NO: 3396 - DNA, 21 bp, Artificial Sequence
  Synthetic Construct
cccctcctctgcagggttcta

SEQ ID NO: 3397 - DNA, 22 bp, Artificial Sequence
  Synthetic Construct
agggtcagttgggagtagaaca

SEQ ID NO: 3398 - DNA, 24 bp, Artificial Sequence
  Synthetic Construct
tgttcccacctctttatcctcctt

SEQ ID NO: 3399 - DNA, 18 bp, Artificial Sequence
  Synthetic Construct
tcagcgggctgtgtgtct

SEQ ID NO: 3400 - DNA, 19 bp, Artificial Sequence
  Synthetic Construct
ggagggctgcagctgaact

SEQ ID NO: 3401 - DNA, 19 bp, Artificial Sequence
  Synthetic Construct
acagccacagggcacttct

SEQ ID NO: 3402 - DNA, 22 bp, Artificial Sequence
  Synthetic Construct
gcagaagcttaggacggcattc

SEQ ID NO: 3403 - DNA, 26 bp, Artificial Sequence
  Synthetic Construct
gcctttccacctttgtctgaggagat

SEQ ID NO: 3404 - DNA, 22 bp, Artificial Sequence
  Synthetic Construct
gggcaggaatgcatgggcataa

SEQ ID NO: 3405 - DNA, 25 bp, Artificial Sequence
  Synthetic Construct
aaaactgcaaggagcctattgttac

SEQ ID NO: 3406 - DNA, 20 bp, Artificial Sequence
  Synthetic Construct
gcaaacagctgggcaagaga

SEQ ID NO: 3407 - DNA, 20 bp, Artificial Sequence
  Synthetic Construct
tccaggagcaggaggaggta

SEQ ID NO: 3408 - DNA, 21 bp, Artificial Sequence
  Synthetic Construct
ttgaatggccccagtgatgtt

SEQ ID NO: 3409 - DNA, 23 bp, Artificial Sequence
  Synthetic Construct
gaggctcagaaagatgcactgat

SEQ ID NO: 3410 - DNA, 21 bp, Artificial Sequence
  Synthetic Construct
aaggtgtggggagagcagtca

SEQ ID NO: 3411 - DNA, 20 bp, Artificial Sequence
  Synthetic Construct
gccttcgtggctagggttgt

SEQ ID NO: 3412 - DNA, 22 bp, Artificial Sequence
  Synthetic Construct
ggacggatgcaccaaacgtgat

SEQ ID NO: 3413 - DNA, 25 bp, Artificial Sequence
  Synthetic Construct
ccaatcagccatttggtgaatagtt

SEQ ID NO: 3414 - DNA, 22 bp, Artificial Sequence
  Synthetic Construct
cacaaaagcgcctctggtgaag

SEQ ID NO: 3415 - DNA, 19 bp, Artificial Sequence
  Synthetic Construct
taacgctgtggcggactca

SEQ ID NO: 3416 - DNA, 25 bp, Artificial Sequence
  Synthetic Construct
tttctacctgtgtcatttggacctt

SEQ ID NO: 3417 - DNA, 23 bp, Artificial Sequence
  Synthetic Construct
accatgacacttttcctgaccat

SEQ ID NO: 3418 - DNA, 22 bp, Artificial Sequence
  Synthetic Construct
gcatctccactccaagttcctt

SEQ ID NO: 3419 - DNA, 24 bp, Artificial Sequence
  Synthetic Construct
gttagaaaacctctgtgccagtga

SEQ ID NO: 3420 - DNA, 25 bp, Artificial Sequence
  Synthetic Construct
acgtatattttggtggggttgatgt

SEQ ID NO: 3421 - DNA, 20 bp, Artificial Sequence
  Synthetic Construct
cccggagtgttccccagttt

SEQ ID NO: 3422 - DNA, 21 bp, Artificial Sequence
  Synthetic Construct
aggctagtcccaggacaggaa

SEQ ID NO: 3423 - DNA, 21 bp, Artificial Sequence
  Synthetic Construct
agtgctaccggctcctgaact

SEQ ID NO: 3424 - DNA, 22 bp, Artificial Sequence
  Synthetic Construct
gggccactgtgattgcagactt

SEQ ID NO: 3425 - DNA, 20 bp, Artificial Sequence
  Synthetic Construct
cccaggcagctggtcctcta

SEQ ID NO: 3426 - DNA, 20 bp, Artificial Sequence
  Synthetic Construct
aactgatggcccctccaagt

SEQ ID NO: 3427 - DNA, 18 bp, Artificial Sequence
  Synthetic Construct
tgcccaccagtgccatgt

SEQ ID NO: 3428 - DNA, 19 bp, Artificial Sequence
  Synthetic Construct
aggatggcgagggctggaa

SEQ ID NO: 3429 - DNA, 23 bp, Artificial Sequence
  Synthetic Construct
ttggttcccagctactacagaga

SEQ ID NO: 3430 - DNA, 24 bp, Artificial Sequence
  Synthetic Construct
ggagcctggttttccatgccattc

SEQ ID NO: 3431 - DNA, 26 bp, Artificial Sequence
  Synthetic Construct
cagaagaaaacaatgcaggggttatg

SEQ ID NO: 3432 - DNA, 28 bp, Artificial Sequence
  Synthetic Construct
ccagctaccaaactcatttacagacaga

SEQ ID NO: 3433 - DNA, 20 bp, Artificial Sequence
  Synthetic Construct
tgacttctggtgccctggtt

SEQ ID NO: 3434 - DNA, 21 bp, Artificial Sequence
  Synthetic Construct
tgcaggggacccaacctttca

SEQ ID NO: 3435 - DNA, 21 bp, Artificial Sequence
  Synthetic Construct
tgcctaagcagaggcagtttg

SEQ ID NO: 3436 - DNA, 25 bp, Artificial Sequence
  Synthetic Construct
tccaatgtcagttggggtaactaaa

SEQ ID NO: 3437 - DNA, 27 bp, Artificial Sequence
  Synthetic Construct
gtccatttccacttattccagcatttg

SEQ ID NO: 3438 - DNA, 22 bp, Artificial Sequence
  Synthetic Construct
ccattgagagcaagggcaggta

SEQ ID NO: 3439 - DNA, 25 bp, Artificial Sequence
  Synthetic Construct
tgacatgtgtgtttatgagggagaa

SEQ ID NO: 3440 - DNA, 19 bp, Artificial Sequence
  Synthetic Construct
ttcggtgggagggctgtca

SEQ ID NO: 3441 - DNA, 26 bp, Artificial Sequence
  Synthetic Construct
cctgattccttgctcctcatccatag

SEQ ID NO: 3442 - DNA, 27 bp, Artificial Sequence
  Synthetic Construct
tgctgcttattgtctagaagctgtatc

SEQ ID NO: 3443 - DNA, 21 bp, Artificial Sequence
  Synthetic Construct
acatccctgcctcccacaagt

SEQ ID NO: 3444 - DNA, 20 bp, Artificial Sequence
  Synthetic Construct
tgctcctgcacggtcacaat

SEQ ID NO: 3445 - DNA, 23 bp, Artificial Sequence
  Synthetic Construct
gtgatcatttgcccttggctaca

SEQ ID NO: 3446 - DNA, 27 bp, Artificial Sequence
  Synthetic Construct
ctgacaatgattatggattggggtgtt

SEQ ID NO: 3447 - DNA, 25 bp, Artificial Sequence
  Synthetic Construct
ccctagaggttcatgggtacagaca

SEQ ID NO: 3448 - DNA, 19 bp, Artificial Sequence
  Synthetic Construct
acaatggagccggcactga

SEQ ID NO: 3449 - DNA, 27 bp, Artificial Sequence
  Synthetic Construct
gcttgtgggtttgactgaagagacttt

SEQ ID NO: 3450 - DNA, 20 bp, Artificial Sequence
  Synthetic Construct
ggccctggaagtcaggaaag

SEQ ID NO: 3451 - DNA, 21 bp, Artificial Sequence
  Synthetic Construct
ccagccttggttgtcctggtt

SEQ ID NO: 3452 - DNA, 27 bp, Artificial Sequence
  Synthetic Construct
ggaaggtaatacagcctgatgggagaa

SEQ ID NO: 3453 - DNA, 21 bp, Artificial Sequence
  Synthetic Construct
gcaagcagtgtctggcaaatc

SEQ ID NO: 3454 - DNA, 22 bp, Artificial Sequence
  Synthetic Construct
ccaactgcttcctgctgactgt

SEQ ID NO: 3455 - DNA, 22 bp, Artificial Sequence
  Synthetic Construct
ggtactaatgccgctgatgctt

SEQ ID NO: 3456 - DNA, 24 bp, Artificial Sequence
  Synthetic Construct
gtggtttaagtgcggactgtgttg

SEQ ID NO: 3457 - DNA, 21 bp, Artificial Sequence
  Synthetic Construct
tgagggaggtcggcacctaaa

SEQ ID NO: 3458 - DNA, 19 bp, Artificial Sequence
  Synthetic Construct
ggagcaggtccccagtgaa

SEQ ID NO: 3459 - DNA, 20 bp, Artificial Sequence
  Synthetic Construct
agtgctgagggtggcagaca

SEQ ID NO: 3460 - DNA, 25 bp, Artificial Sequence
  Synthetic Construct
gttctcaaatcaatccatggcaact

SEQ ID NO: 3461 - DNA, 23 bp, Artificial Sequence
  Synthetic Construct
ccttctccagcttcccaggatac

SEQ ID NO: 3462 - DNA, 19 bp, Artificial Sequence
  Synthetic Construct
aggcgatggcacgctgtct

SEQ ID NO: 3463 - DNA, 23 bp, Artificial Sequence
  Synthetic Construct
caacatccaacagagccgatttt

SEQ ID NO: 3464 - DNA, 20 bp, Artificial Sequence
  Synthetic Construct
acacaaggggcacccagaaa

SEQ ID NO: 3465 - DNA, 27 bp, Artificial Sequence
  Synthetic Construct
gcttcaggggagataaggaaatcaaga

SEQ ID NO: 3466 - DNA, 25 bp, Artificial Sequence
  Synthetic Construct
gcaatcacccaagaccaaacccaat

SEQ ID NO: 3467 - DNA, 19 bp, Artificial Sequence
  Synthetic Construct
caaggggctgccttcttga

SEQ ID NO: 3468 - DNA, 20 bp, Artificial Sequence
  Synthetic Construct
tgccccatttccctcagagt

SEQ ID NO: 3469 - DNA, 22 bp, Artificial Sequence
  Synthetic Construct
tttgtggagaaggcaagtgtca

SEQ ID NO: 3470 - DNA, 20 bp, Artificial Sequence
  Synthetic Construct
gcctgtgccatcagccaact

SEQ ID NO: 3471 - DNA, 22 bp, Artificial Sequence
  Synthetic Construct
aaccagatacacctgcatgctt

SEQ ID NO: 3472 - DNA, 19 bp, Artificial Sequence
  Synthetic Construct
atgccggggaaagccagaa

SEQ ID NO: 3473 - DNA, 22 bp, Artificial Sequence
  Synthetic Construct
ccatctgtgctggccaatccta

SEQ ID NO: 3474 - DNA, 21 bp, Artificial Sequence
  Synthetic Construct
ttcccaccatccgagactttg

SEQ ID NO: 3475 - DNA, 18 bp, Artificial Sequence
  Synthetic Construct
tgtgccctgggacactga

SEQ ID NO: 3476 - DNA, 21 bp, Artificial Sequence
  Synthetic Construct
gctgggtctggacccttctaa

SEQ ID NO: 3477 - DNA, 24 bp, Artificial Sequence
  Synthetic Construct
ggtgtgctggaccgagattctaac

SEQ ID NO: 3478 - DNA, 20 bp, Artificial Sequence
  Synthetic Construct
tgcacgcactctcccttatg

SEQ ID NO: 3479 - DNA, 22 bp, Artificial Sequence
  Synthetic Construct
ggaatgctgccacttggtgtag

SEQ ID NO: 3480 - DNA, 20 bp, Artificial Sequence
  Synthetic Construct
acacccacccatctctcctt

SEQ ID NO: 3481 - DNA, 19 bp, Artificial Sequence
  Synthetic Construct
tgccccaggccagaagcat

SEQ ID NO: 3482 - DNA, 19 bp, Artificial Sequence
  Synthetic Construct
ccgacggcagaacggaaac

SEQ ID NO: 3483 - DNA, 18 bp, Artificial Sequence
  Synthetic Construct
agggcaccagaggtgaca

SEQ ID NO: 3484 - DNA, 20 bp, Artificial Sequence
  Synthetic Construct
tggcaggtgctgctgtcaga

SEQ ID NO: 3485 - DNA, 20 bp, Artificial Sequence
  Synthetic Construct
tgttccctgcggtaggatgt

SEQ ID NO: 3486 - DNA, 22 bp, Artificial Sequence
  Synthetic Construct
gcccttgtgctttggggttcaa

SEQ ID NO: 3487 - DNA, 23 bp, Artificial Sequence
  Synthetic Construct
tccttactgctcagcatggatct

SEQ ID NO: 3488 - DNA, 26 bp, Artificial Sequence
  Synthetic Construct
ggaaacctcctatagtacggccagaa

SEQ ID NO: 3489 - DNA, 21 bp, Artificial Sequence
  Synthetic Construct
caccagccatggacaacaagt

SEQ ID NO: 3490 - DNA, 22 bp, Artificial Sequence
  Synthetic Construct
gcctcctggtattcctgtgcta

SEQ ID NO: 3491 - DNA, 23 bp, Artificial Sequence
  Synthetic Construct
ccgggaaatcagaggtgggtaac

SEQ ID NO: 3492 - DNA, 22 bp, Artificial Sequence
  Synthetic Construct
gtccatcaggaagcaagcacat

SEQ ID NO: 3493 - DNA, 22 bp, Artificial Sequence
  Synthetic Construct
ccagcaagaggaaactgcgtaa

SEQ ID NO: 3494 - DNA, 25 bp, Artificial Sequence
  Synthetic Construct
gggcagtagaaggtatcagcagtgt

SEQ ID NO: 3495 - DNA, 22 bp, Artificial Sequence
  Synthetic Construct
gtgccttacttcgggagctttc

SEQ ID NO: 3496 - DNA, 18 bp, Artificial Sequence
  Synthetic Construct
tgctgcgggtgaggttca

SEQ ID NO: 3497 - DNA, 21 bp, Artificial Sequence
  Synthetic Construct
cccaatccgagctgcagtcat

SEQ ID NO: 3498 - DNA, 23 bp, Artificial Sequence
  Synthetic Construct
tcctccatctaactcctgctcat

SEQ ID NO: 3499 - DNA, 24 bp, Artificial Sequence
  Synthetic Construct
ctgccttgataactctgggcattg

SEQ ID NO: 3500 - DNA, 19 bp, Artificial Sequence
  Synthetic Construct
ctggggtacccagggatgt

SEQ ID NO: 3501 - DNA, 20 bp, Artificial Sequence
  Synthetic Construct
tgggccagggctgtaatcta

SEQ ID NO: 3502 - DNA, 20 bp, Artificial Sequence
  Synthetic Construct
accggccgaggggtctttga

SEQ ID NO: 3503 - DNA, 21 bp, Artificial Sequence
  Synthetic Construct
tcccttccccacctctctttc

SEQ ID NO: 3504 - DNA, 20 bp, Artificial Sequence
  Synthetic Construct
ccgaaagctctgccaggaaa

SEQ ID NO: 3505 - DNA, 24 bp, Artificial Sequence
  Synthetic Construct
gtgccaatttttgtggggctgata

SEQ ID NO: 3506 - DNA, 21 bp, Artificial Sequence
  Synthetic Construct
cctctccaccaagcacagcat

SEQ ID NO: 3507 - DNA, 22 bp, Artificial Sequence
  Synthetic Construct
ctgccactgtccatccacatct

SEQ ID NO: 3508 - DNA, 20 bp, Artificial Sequence
  Synthetic Construct
tgcaaagtgcatggcacaga

SEQ ID NO: 3509 - DNA, 19 bp, Artificial Sequence
  Synthetic Construct
ggtggcgctgtctctccat

SEQ ID NO: 3510 - DNA, 22 bp, Artificial Sequence
  Synthetic Construct
tcctggcatcaagactgtgaac

SEQ ID NO: 3511 - DNA, 26 bp, Artificial Sequence
  Synthetic Construct
gtctttgtttacctccagggttccta

SEQ ID NO: 3512 - DNA, 24 bp, Artificial Sequence
  Synthetic Construct
ccatctctgcattcccaaatggat

SEQ ID NO: 3513 - DNA, 24 bp, Artificial Sequence
  Synthetic Construct
ccctctgttttcagctccactttc

SEQ ID NO: 3514 - DNA, 23 bp, Artificial Sequence
  Synthetic Construct
cagacttcacccactttgctctt

SEQ ID NO: 3515 - DNA, 20 bp, Artificial Sequence
  Synthetic Construct
tgggctgagcggctttctta

SEQ ID NO: 3516 - DNA, 24 bp, Artificial Sequence
  Synthetic Construct
gggatagcccttgtggctactttc

SEQ ID NO: 3517 - DNA, 27 bp, Artificial Sequence
  Synthetic Construct
tcccattggaaagtatggactacaaag

SEQ ID NO: 3518 - DNA, 24 bp, Artificial Sequence
  Synthetic Construct
gttcaggagtaaggaatggaccaa

SEQ ID NO: 3519 - DNA, 20 bp, Artificial Sequence
  Synthetic Construct
acttggcaggaagggtggat

SEQ ID NO: 3520 - DNA, 18 bp, Artificial Sequence
  Synthetic Construct
tccacccctgccccaaat

SEQ ID NO: 3521 - DNA, 22 bp, Artificial Sequence
  Synthetic Construct
ggcagacgggattcagttgcta

SEQ ID NO: 3522 - DNA, 18 bp, Artificial Sequence
  Synthetic Construct
accatgctggcccacagt

SEQ ID NO: 3523 - DNA, 21 bp, Artificial Sequence
  Synthetic Construct
gggactttcccaggccatgta

SEQ ID NO: 3524 - DNA, 26 bp, Artificial Sequence
  Synthetic Construct
gtcttgtgctgaatgctgaatggttt

SEQ ID NO: 3525 - DNA, 19 bp, Artificial Sequence
  Synthetic Construct
cctggctccatgggtcact

SEQ ID NO: 3526 - DNA, 19 bp, Artificial Sequence
  Synthetic Construct
tctggggtgccaccagcaa

SEQ ID NO: 3527 - DNA, 22 bp, Artificial Sequence
  Synthetic Construct
gcctcttcatacctgcagaact

SEQ ID NO: 3528 - DNA, 22 bp, Artificial Sequence
  Synthetic Construct
gcaggtggagtctgaagtgtca

SEQ ID NO: 3529 - DNA, 26 bp, Artificial Sequence
  Synthetic Construct
gtcctcattatccactccttccctta

SEQ ID NO: 3530 - DNA, 21 bp, Artificial Sequence
  Synthetic Construct
aggctgcagaacagcaaagat

SEQ ID NO: 3531 - DNA, 22 bp, Artificial Sequence
  Synthetic Construct
ctggtgggccttatggacaaga

SEQ ID NO: 3532 - DNA, 24 bp, Artificial Sequence
  Synthetic Construct
ctggggccagagtctgattcttag

SEQ ID NO: 3533 - DNA, 22 bp, Artificial Sequence
  Synthetic Construct
gcactggagatgaggctgcttt

SEQ ID NO: 3534 - DNA, 20 bp, Artificial Sequence
  Synthetic Construct
tttctgccccacctgcacaa

SEQ ID NO: 3535 - DNA, 24 bp, Artificial Sequence
  Synthetic Construct
ccaaaactatctcaggtgcaggaa

SEQ ID NO: 3536 - DNA, 22 bp, Artificial Sequence
  Synthetic Construct
cctctggcaaagcacccattca

SEQ ID NO: 3537 - DNA, 20 bp, Artificial Sequence
  Synthetic Construct
agagccaagaggctgcaaca

SEQ ID NO: 3538 - DNA, 22 bp, Artificial Sequence
  Synthetic Construct
gcagtgagccagtagccttttg

SEQ ID NO: 3539 - DNA, 23 bp, Artificial Sequence
  Synthetic Construct
gctccaaggtactagtgctgcat

SEQ ID NO: 3540 - DNA, 22 bp, Artificial Sequence
  Synthetic Construct
ggccaacctctgtaccttcagt

SEQ ID NO: 3541 - DNA, 23 bp, Artificial Sequence
  Synthetic Construct
cacttctcagtctctcccctttg

SEQ ID NO: 3542 - DNA, 22 bp, Artificial Sequence
  Synthetic Construct
ctcctggtttgcctggtactct

SEQ ID NO: 3543 - DNA, 20 bp, Artificial Sequence
  Synthetic Construct
agggagggaccagtcaactt

SEQ ID NO: 3544 - DNA, 29 bp, Artificial Sequence
  Synthetic Construct
gccctacaggtttacatgcaaagatattc

SEQ ID NO: 3545 - DNA, 21 bp, Artificial Sequence
  Synthetic Construct
gctgtccatgcagagctaagt

SEQ ID NO: 3546 - DNA, 22 bp, Artificial Sequence
  Synthetic Construct
gaatgaactggcaggcatctgt

SEQ ID NO: 3547 - DNA, 22 bp, Artificial Sequence
  Synthetic Construct
ggctaagggaatgccgacataa

SEQ ID NO: 3548 - DNA, 20 bp, Artificial Sequence
  Synthetic Construct
gccagaagggaatcgccaat

SEQ ID NO: 3549 - DNA, 20 bp, Artificial Sequence
  Synthetic Construct
ttccatccccggagcaactt

SEQ ID NO: 3550 - DNA, 21 bp, Artificial Sequence
  Synthetic Construct
ttgaaggaagtggcagccttt

SEQ ID NO: 3551 - DNA, 20 bp, Artificial Sequence
  Synthetic Construct
gccttccctggagctcgtta

SEQ ID NO: 3552 - DNA, 26 bp, Artificial Sequence
  Synthetic Construct
ctgaaatggcagcctttatgttcatc

SEQ ID NO: 3553 - DNA, 20 bp, Artificial Sequence
  Synthetic Construct
ttcctcggagtgctgctttg

SEQ ID NO: 3554 - DNA, 20 bp, Artificial Sequence
  Synthetic Construct
tggagctggcaggagtcagt

SEQ ID NO: 3555 - DNA, 20 bp, Artificial Sequence
  Synthetic Construct
gggctgtgaggtttgtgtca

SEQ ID NO: 3556 - DNA, 22 bp, Artificial Sequence
  Synthetic Construct
gctcagggcttgcacattcctt

SEQ ID NO: 3557 - DNA, 22 bp, Artificial Sequence
  Synthetic Construct
tgccctaacttctcctgcattg

SEQ ID NO: 3558 - DNA, 21 bp, Artificial Sequence
  Synthetic Construct
accaggccttccttctagtca

SEQ ID NO: 3559 - DNA, 20 bp, Artificial Sequence
  Synthetic Construct
gggtgagccgaatgttcact

SEQ ID NO: 3560 - DNA, 22 bp, Artificial Sequence
  Synthetic Construct
cccagccagagaggtatcaact

SEQ ID NO: 3561 - DNA, 23 bp, Artificial Sequence
  Synthetic Construct
gctactttgcagctaccactgaa

SEQ ID NO: 3562 - DNA, 26 bp, Artificial Sequence
  Synthetic Construct
ctgaagtatcatctcttccccggatt

SEQ ID NO: 3563 - DNA, 22 bp, Artificial Sequence
  Synthetic Construct
cagaggggtaggatgcatgaga

SEQ ID NO: 3564 - DNA, 26 bp, Artificial Sequence
  Synthetic Construct
ctgatgctagatcctccttctacttg

SEQ ID NO: 3565 - DNA, 20 bp, Artificial Sequence
  Synthetic Construct
ggcaataggagcctgcagat

SEQ ID NO: 3566 - DNA, 20 bp, Artificial Sequence
  Synthetic Construct
gggctgttgggccaagattt

SEQ ID NO: 3567 - DNA, 27 bp, Artificial Sequence
  Synthetic Construct
cccaactatttttgggttaggaagaac

SEQ ID NO: 3568 - DNA, 22 bp, Artificial Sequence
  Synthetic Construct
gggtgacacctgaggttcttga

SEQ ID NO: 3569 - DNA, 22 bp, Artificial Sequence
  Synthetic Construct
cccaaaatgcctcctgggaaac

SEQ ID NO: 3570 - DNA, 25 bp, Artificial Sequence
  Synthetic Construct
ggaacatctcatggtcacgtatttg

SEQ ID NO: 3571 - DNA, 25 bp, Artificial Sequence
  Synthetic Construct
ggtctagggtctcaatttggtcagt

SEQ ID NO: 3572 - DNA, 24 bp, Artificial Sequence
  Synthetic Construct
ccctttggatgactcttcgcacat

SEQ ID NO: 3573 - DNA, 20 bp, Artificial Sequence
  Synthetic Construct
ccactgccaccactgacaaa

SEQ ID NO: 3574 - DNA, 23 bp, Artificial Sequence
  Synthetic Construct
gagtggtttcccatcagggatga

SEQ ID NO: 3575 - DNA, 21 bp, Artificial Sequence
  Synthetic Construct
ggcaaaactgcaacactgtga

SEQ ID NO: 3576 - DNA, 24 bp, Artificial Sequence
  Synthetic Construct
tgcaggtttctcacataactcctt

SEQ ID NO: 3577 - DNA, 24 bp, Artificial Sequence
  Synthetic Construct
ttctctccagcagcactctttatt

SEQ ID NO: 3578 - DNA, 20 bp, Artificial Sequence
  Synthetic Construct
ctgtggcccatgaagcatct

SEQ ID NO: 3579 - DNA, 21 bp, Artificial Sequence
  Synthetic Construct
tgtctgcttcctagcgtcttc

SEQ ID NO: 3580 - DNA, 27 bp, Artificial Sequence
  Synthetic Construct
cacacatttcaggagcttgatctcatc

SEQ ID NO: 3581 - DNA, 26 bp, Artificial Sequence
  Synthetic Construct
ggaaccatgttcctttccaggttgtt

SEQ ID NO: 3582 - DNA, 23 bp, Artificial Sequence
  Synthetic Construct
tcatcatcccagagacacagcta

SEQ ID NO: 3583 - DNA, 24 bp, Artificial Sequence
  Synthetic Construct
ccttgtgctgctaaccatgagact

SEQ ID NO: 3584 - DNA, 24 bp, Artificial Sequence
  Synthetic Construct
ggaccctagtgattctcccatcat

SEQ ID NO: 3585 - DNA, 22 bp, Artificial Sequence
  Synthetic Construct
cacacttttcggtggtgccttt

SEQ ID NO: 3586 - DNA, 22 bp, Artificial Sequence
  Synthetic Construct
aggagccaagaacaaggagaag

SEQ ID NO: 3587 - DNA, 23 bp, Artificial Sequence
  Synthetic Construct
tggccataacagagtaggtgtga

SEQ ID NO: 3588 - DNA, 20 bp, Artificial Sequence
  Synthetic Construct
tagccccacgtgtcttccta

SEQ ID NO: 3589 - DNA, 24 bp, Artificial Sequence
  Synthetic Construct
acttgttcacttgctaggggatac

SEQ ID NO: 3590 - DNA, 22 bp, Artificial Sequence
  Synthetic Construct
cagagagaaggaggcccaaaga

SEQ ID NO: 3591 - DNA, 22 bp, Artificial Sequence
  Synthetic Construct
tgtcagtaacggtggagaccta

SEQ ID NO: 3592 - DNA, 24 bp, Artificial Sequence
  Synthetic Construct
gccttttaattagccttgcagctt

SEQ ID NO: 3593 - DNA, 20 bp, Artificial Sequence
  Synthetic Construct
agtgggagcctcgtaagcat

SEQ ID NO: 3594 - DNA, 24 bp, Artificial Sequence
  Synthetic Construct
ggaataggtaggtgcaagcagttg

SEQ ID NO: 3595 - DNA, 25 bp, Artificial Sequence
  Synthetic Construct
atccacaatttccctaggctagaag

SEQ ID NO: 3596 - DNA, 25 bp, Artificial Sequence
  Synthetic Construct
gcctagggttctcttccttcccttt

SEQ ID NO: 3597 - DNA, 20 bp, Artificial Sequence
  Synthetic Construct
tggttccccgagctcttttc

SEQ ID NO: 3598 - DNA, 25 bp, Artificial Sequence
  Synthetic Construct
tgggtctagaaggaaactgactttg

SEQ ID NO: 3599 - DNA, 21 bp, Artificial Sequence
  Synthetic Construct
gggctcagggagaaaatcaca

SEQ ID NO: 3600 - DNA, 21 bp, Artificial Sequence
  Synthetic Construct
tgagtcttacggggacgaagt

SEQ ID NO: 3601 - DNA, 21 bp, Artificial Sequence
  Synthetic Construct
gtgtcgtgcctgctaggtatt

SEQ ID NO: 3602 - DNA, 20 bp, Artificial Sequence
  Synthetic Construct
tgtgccaggcccaaaagctt

SEQ ID NO: 3603 - DNA, 19 bp, Artificial Sequence
  Synthetic Construct
tctgcttctgccggcattc

SEQ ID NO: 3604 - DNA, 22 bp, Artificial Sequence
  Synthetic Construct
aggaactgtcagattgcaacca

SEQ ID NO: 3605 - DNA, 21 bp, Artificial Sequence
  Synthetic Construct
ccaccaggtgctctcaactct

SEQ ID NO: 3606 - DNA, 22 bp, Artificial Sequence
  Synthetic Construct
tcccacacacgtgtctgtatct

SEQ ID NO: 3607 - DNA, 24 bp, Artificial Sequence
  Synthetic Construct
agaagggcaaggaaacataacctt

SEQ ID NO: 3608 - DNA, 24 bp, Artificial Sequence
  Synthetic Construct
ccactcctggcccttttctctttt

SEQ ID NO: 3609 - DNA, 19 bp, Artificial Sequence
  Synthetic Construct
aacttggggccaggctcta

SEQ ID NO: 3610 - DNA, 25 bp, Artificial Sequence
  Synthetic Construct
ccacgatgaaaaacagaaaccaaac

SEQ ID NO: 3611 - DNA, 21 bp, Artificial Sequence
  Synthetic Construct
ggttgcaaacccctcctcttt

SEQ ID NO: 3612 - DNA, 22 bp, Artificial Sequence
  Synthetic Construct
gcctttgtgtagacagccactt

SEQ ID NO: 3613 - DNA, 24 bp, Artificial Sequence
  Synthetic Construct
tgtgtgcataaagggtcttgaaga

SEQ ID NO: 3614 - DNA, 20 bp, Artificial Sequence
  Synthetic Construct
acccttccctgccactgttt

SEQ ID NO: 3615 - DNA, 23 bp, Artificial Sequence
  Synthetic Construct
tagccgtagctcagatcctagct

SEQ ID NO: 3616 - DNA, 21 bp, Artificial Sequence
  Synthetic Construct
tcatggtgccctggcctcact

SEQ ID NO: 3617 - DNA, 24 bp, Artificial Sequence
  Synthetic Construct
ctccaagccacagaactcaacatg

SEQ ID NO: 3618 - DNA, 20 bp, Artificial Sequence
  Synthetic Construct
gcctcaccatggctctgatc

SEQ ID NO: 3619 - DNA, 18 bp, Artificial Sequence
  Synthetic Construct
ccaggtccccccaaacac

SEQ ID NO: 3620 - DNA, 23 bp, Artificial Sequence
  Synthetic Construct
tccagtgctcactcactctcctt

SEQ ID NO: 3621 - DNA, 22 bp, Artificial Sequence
  Synthetic Construct
gagtagtgcatgcacacagtga

SEQ ID NO: 3622 - DNA, 20 bp, Artificial Sequence
  Synthetic Construct
tgggcctcattcccaagttc

SEQ ID NO: 3623 - DNA, 26 bp, Artificial Sequence
  Synthetic Construct
ggcttctgcagaataacatcctgatt

SEQ ID NO: 3624 - DNA, 18 bp, Artificial Sequence
  Synthetic Construct
tccagcctcagcctggtt

SEQ ID NO: 3625 - DNA, 21 bp, Artificial Sequence
  Synthetic Construct
tgcatggccagacaatatggt

SEQ ID NO: 3626 - DNA, 24 bp, Artificial Sequence
  Synthetic Construct
gaaagttgtgttcccaaggctttg

SEQ ID NO: 3627 - DNA, 26 bp, Artificial Sequence
  Synthetic Construct
gtatgactccccttaaggatgagaag

SEQ ID NO: 3628 - DNA, 20 bp, Artificial Sequence
  Synthetic Construct
agcagcatgatgccaacgaa

SEQ ID NO: 3629 - DNA, 25 bp, Artificial Sequence
  Synthetic Construct
ggctcatctttgccagttatttcca

SEQ ID NO: 3630 - DNA, 23 bp, Artificial Sequence
  Synthetic Construct
gctgttccatggagcaatcactt

SEQ ID NO: 3631 - DNA, 23 bp, Artificial Sequence
  Synthetic Construct
aaaaatggcccagttttgcagaa

SEQ ID NO: 3632 - DNA, 21 bp, Artificial Sequence
  Synthetic Construct
aacaatccccggcccaatcct

SEQ ID NO: 3633 - DNA, 19 bp, Artificial Sequence
  Synthetic Construct
tgcccaggctttccccaat

SEQ ID NO: 3634 - DNA, 20 bp, Artificial Sequence
  Synthetic Construct
tgctgtctgcctcaggatga

SEQ ID NO: 3635 - DNA, 21 bp, Artificial Sequence
  Synthetic Construct
gtgggacagacagcccttgtt

SEQ ID NO: 3636 - DNA, 25 bp, Artificial Sequence
  Synthetic Construct
gttttcctgttcaggtgacctagtc

SEQ ID NO: 3637 - DNA, 27 bp, Artificial Sequence
  Synthetic Construct
gagagctatacagaattgtggcttttc

SEQ ID NO: 3638 - DNA, 22 bp, Artificial Sequence
  Synthetic Construct
cccgcagtgattccaacataga

SEQ ID NO: 3639 - DNA, 20 bp, Artificial Sequence
  Synthetic Construct
tgcaaactgcgacctgaact

SEQ ID NO: 3640 - DNA, 20 bp, Artificial Sequence
  Synthetic Construct
agctggggctctgaatgtga

SEQ ID NO: 3641 - DNA, 21 bp, Artificial Sequence
  Synthetic Construct
cccaactgtcccctctcacta

SEQ ID NO: 3642 - DNA, 27 bp, Artificial Sequence
  Synthetic Construct
ctggtttgaatgtcttggattgcttag

SEQ ID NO: 3643 - DNA, 24 bp, Artificial Sequence
  Synthetic Construct
tcaacaggctaccattctttggat

SEQ ID NO: 3644 - DNA, 21 bp, Artificial Sequence
  Synthetic Construct
tcccccaaagaggaactgctt

SEQ ID NO: 3645 - DNA, 25 bp, Artificial Sequence
  Synthetic Construct
ggaatcccctcccctgtatttattg

SEQ ID NO: 3646 - DNA, 24 bp, Artificial Sequence
  Synthetic Construct
gaaatgtcctctctggtccaagat

SEQ ID NO: 3647 - DNA, 19 bp, Artificial Sequence
  Synthetic Construct
tgggctactggcactgagt

SEQ ID NO: 3648 - DNA, 22 bp, Artificial Sequence
  Synthetic Construct
cacggttaagttgcacccaaac

SEQ ID NO: 3649 - DNA, 22 bp, Artificial Sequence
  Synthetic Construct
aggaggtggtgagtgcagagaa

SEQ ID NO: 3650 - DNA, 18 bp, Artificial Sequence
  Synthetic Construct
gctgggcgagctctttgg

SEQ ID NO: 3651 - DNA, 22 bp, Artificial Sequence
  Synthetic Construct
agagtgaggagcagagacttca

SEQ ID NO: 3652 - DNA, 21 bp, Artificial Sequence
  Synthetic Construct
taggcagaggcatgcctgaat

SEQ ID NO: 3653 - DNA, 21 bp, Artificial Sequence
  Synthetic Construct
ttgggtgccagtttggaccaa

SEQ ID NO: 3654 - DNA, 20 bp, Artificial Sequence
  Synthetic Construct
ccccagctgtcttcactgtt

SEQ ID NO: 3655 - DNA, 20 bp, Artificial Sequence
  Synthetic Construct
gtgtgctcagtggacaagca

SEQ ID NO: 3656 - DNA, 21 bp, Artificial Sequence
  Synthetic Construct
aggacaggggcagggagtaat

SEQ ID NO: 3657 - DNA, 24 bp, Artificial Sequence
  Synthetic Construct
ggaaccacttatccagaaccagaa

SEQ ID NO: 3658 - DNA, 20 bp, Artificial Sequence
  Synthetic Construct
gaggctgactcctgttgcat

SEQ ID NO: 3659 - DNA, 29 bp, Artificial Sequence
  Synthetic Construct
tggaaagctacattcaattcaaagacaaa

SEQ ID NO: 3660 - DNA, 22 bp, Artificial Sequence
  Synthetic Construct
ctccaaaactgatcccggcaaa

SEQ ID NO: 3661 - DNA, 24 bp, Artificial Sequence
  Synthetic Construct
tgataagggctgtgctcttctaag

SEQ ID NO: 3662 - DNA, 26 bp, Artificial Sequence
  Synthetic Construct
agataccgagtgggtttattcttctc

SEQ ID NO: 3663 - DNA, 25 bp, Artificial Sequence
  Synthetic Construct
tgtttccccatccatcaaccatatc

SEQ ID NO: 3664 - DNA, 19 bp, Artificial Sequence
  Synthetic Construct
tgcccatgcccacatccat

SEQ ID NO: 3665 - DNA, 22 bp, Artificial Sequence
  Synthetic Construct
aggctatgaaccagctctcctt

SEQ ID NO: 3666 - DNA, 24 bp, Artificial Sequence
  Synthetic Construct
ccacacgattcagaaagagcctta

SEQ ID NO: 3667 - DNA, 24 bp, Artificial Sequence
  Synthetic Construct
cacctctacttcttcagggacaag

SEQ ID NO: 3668 - DNA, 22 bp, Artificial Sequence
  Synthetic Construct
gctatgcccacacaagtacaga

SEQ ID NO: 3669 - DNA, 28 bp, Artificial Sequence
  Synthetic Construct
gcatcttcattgatgggaactgtaaacc

SEQ ID NO: 3670 - DNA, 26 bp, Artificial Sequence
  Synthetic Construct
gcccatatctcattgaaaggagaaca

SEQ ID NO: 3671 - DNA, 25 bp, Artificial Sequence
  Synthetic Construct
ccattctaggttaggcttgacgttt

SEQ ID NO: 3672 - DNA, 19 bp, Artificial Sequence
  Synthetic Construct
cttcccccgagaccaacac

SEQ ID NO: 3673 - DNA, 18 bp, Artificial Sequence
  Synthetic Construct
agccaggctgagcaaggt

SEQ ID NO: 3674 - DNA, 23 bp, Artificial Sequence
  Synthetic Construct
tcccaagttaacggcattttcct

SEQ ID NO: 3675 - DNA, 21 bp, Artificial Sequence
  Synthetic Construct
agggcactgtggggatatcca

SEQ ID NO: 3676 - DNA, 30 bp, Artificial Sequence
  Synthetic Construct
agagataacctgtctacagaaaatgcttta

SEQ ID NO: 3677 - DNA, 21 bp, Artificial Sequence
  Synthetic Construct
ttcctaccccaggcagatgca

SEQ ID NO: 3678 - DNA, 20 bp, Artificial Sequence
  Synthetic Construct
gccctatggcggggtgaata

SEQ ID NO: 3679 - DNA, 21 bp, Artificial Sequence
  Synthetic Construct
agctcccaccctaccttagca

SEQ ID NO: 3680 - DNA, 20 bp, Artificial Sequence
  Synthetic Construct
agacacggtgggttctgcat

SEQ ID NO: 3681 - DNA, 24 bp, Artificial Sequence
  Synthetic Construct
tcttatgctactgggcctttcttc

SEQ ID NO: 3682 - DNA, 26 bp, Artificial Sequence
  Synthetic Construct
ggtctgttgggatttcagaagctaaa

SEQ ID NO: 3683 - DNA, 19 bp, Artificial Sequence
  Synthetic Construct
gaggccacactgcagtcaa

SEQ ID NO: 3684 - DNA, 27 bp, Artificial Sequence
  Synthetic Construct
ccccttccattatgggatcataagtag

SEQ ID NO: 3685 - DNA, 24 bp, Artificial Sequence
  Synthetic Construct
aaaggcaggaactagactgaaaca

SEQ ID NO: 3686 - DNA, 21 bp, Artificial Sequence
  Synthetic Construct
tccttgaggctttcccattcc

SEQ ID NO: 3687 - DNA, 21 bp, Artificial Sequence
  Synthetic Construct
gccagaaggtgccagttttgt

SEQ ID NO: 3688 - DNA, 20 bp, Artificial Sequence
  Synthetic Construct
tccagggttccctcttgtga

SEQ ID NO: 3689 - DNA, 20 bp, Artificial Sequence
  Synthetic Construct
tcctgggtgcagggtagact

SEQ ID NO: 3690 - DNA, 20 bp, Artificial Sequence
  Synthetic Construct
tgaaacaacacgccctcagt

SEQ ID NO: 3691 - DNA, 26 bp, Artificial Sequence
  Synthetic Construct
ctgaagcagaagttaactctttgctt

SEQ ID NO: 3692 - DNA, 19 bp, Artificial Sequence
  Synthetic Construct
aggcagtcccgggctgact

SEQ ID NO: 3693 - DNA, 22 bp, Artificial Sequence
  Synthetic Construct
tggtcttagaggcgtccagtct

SEQ ID NO: 3694 - DNA, 23 bp, Artificial Sequence
  Synthetic Construct
aggggtctgtagagtagcgagat

SEQ ID NO: 3695 - DNA, 22 bp, Artificial Sequence
  Synthetic Construct
gagtgttcagcagagcaccatt

SEQ ID NO: 3696 - DNA, 24 bp, Artificial Sequence
  Synthetic Construct
ccaaaaccttcactctctgttgtc

SEQ ID NO: 3697 - DNA, 26 bp, Artificial Sequence
  Synthetic Construct
ggagtaatgcccaactagaggttagg

SEQ ID NO: 3698 - DNA, 20 bp, Artificial Sequence
  Synthetic Construct
aatgggcccttgctctgttt

SEQ ID NO: 3699 - DNA, 21 bp, Artificial Sequence
  Synthetic Construct
aggatgggaaggctgtgagta

SEQ ID NO: 3700 - DNA, 21 bp, Artificial Sequence
  Synthetic Construct
cagcccatccttcctgatgac

SEQ ID NO: 3701 - DNA, 24 bp, Artificial Sequence
  Synthetic Construct
gaggtttcggctttagttgtgtga

SEQ ID NO: 3702 - DNA, 24 bp, Artificial Sequence
  Synthetic Construct
aggagatgaccttcaaggctgtct

SEQ ID NO: 3703 - DNA, 21 bp, Artificial Sequence
  Synthetic Construct
cagtggtgggaaagacagcaa

SEQ ID NO: 3704 - DNA, 24 bp, Artificial Sequence
  Synthetic Construct
cctgttgggcactgcatacttttc

SEQ ID NO: 3705 - DNA, 22 bp, Artificial Sequence
  Synthetic Construct
cctgattcacagaccccaagtt

SEQ ID NO: 3706 - DNA, 24 bp, Artificial Sequence
  Synthetic Construct
agaaggaagtagggggagtgagat

SEQ ID NO: 3707 - DNA, 26 bp, Artificial Sequence
  Synthetic Construct
tctttggcactccttccatcgagatg

SEQ ID NO: 3708 - DNA, 25 bp, Artificial Sequence
  Synthetic Construct
ggacaggaattcatgacttgtggtt

SEQ ID NO: 3709 - DNA, 27 bp, Artificial Sequence
  Synthetic Construct
cataggtaaaagctaggtgtggagaaa

SEQ ID NO: 3710 - DNA, 24 bp, Artificial Sequence
  Synthetic Construct
ggagatttctcaccatgggaatct

SEQ ID NO: 3711 - DNA, 28 bp, Artificial Sequence
  Synthetic Construct
agagatttagtttctcagttcgtaagga

SEQ ID NO: 3712 - DNA, 26 bp, Artificial Sequence
  Synthetic Construct
caacctagcaaggattctactggtaa

SEQ ID NO: 3713 - DNA, 20 bp, Artificial Sequence
  Synthetic Construct
ccttgctgttcctggaagct

SEQ ID NO: 3714 - DNA, 24 bp, Artificial Sequence
  Synthetic Construct
ggagaaatgaggccttggagcttt

SEQ ID NO: 3715 - DNA, 27 bp, Artificial Sequence
  Synthetic Construct
aagcacaatactaaacacagagtcaac

SEQ ID NO: 3716 - DNA, 26 bp, Artificial Sequence
  Synthetic Construct
acaaggtgattggttctaactttggt

SEQ ID NO: 3717 - DNA, 22 bp, Artificial Sequence
  Synthetic Construct
agaccacattgtaggccccata

SEQ ID NO: 3718 - DNA, 23 bp, Artificial Sequence
  Synthetic Construct
tgggtcctgatctccacacttct

SEQ ID NO: 3719 - DNA, 24 bp, Artificial Sequence
  Synthetic Construct
gatccctttggaggcattcaagga

SEQ ID NO: 3720 - DNA, 24 bp, Artificial Sequence
  Synthetic Construct
cagcaatccagactctacctcttc

SEQ ID NO: 3721 - DNA, 26 bp, Artificial Sequence
  Synthetic Construct
gccaacctttccattgtcatggttta

SEQ ID NO: 3722 - DNA, 23 bp, Artificial Sequence
  Synthetic Construct
cacagaactgctcacagatagca

SEQ ID NO: 3723 - DNA, 21 bp, Artificial Sequence
  Synthetic Construct
tctgcaaagtcccaccaaagg

SEQ ID NO: 3724 - DNA, 22 bp, Artificial Sequence
  Synthetic Construct
ccactggggctaattgctacaa

SEQ ID NO: 3725 - DNA, 27 bp, Artificial Sequence
  Synthetic Construct
gaggatacattttggggagataactgt

SEQ ID NO: 3726 - DNA, 23 bp, Artificial Sequence
  Synthetic Construct
tctcagggtgcaacagacatttc

SEQ ID NO: 3727 - DNA, 20 bp, Artificial Sequence
  Synthetic Construct
ggacaggcaagggagttgag

SEQ ID NO: 3728 - DNA, 23 bp, Artificial Sequence
  Synthetic Construct
ctttttccagaccccagattcct

SEQ ID NO: 3729 - DNA, 24 bp, Artificial Sequence
  Synthetic Construct
gaaaaggaagagccattccgtgta

SEQ ID NO: 3730 - DNA, 22 bp, Artificial Sequence
  Synthetic Construct
gcaaccacaaagcagtttgttg

SEQ ID NO: 3731 - DNA, 23 bp, Artificial Sequence
  Synthetic Construct
gcctgtagctagtgtctgtctct

SEQ ID NO: 3732 - DNA, 22 bp, Artificial Sequence
  Synthetic Construct
tctcctgagcgtgaagttggtt

SEQ ID NO: 3733 - DNA, 21 bp, Artificial Sequence
  Synthetic Construct
tggcaccatgtgttcctctct

SEQ ID NO: 3734 - DNA, 22 bp, Artificial Sequence
  Synthetic Construct
gcccctttacacctgatcttga

SEQ ID NO: 3735 - DNA, 28 bp, Artificial Sequence
  Synthetic Construct
gtttcaggcttagtacttaaaacagtca

SEQ ID NO: 3736 - DNA, 26 bp, Artificial Sequence
  Synthetic Construct
tgaaggagtgtggattagtggttaac

SEQ ID NO: 3737 - DNA, 20 bp, Artificial Sequence
  Synthetic Construct
aggtgtgtggtccagattgc

SEQ ID NO: 3738 - DNA, 21 bp, Artificial Sequence
  Synthetic Construct
gccgatgtgttgcctcaagtt

SEQ ID NO: 3739 - DNA, 24 bp, Artificial Sequence
  Synthetic Construct
cacagccttcaagttctgtttcca

SEQ ID NO: 3740 - DNA, 23 bp, Artificial Sequence
  Synthetic Construct
gcaacgggagtaattgcatttgg

SEQ ID NO: 3741 - DNA, 22 bp, Artificial Sequence
  Synthetic Construct
aagaggcagattgctggaagga

SEQ ID NO: 3742 - DNA, 20 bp, Artificial Sequence
  Synthetic Construct
ggaagctgagctgcctctag

SEQ ID NO: 3743 - DNA, 24 bp, Artificial Sequence
  Synthetic Construct
gtattacaacagcgagtggattgc

SEQ ID NO: 3744 - DNA, 23 bp, Artificial Sequence
  Synthetic Construct
gatgtccacctacactggatctc

SEQ ID NO: 3745 - DNA, 24 bp, Artificial Sequence
  Synthetic Construct
acagaagagagacttgggcaatag

SEQ ID NO: 3746 - DNA, 20 bp, Artificial Sequence
  Synthetic Construct
ggagctgcctgatcccagat

SEQ ID NO: 3747 - DNA, 22 bp, Artificial Sequence
  Synthetic Construct
tgatcccagatcaggctcaact

SEQ ID NO: 3748 - DNA, 23 bp, Artificial Sequence
  Synthetic Construct
gtccttgggttcaaatcctagct

SEQ ID NO: 3749 - DNA, 22 bp, Artificial Sequence
  Synthetic Construct
tgaggctccagttgaccttgac

SEQ ID NO: 3750 - DNA, 24 bp, Artificial Sequence
  Synthetic Construct
tcttgcatatacaccactgaagca

SEQ ID NO: 3751 - DNA, 24 bp, Artificial Sequence
  Synthetic Construct
tgtgcaatgaattcagcatgtgat

SEQ ID NO: 3752 - DNA, 20 bp, Artificial Sequence
  Synthetic Construct
tgaagcactcgcagctcact

SEQ ID NO: 3753 - DNA, 23 bp, Artificial Sequence
  Synthetic Construct
agctgaaccttgagaagagcaaa

SEQ ID NO: 3754 - DNA, 21 bp, Artificial Sequence
  Synthetic Construct
aggggtggctctgactaagga

SEQ ID NO: 3755 - DNA, 29 bp, Artificial Sequence
  Synthetic Construct
ccttgaaaataagctgttccaggtaaagg

SEQ ID NO: 3756 - DNA, 24 bp, Artificial Sequence
  Synthetic Construct
ggagtggttactatgcagggtatg

SEQ ID NO: 3757 - DNA, 26 bp, Artificial Sequence
  Synthetic Construct
ggactaggattaaaggagggcctact

SEQ ID NO: 3758 - DNA, 23 bp, Artificial Sequence
  Synthetic Construct
agggttagctaagtaggctgagt

SEQ ID NO: 3759 - DNA, 25 bp, Artificial Sequence
  Synthetic Construct
tggataggtgggcactatagtgtac

SEQ ID NO: 3760 - DNA, 26 bp, Artificial Sequence
  Synthetic Construct
ggagggtgaggacagagtatttatcc

SEQ ID NO: 3761 - DNA, 26 bp, Artificial Sequence
  Synthetic Construct
ccctcctgattctctctctcagatca

SEQ ID NO: 3762 - DNA, 24 bp, Artificial Sequence
  Synthetic Construct
gcttccatgaacacggactgtatg

SEQ ID NO: 3763 - DNA, 24 bp, Artificial Sequence
  Synthetic Construct
gtgggggttaagaggacaaagagt

SEQ ID NO: 3764 - DNA, 27 bp, Artificial Sequence
  Synthetic Construct
ggagagagaatagtgttgcactttgtc

SEQ ID NO: 3765 - DNA, 25 bp, Artificial Sequence
  Synthetic Construct
accccagggaaagtatagacttgag

SEQ ID NO: 3766 - DNA, 24 bp, Artificial Sequence
  Synthetic Construct
gatgaacactacagctgacacact

SEQ ID NO: 3767 - DNA, 22 bp, Artificial Sequence
  Synthetic Construct
aacacaccatgaacccactctt

SEQ ID NO: 3768 - DNA, 26 bp, Artificial Sequence
  Synthetic Construct
gatgctgggaagttgatgaaacatac

SEQ ID NO: 3769 - DNA, 22 bp, Artificial Sequence
  Synthetic Construct
ggttccatcgtctcaactgtgt

SEQ ID NO: 3770 - DNA, 19 bp, Artificial Sequence
  Synthetic Construct
agaaggctgccaggatcca

SEQ ID NO: 3771 - DNA, 24 bp, Artificial Sequence
  Synthetic Construct
tccacagtcgatttgcctatagag

SEQ ID NO: 3772 - DNA, 25 bp, Artificial Sequence
  Synthetic Construct
cgtcttcagagagtttgctttctct

SEQ ID NO: 3773 - DNA, 26 bp, Artificial Sequence
  Synthetic Construct
gctcagaaaaagagaagctgctgtga

SEQ ID NO: 3774 - DNA, 21 bp, Artificial Sequence
  Synthetic Construct
gccttgaacaagtcgctttcc

SEQ ID NO: 3775 - DNA, 23 bp, Artificial Sequence
  Synthetic Construct
ctgtgggttgatgtcttcaaagc

SEQ ID NO: 3776 - DNA, 21 bp, Artificial Sequence
  Synthetic Construct
cccaagccaacatgtcaactg

SEQ ID NO: 3777 - DNA, 25 bp, Artificial Sequence
  Synthetic Construct
ggctccttctcaatacaggtgattc

SEQ ID NO: 3778 - DNA, 21 bp, Artificial Sequence
  Synthetic Construct
agttcagcacctgcagatctg

SEQ ID NO: 3779 - DNA, 18 bp, Artificial Sequence
  Synthetic Construct
cccgcacacacacagact

SEQ ID NO: 3780 - DNA, 24 bp, Artificial Sequence
  Synthetic Construct
tgtgacgctattgttggtgataga

SEQ ID NO: 3781 - DNA, 23 bp, Artificial Sequence
  Synthetic Construct
ctacagccaccttacacctttgt

SEQ ID NO: 3782 - DNA, 24 bp, Artificial Sequence
  Synthetic Construct
ctccagaggaaactgagcttttgg

SEQ ID NO: 3783 - DNA, 25 bp, Artificial Sequence
  Synthetic Construct
gaataaaactgagcaatgccttcca

SEQ ID NO: 3784 - DNA, 26 bp, Artificial Sequence
  Synthetic Construct
ccatacactttgcctatccattgttt

SEQ ID NO: 3785 - DNA, 25 bp, Artificial Sequence
  Synthetic Construct
gggaagttaatctcagccattttgg

SEQ ID NO: 3786 - DNA, 20 bp, Artificial Sequence
  Synthetic Construct
aagcttgcatcccacatcca

SEQ ID NO: 3787 - DNA, 25 bp, Artificial Sequence
  Synthetic Construct
ggaaacgattctaacagagcatctg

SEQ ID NO: 3788 - DNA, 25 bp, Artificial Sequence
  Synthetic Construct
ggtaaggacagggaaaaggattagc

SEQ ID NO: 3789 - DNA, 20 bp, Artificial Sequence
  Synthetic Construct
ccagagccccacagtctaca

SEQ ID NO: 3790 - DNA, 24 bp, Artificial Sequence
  Synthetic Construct
tgagagagaactcttgcctctctt

SEQ ID NO: 3791 - DNA, 21 bp, Artificial Sequence
  Synthetic Construct
atgtctgatgggctgctttgc

SEQ ID NO: 3792 - DNA, 20 bp, Artificial Sequence
  Synthetic Construct
agggttgggcagacagagat

SEQ ID NO: 3793 - DNA, 21 bp, Artificial Sequence
  Synthetic Construct
aggctacagggagggaatgca

SEQ ID NO: 3794 - DNA, 24 bp, Artificial Sequence
  Synthetic Construct
gctctagagacctacaggacacta

SEQ ID NO: 3795 - DNA, 27 bp, Artificial Sequence
  Synthetic Construct
aaatcctcaaaactcattcctggaatg

SEQ ID NO: 3796 - DNA, 20 bp, Artificial Sequence
  Synthetic Construct
cggagtagccctcactctct

SEQ ID NO: 3797 - DNA, 22 bp, Artificial Sequence
  Synthetic Construct
cagagcccgtttttccaacatg

SEQ ID NO: 3798 - DNA, 22 bp, Artificial Sequence
  Synthetic Construct
ctggcagtggagggaaaacaaa

SEQ ID NO: 3799 - DNA, 23 bp, Artificial Sequence
  Synthetic Construct
gggctgtctacatgtagctgaga

SEQ ID NO: 3800 - DNA, 20 bp, Artificial Sequence
  Synthetic Construct
agctgaacctgtggggatgt

SEQ ID NO: 3801 - DNA, 21 bp, Artificial Sequence
  Synthetic Construct
tgggacacacaggaggagaga

SEQ ID NO: 3802 - DNA, 23 bp, Artificial Sequence
  Synthetic Construct
gctcttcatgtggctggattaca

SEQ ID NO: 3803 - DNA, 24 bp, Artificial Sequence
  Synthetic Construct
tgactatggtcaggtcacttgtct

SEQ ID NO: 3804 - DNA, 25 bp, Artificial Sequence
  Synthetic Construct
aagtgtaaagagagctggagttcaa

SEQ ID NO: 3805 - DNA, 26 bp, Artificial Sequence
  Synthetic Construct
gcaaactctcatgcaaccaggaataa

SEQ ID NO: 3806 - DNA, 26 bp, Artificial Sequence
  Synthetic Construct
gtgaaatttaccaccaatgccctgat

SEQ ID NO: 3807 - DNA, 24 bp, Artificial Sequence
  Synthetic Construct
gcgatggggagacaattactcagt

SEQ ID NO: 3808 - DNA, 20 bp, Artificial Sequence
  Synthetic Construct
agggctccaacctcaagcta

SEQ ID NO: 3809 - DNA, 20 bp, Artificial Sequence
  Synthetic Construct
ctgtgtgcatctggctgaca

SEQ ID NO: 3810 - DNA, 19 bp, Artificial Sequence
  Synthetic Construct
agtgccacccagcctagct

SEQ ID NO: 3811 - DNA, 26 bp, Artificial Sequence
  Synthetic Construct
ggcaactctagaatgacaaaggctta

SEQ ID NO: 3812 - DNA, 22 bp, Artificial Sequence
  Synthetic Construct
ctcttcactgggatgcttcctt

SEQ ID NO: 3813 - DNA, 24 bp, Artificial Sequence
  Synthetic Construct
ccccagccgacttacttttgaaga

SEQ ID NO: 3814 - DNA, 22 bp, Artificial Sequence
  Synthetic Construct
gctgactcttagccctgacttc

SEQ ID NO: 3815 - DNA, 24 bp, Artificial Sequence
  Synthetic Construct
ctctgtgctttctcactcatttcc

SEQ ID NO: 3816 - DNA, 20 bp, Artificial Sequence
  Synthetic Construct
ttgggtgccacttgggagaa

SEQ ID NO: 3817 - DNA, 29 bp, Artificial Sequence
  Synthetic Construct
ctccttagagtgctgaaatattcttagca

SEQ ID NO: 3818 - DNA, 22 bp, Artificial Sequence
  Synthetic Construct
gggaggctttttgtggtacaga

SEQ ID NO: 3819 - DNA, 28 bp, Artificial Sequence
  Synthetic Construct
gctagactatctctaagccagtctccta

SEQ ID NO: 3820 - DNA, 20 bp, Artificial Sequence
  Synthetic Construct
gcggcgtggtcaatctctca

SEQ ID NO: 3821 - DNA, 22 bp, Artificial Sequence
  Synthetic Construct
gcaagtaactgaaggcagcaaa

SEQ ID NO: 3822 - DNA, 25 bp, Artificial Sequence
  Synthetic Construct
ggtatgtggggcgatttatctcaag

SEQ ID NO: 3823 - DNA, 19 bp, Artificial Sequence
  Synthetic Construct
tcgctggcttgcctaacac

SEQ ID NO: 3824 - DNA, 24 bp, Artificial Sequence
  Synthetic Construct
gcttggtctcagataggcctgatt

SEQ ID NO: 3825 - DNA, 24 bp, Artificial Sequence
  Synthetic Construct
tcctaatcaccccatggccaaatc

SEQ ID NO: 3826 - DNA, 22 bp, Artificial Sequence
  Synthetic Construct
cgctacctcagtgatgtccatt

SEQ ID NO: 3827 - DNA, 28 bp, Artificial Sequence
  Synthetic Construct
ggcaaacaggttagaatttacacaggaa

SEQ ID NO: 3828 - DNA, 26 bp, Artificial Sequence
  Synthetic Construct
aggggattactgagggtgaggattac

SEQ ID NO: 3829 - DNA, 20 bp, Artificial Sequence
  Synthetic Construct
aatgcccgcctctgaggaat

SEQ ID NO: 3830 - DNA, 24 bp, Artificial Sequence
  Synthetic Construct
tgctgagagaaagctgatttggta

SEQ ID NO: 3831 - DNA, 20 bp, Artificial Sequence
  Synthetic Construct
tgaggccagaagcagtgcta

SEQ ID NO: 3832 - DNA, 26 bp, Artificial Sequence
  Synthetic Construct
aaggctgctattatccaaaagtgttg

SEQ ID NO: 3833 - DNA, 22 bp, Artificial Sequence
  Synthetic Construct
tgcctccttgtggcataccatt

SEQ ID NO: 3834 - DNA, 24 bp, Artificial Sequence
  Synthetic Construct
gttctctccttgaccttccttctg

SEQ ID NO: 3835 - DNA, 21 bp, Artificial Sequence
  Synthetic Construct
gtctgtcaggttggacactgt

SEQ ID NO: 3836 - DNA, 26 bp, Artificial Sequence
  Synthetic Construct
cgtgagcttatgtctctggtgttgag

SEQ ID NO: 3837 - DNA, 27 bp, Artificial Sequence
  Synthetic Construct
ctgatgttgaagctcacattgtttgag

SEQ ID NO: 3838 - DNA, 26 bp, Artificial Sequence
  Synthetic Construct
cagatattctctaatgccccttgagt

SEQ ID NO: 3839 - DNA, 21 bp, Artificial Sequence
  Synthetic Construct
agcacagaggagcaggagtgt

SEQ ID NO: 3840 - DNA, 27 bp, Artificial Sequence
  Synthetic Construct
gctgccaaatgaaaattgaccttcatg

SEQ ID NO: 3841 - DNA, 25 bp, Artificial Sequence
  Synthetic Construct
ccgtgacctaatgctgtatttctga

SEQ ID NO: 3842 - DNA, 22 bp, Artificial Sequence
  Synthetic Construct
gcaagatccactccctctctgt

SEQ ID NO: 3843 - DNA, 24 bp, Artificial Sequence
  Synthetic Construct
ctttaaaccaccagcctgacaaag

SEQ ID NO: 3844 - DNA, 24 bp, Artificial Sequence
  Synthetic Construct
ccgggtatgtcgtgatgaactaag

SEQ ID NO: 3845 - DNA, 26 bp, Artificial Sequence
  Synthetic Construct
gcaccagagacaaatttgcctcaaac

SEQ ID NO: 3846 - DNA, 19 bp, Artificial Sequence
  Synthetic Construct
agccagaccctgagcaagt

SEQ ID NO: 3847 - DNA, 21 bp, Artificial Sequence
  Synthetic Construct
tctgggcatctctgagcatca

SEQ ID NO: 3848 - DNA, 22 bp, Artificial Sequence
  Synthetic Construct
atcttcgtgcctcccaggttga

SEQ ID NO: 3849 - DNA, 27 bp, Artificial Sequence
  Synthetic Construct
cagcagtcccataatattcttggctta

SEQ ID NO: 3850 - DNA, 20 bp, Artificial Sequence
  Synthetic Construct
ctgccccttccgaggctact

SEQ ID NO: 3851 - DNA, 24 bp, Artificial Sequence
  Synthetic Construct
gaaaacatgggacacctgagtcat

SEQ ID NO: 3852 - DNA, 22 bp, Artificial Sequence
  Synthetic Construct
gagaggccatgtacacaaggtt

SEQ ID NO: 3853 - DNA, 24 bp, Artificial Sequence
  Synthetic Construct
ggcattagcagaagagggaacagt

SEQ ID NO: 3854 - DNA, 22 bp, Artificial Sequence
  Synthetic Construct
cttgcaaactgcccttctcagt

SEQ ID NO: 3855 - DNA, 19 bp, Artificial Sequence
  Synthetic Construct
aggggaggggcatcttagc

SEQ ID NO: 3856 - DNA, 24 bp, Artificial Sequence
  Synthetic Construct
gcctccaaaaccatccaaaatcca

SEQ ID NO: 3857 - DNA, 28 bp, Artificial Sequence
  Synthetic Construct
caaggaaagtatgcttgtaattggagtt

SEQ ID NO: 3858 - DNA, 23 bp, Artificial Sequence
  Synthetic Construct
ggtgttccctctctgtctctcta

SEQ ID NO: 3859 - DNA, 21 bp, Artificial Sequence
  Synthetic Construct
gctcatacagctggcaaaagg

SEQ ID NO: 3860 - DNA, 22 bp, Artificial Sequence
  Synthetic Construct
tccttgacaggctcttgctttg

SEQ ID NO: 3861 - DNA, 23 bp, Artificial Sequence
  Synthetic Construct
aaattgctgactcttgggacctt

SEQ ID NO: 3862 - DNA, 20 bp, Artificial Sequence
  Synthetic Construct
ctggagtgtgcctgcgttct

SEQ ID NO: 3863 - DNA, 22 bp, Artificial Sequence
  Synthetic Construct
ctccaaggcctagtttgctgaa

SEQ ID NO: 3864 - DNA, 18 bp, Artificial Sequence
  Synthetic Construct
cgcggctctcagtggaaa

SEQ ID NO: 3865 - DNA, 22 bp, Artificial Sequence
  Synthetic Construct
aaggtactgcctgtgtctacca

SEQ ID NO: 3866 - DNA, 24 bp, Artificial Sequence
  Synthetic Construct
gaatactttgagggctgacgtcaa

SEQ ID NO: 3867 - DNA, 20 bp, Artificial Sequence
  Synthetic Construct
gggttggggaagccctagtc

SEQ ID NO: 3868 - DNA, 26 bp, Artificial Sequence
  Synthetic Construct
tgagactgtcaccaaataagcctatc

SEQ ID NO: 3869 - DNA, 24 bp, Artificial Sequence
  Synthetic Construct
gggatcattgggtggtttctgtca

SEQ ID NO: 3870 - DNA, 23 bp, Artificial Sequence
  Synthetic Construct
accaccccagagattcagttgga

SEQ ID NO: 3871 - DNA, 22 bp, Artificial Sequence
  Synthetic Construct
gtgcccaagtggagtcatgttt

SEQ ID NO: 3872 - DNA, 23 bp, Artificial Sequence
  Synthetic Construct
ggagcgtaagagcctaactttgg

SEQ ID NO: 3873 - DNA, 27 bp, Artificial Sequence
  Synthetic Construct
ggttattgaagtccttgtcatggatga

SEQ ID NO: 3874 - DNA, 30 bp, Artificial Sequence
  Synthetic Construct
cctctttactaggatatctcccaggaatgt

SEQ ID NO: 3875 - DNA, 27 bp, Artificial Sequence
  Synthetic Construct
gcttagaatgagcatagtctacatgca

SEQ ID NO: 3876 - DNA, 24 bp, Artificial Sequence
  Synthetic Construct
cacccacctgttttggagatgttc

SEQ ID NO: 3877 - DNA, 18 bp, Artificial Sequence
  Synthetic Construct
gggcaggggtgcaaagca

SEQ ID NO: 3878 - DNA, 23 bp, Artificial Sequence
  Synthetic Construct
gcatctgcaactgtgtgatcttg

SEQ ID NO: 3879 - DNA, 21 bp, Artificial Sequence
  Synthetic Construct
aggcagaacccaaggatcctt

SEQ ID NO: 3880 - DNA, 20 bp, Artificial Sequence
  Synthetic Construct
agggaggatggcctgacatc

SEQ ID NO: 3881 - DNA, 25 bp, Artificial Sequence
  Synthetic Construct
cacttcccaaaaaggttccattgat

SEQ ID NO: 3882 - DNA, 24 bp, Artificial Sequence
  Synthetic Construct
ttcatcccttctgctttgtgaaga

SEQ ID NO: 3883 - DNA, 23 bp, Artificial Sequence
  Synthetic Construct
gatggtctctagggggctctatt

SEQ ID NO: 3884 - DNA, 25 bp, Artificial Sequence
  Synthetic Construct
ccactgaggctattcccctacaatt

SEQ ID NO: 3885 - DNA, 21 bp, Artificial Sequence
  Synthetic Construct
tgagtgggtggagagcttcct

SEQ ID NO: 3886 - DNA, 25 bp, Artificial Sequence
  Synthetic Construct
gagtcctctttttctctgcaatcct

SEQ ID NO: 3887 - DNA, 23 bp, Artificial Sequence
  Synthetic Construct
ctccgttcctcagtttaccacaa

SEQ ID NO: 3888 - DNA, 21 bp, Artificial Sequence
  Synthetic Construct
cctgaacagccacatgatgca

SEQ ID NO: 3889 - DNA, 22 bp, Artificial Sequence
  Synthetic Construct
agaccttagactggctggaagt

SEQ ID NO: 3890 - DNA, 24 bp, Artificial Sequence
  Synthetic Construct
ggggaagtatcactgatgcaagca

SEQ ID NO: 3891 - DNA, 23 bp, Artificial Sequence
  Synthetic Construct
gattggttgccaaagaggtcatc

SEQ ID NO: 3892 - DNA, 22 bp, Artificial Sequence
  Synthetic Construct
ccctgtgtcttcctctctccta

SEQ ID NO: 3893 - DNA, 23 bp, Artificial Sequence
  Synthetic Construct
caatttccctgtgtctggtgaca

SEQ ID NO: 3894 - DNA, 20 bp, Artificial Sequence
  Synthetic Construct
agccaggaacagagccaaga

SEQ ID NO: 3895 - DNA, 22 bp, Artificial Sequence
  Synthetic Construct
tggtccactgactggcatttgg

SEQ ID NO: 3896 - DNA, 25 bp, Artificial Sequence
  Synthetic Construct
tgccttcctaattaaccatcacact

SEQ ID NO: 3897 - DNA, 24 bp, Artificial Sequence
  Synthetic Construct
actccccaagacctttcagagatg

SEQ ID NO: 3898 - DNA, 19 bp, Artificial Sequence
  Synthetic Construct
gtgctgagcctgagatgct

SEQ ID NO: 3899 - DNA, 24 bp, Artificial Sequence
  Synthetic Construct
ctctgtttcaccttaggtcagtga

SEQ ID NO: 3900 - DNA, 22 bp, Artificial Sequence
  Synthetic Construct
ttcatgcatgaggctggatgaa

SEQ ID NO: 3901 - DNA, 19 bp, Artificial Sequence
  Synthetic Construct
agcacttccccagctgtga

SEQ ID NO: 3902 - DNA, 22 bp, Artificial Sequence
  Synthetic Construct
tttggcaggggaatggaaagat

SEQ ID NO: 3903 - DNA, 25 bp, Artificial Sequence
  Synthetic Construct
ggcacaattagagcagctactgtct

SEQ ID NO: 3904 - DNA, 25 bp, Artificial Sequence
  Synthetic Construct
tggcccatctatatctcagtgtgta

SEQ ID NO: 3905 - DNA, 23 bp, Artificial Sequence
  Synthetic Construct
gctgctttatgccaagagtgtac

SEQ ID NO: 3906 - DNA, 23 bp, Artificial Sequence
  Synthetic Construct
aggtggttcggtcagtccttaga

SEQ ID NO: 3907 - DNA, 19 bp, Artificial Sequence
  Synthetic Construct
tgctgctcttggcttggtt

SEQ ID NO: 3908 - DNA, 21 bp, Artificial Sequence
  Synthetic Construct
tcagcctgaacccaagtccaa

SEQ ID NO: 3909 - DNA, 22 bp, Artificial Sequence
  Synthetic Construct
aggtgacgcaaggtaacagttg

SEQ ID NO: 3910 - DNA, 28 bp, Artificial Sequence
  Synthetic Construct
ccccacaaatcattaagaggtctttacg

SEQ ID NO: 3911 - DNA, 24 bp, Artificial Sequence
  Synthetic Construct
gcacagtaatgtcaggagagtttg

SEQ ID NO: 3912 - DNA, 25 bp, Artificial Sequence
  Synthetic Construct
ggagacagttcttccttcaagatca

SEQ ID NO: 3913 - DNA, 26 bp, Artificial Sequence
  Synthetic Construct
tgtttccatgtcagttgatagaacct

SEQ ID NO: 3914 - DNA, 24 bp, Artificial Sequence
  Synthetic Construct
cagggacagtctgaagaactgatg

SEQ ID NO: 3915 - DNA, 25 bp, Artificial Sequence
  Synthetic Construct
aacagacatgtacattccccagaaa

SEQ ID NO: 3916 - DNA, 19 bp, Artificial Sequence
  Synthetic Construct
tgccctctgctgacacaga

SEQ ID NO: 3917 - DNA, 20 bp, Artificial Sequence
  Synthetic Construct
cctgcctctcagcctgaagt

SEQ ID NO: 3918 - DNA, 22 bp, Artificial Sequence
  Synthetic Construct
cacaggcagaagagcatctttg

SEQ ID NO: 3919 - DNA, 24 bp, Artificial Sequence
  Synthetic Construct
actgtaggtggtttgtaggagttg

SEQ ID NO: 3920 - DNA, 25 bp, Artificial Sequence
  Synthetic Construct
cctgtaccccagcctatttaattct

SEQ ID NO: 3921 - DNA, 27 bp, Artificial Sequence
  Synthetic Construct
cacactgtattagaatcagtgctgttt

SEQ ID NO: 3922 - DNA, 26 bp, Artificial Sequence
  Synthetic Construct
gccttcaatgacctttgacagctttc

SEQ ID NO: 3923 - DNA, 25 bp, Artificial Sequence
  Synthetic Construct
gtccaccctcacatggtttctattc

SEQ ID NO: 3924 - DNA, 20 bp, Artificial Sequence
  Synthetic Construct
tgctgcttggacaggtacct

SEQ ID NO: 3925 - DNA, 19 bp, Artificial Sequence
  Synthetic Construct
gggtggggaagcctctaca

SEQ ID NO: 3926 - DNA, 22 bp, Artificial Sequence
  Synthetic Construct
cctgagtgtccaagatgggttt

SEQ ID NO: 3927 - DNA, 21 bp, Artificial Sequence
  Synthetic Construct
ctatgcaccagcctccttctc

SEQ ID NO: 3928 - DNA, 19 bp, Artificial Sequence
  Synthetic Construct
ccctcgcgtgctgataagg

SEQ ID NO: 3929 - DNA, 23 bp, Artificial Sequence
  Synthetic Construct
gaccttttgccacttgagacgat

SEQ ID NO: 3930 - DNA, 23 bp, Artificial Sequence
  Synthetic Construct
caaacataagcatgagcgaaggt

SEQ ID NO: 3931 - DNA, 21 bp, Artificial Sequence
  Synthetic Construct
ttgtgaggccactgtgtctca

SEQ ID NO: 3932 - DNA, 22 bp, Artificial Sequence
  Synthetic Construct
tgctagaccctcagttctccat

SEQ ID NO: 3933 - DNA, 27 bp, Artificial Sequence
  Synthetic Construct
tgattatgacttgctttggtcaaaagg

SEQ ID NO: 3934 - DNA, 22 bp, Artificial Sequence
  Synthetic Construct
acagcacagcttttgagggaaa

SEQ ID NO: 3935 - DNA, 27 bp, Artificial Sequence
  Synthetic Construct
atcaatacatggtggttttgtttcctt

SEQ ID NO: 3936 - DNA, 24 bp, Artificial Sequence
  Synthetic Construct
gctctaaagcccactaccatgcaa

SEQ ID NO: 3937 - DNA, 25 bp, Artificial Sequence
  Synthetic Construct
cccgctaatgtgagtgcaggataaa

SEQ ID NO: 3938 - DNA, 27 bp, Artificial Sequence
  Synthetic Construct
ggaaagcaaaagatggaagagggaaaa

SEQ ID NO: 3939 - DNA, 24 bp, Artificial Sequence
  Synthetic Construct
ctgctgataacttttggtcaacgt

SEQ ID NO: 3940 - DNA, 23 bp, Artificial Sequence
  Synthetic Construct
cctcctgcaatagaaggcaaact

SEQ ID NO: 3941 - DNA, 22 bp, Artificial Sequence
  Synthetic Construct
ccagacaaaggtcagccctaat

SEQ ID NO: 3942 - DNA, 20 bp, Artificial Sequence
  Synthetic Construct
tccacgtctgtgtgctgatc

SEQ ID NO: 3943 - DNA, 19 bp, Artificial Sequence
  Synthetic Construct
tgctgggacccatgaacca

SEQ ID NO: 3944 - DNA, 21 bp, Artificial Sequence
  Synthetic Construct
ttagccaggcctcctcttctc

SEQ ID NO: 3945 - DNA, 27 bp, Artificial Sequence
  Synthetic Construct
tgtctcactggcaattaaactctaact

SEQ ID NO: 3946 - DNA, 19 bp, Artificial Sequence
  Synthetic Construct
accatggccaagcctgtca

SEQ ID NO: 3947 - DNA, 24 bp, Artificial Sequence
  Synthetic Construct
tgctgaagagtacccccagttttg

SEQ ID NO: 3948 - DNA, 20 bp, Artificial Sequence
  Synthetic Construct
cagctcacaggaagcagtca

SEQ ID NO: 3949 - DNA, 26 bp, Artificial Sequence
  Synthetic Construct
gtgaatttcttgtaggcagcagatag

SEQ ID NO: 3950 - DNA, 22 bp, Artificial Sequence
  Synthetic Construct
gctaaggcagccagtcctggaa

SEQ ID NO: 3951 - DNA, 28 bp, Artificial Sequence
  Synthetic Construct
gcttttgttttcaagtggcagaaaacac

SEQ ID NO: 3952 - DNA, 23 bp, Artificial Sequence
  Synthetic Construct
tcatggaatggtatccacaagca

SEQ ID NO: 3953 - DNA, 25 bp, Artificial Sequence
  Synthetic Construct
ggaaccagctgcagtagatctatag

SEQ ID NO: 3954 - DNA, 20 bp, Artificial Sequence
  Synthetic Construct
gattggtgcccaggaaacct

SEQ ID NO: 3955 - DNA, 24 bp, Artificial Sequence
  Synthetic Construct
gccctctttgccatctctacactt

SEQ ID NO: 3956 - DNA, 20 bp, Artificial Sequence
  Synthetic Construct
actccagccaggcaattcct

SEQ ID NO: 3957 - DNA, 22 bp, Artificial Sequence
  Synthetic Construct
ccatgcagcaacatctgtagtg

SEQ ID NO: 3958 - DNA, 22 bp, Artificial Sequence
  Synthetic Construct
caacttcaagtccctggagcaa

SEQ ID NO: 3959 - DNA, 21 bp, Artificial Sequence
  Synthetic Construct
ccagctgtgttctccagacaa

SEQ ID NO: 3960 - DNA, 19 bp, Artificial Sequence
  Synthetic Construct
gggctggagctcaggatca

SEQ ID NO: 3961 - DNA, 19 bp, Artificial Sequence
  Synthetic Construct
tccacctgcccctcagcaa

SEQ ID NO: 3962 - DNA, 27 bp, Artificial Sequence
  Synthetic Construct
gcagggaaagggtacacagttgtatag

SEQ ID NO: 3963 - DNA, 26 bp, Artificial Sequence
  Synthetic Construct
tttggttcaccttcatatcagtttcg

SEQ ID NO: 3964 - DNA, 22 bp, Artificial Sequence
  Synthetic Construct
tccaaaaccagctcctcctgaa

SEQ ID NO: 3965 - DNA, 24 bp, Artificial Sequence
  Synthetic Construct
gcactcccagaggtatgaacagat

SEQ ID NO: 3966 - DNA, 24 bp, Artificial Sequence
  Synthetic Construct
tgctctgagctacccatctccatt

SEQ ID NO: 3967 - DNA, 25 bp, Artificial Sequence
  Synthetic Construct
ggacaggacagtgatgattgctaga

SEQ ID NO: 3968 - DNA, 22 bp, Artificial Sequence
  Synthetic Construct
agggtgtggaggtatcgaagct

SEQ ID NO: 3969 - DNA, 24 bp, Artificial Sequence
  Synthetic Construct
cagagccctaggaacactatgtct

SEQ ID NO: 3970 - DNA, 24 bp, Artificial Sequence
  Synthetic Construct
gattagcatgagtgggaactgagt

SEQ ID NO: 3971 - DNA, 20 bp, Artificial Sequence
  Synthetic Construct
acccaagatggctgccaaca

SEQ ID NO: 3972 - DNA, 22 bp, Artificial Sequence
  Synthetic Construct
gctgacatgttgcccaagacta

SEQ ID NO: 3973 - DNA, 23 bp, Artificial Sequence
  Synthetic Construct
ccctagccttctgcatcataagg

SEQ ID NO: 3974 - DNA, 24 bp, Artificial Sequence
  Synthetic Construct
cctctctggtttggtgaagttacg

SEQ ID NO: 3975 - DNA, 23 bp, Artificial Sequence
  Synthetic Construct
gtagtgcctcccaaaatgtgact

SEQ ID NO: 3976 - DNA, 23 bp, Artificial Sequence
  Synthetic Construct
gacttgccccaaatctctgatca

SEQ ID NO: 3977 - DNA, 20 bp, Artificial Sequence
  Synthetic Construct
tcatggcttgcccttcaaca

SEQ ID NO: 3978 - DNA, 23 bp, Artificial Sequence
  Synthetic Construct
gtttcctgctagcactactctgt

SEQ ID NO: 3979 - DNA, 22 bp, Artificial Sequence
  Synthetic Construct
ggtcacagctgattggaccaaa

SEQ ID NO: 3980 - DNA, 23 bp, Artificial Sequence
  Synthetic Construct
gagaggagaagtctctggaaggt

SEQ ID NO: 3981 - DNA, 25 bp, Artificial Sequence
  Synthetic Construct
cccattttgcagtgaccttttactg

SEQ ID NO: 3982 - DNA, 26 bp, Artificial Sequence
  Synthetic Construct
ttattctgcccaccgagaatattaca

SEQ ID NO: 3983 - DNA, 21 bp, Artificial Sequence
  Synthetic Construct
aaaccttgccttcacctggaa

SEQ ID NO: 3984 - DNA, 24 bp, Artificial Sequence
  Synthetic Construct
tgctgagggatatttggggagagt

SEQ ID NO: 3985 - DNA, 22 bp, Artificial Sequence
  Synthetic Construct
ccttgaatctggctgacttggt

SEQ ID NO: 3986 - DNA, 22 bp, Artificial Sequence
  Synthetic Construct
tcttccaccccatatcccatca

SEQ ID NO: 3987 - DNA, 24 bp, Artificial Sequence
  Synthetic Construct
gcttcctaggaggtagtgaatgtc

SEQ ID NO: 3988 - DNA, 24 bp, Artificial Sequence
  Synthetic Construct
ccaccaattcaggaagctctccat

SEQ ID NO: 3989 - DNA, 24 bp, Artificial Sequence
  Synthetic Construct
ggatgaaggcagatccctgaaaca

SEQ ID NO: 3990 - DNA, 22 bp, Artificial Sequence
  Synthetic Construct
tgagatctgggatgcgtgcttt

SEQ ID NO: 3991 - DNA, 24 bp, Artificial Sequence
  Synthetic Construct
tggtgcaagagagggttacttcac

SEQ ID NO: 3992 - DNA, 21 bp, Artificial Sequence
  Synthetic Construct
agagtggagaagcaggacaga

SEQ ID NO: 3993 - DNA, 22 bp, Artificial Sequence
  Synthetic Construct
gagactcaatcctggcacttgt

SEQ ID NO: 3994 - DNA, 27 bp, Artificial Sequence
  Synthetic Construct
gacattggatagttcagagcaaatcca

SEQ ID NO: 3995 - DNA, 23 bp, Artificial Sequence
  Synthetic Construct
tgaatgttccaggcagaaggaat

SEQ ID NO: 3996 - DNA, 25 bp, Artificial Sequence
  Synthetic Construct
ggctttgaacaggaacacactatcc

SEQ ID NO: 3997 - DNA, 18 bp, Artificial Sequence
  Synthetic Construct
agctgctcctgggttcca

SEQ ID NO: 3998 - DNA, 26 bp, Artificial Sequence
  Synthetic Construct
tgctaatctaaacatggacctgagtt

SEQ ID NO: 3999 - DNA, 24 bp, Artificial Sequence
  Synthetic Construct
cctgattctgagccactgttccat

SEQ ID NO: 4000 - DNA, 26 bp, Artificial Sequence
  Synthetic Construct
cttatattgctgccatctggattcag

SEQ ID NO: 4001 - DNA, 20 bp, Artificial Sequence
  Synthetic Construct
accatagggcctctgttggt

SEQ ID NO: 4002 - DNA, 28 bp, Artificial Sequence
  Synthetic Construct
ttcatgtgtgtctttagtttcaaacact

SEQ ID NO: 4003 - DNA, 24 bp, Artificial Sequence
  Synthetic Construct
ggaagttctactcaaggcagagaa

SEQ ID NO: 4004 - DNA, 23 bp, Artificial Sequence
  Synthetic Construct
ctctctgaatgctccctcacatt

SEQ ID NO: 4005 - DNA, 27 bp, Artificial Sequence
  Synthetic Construct
agaaaagttttgttaccacttgcaatg

SEQ ID NO: 4006 - DNA, 21 bp, Artificial Sequence
  Synthetic Construct
ccaccactgccctgatatgac

SEQ ID NO: 4007 - DNA, 22 bp, Artificial Sequence
  Synthetic Construct
gctgagggtttgaatggggaaa

SEQ ID NO: 4008 - DNA, 27 bp, Artificial Sequence
  Synthetic Construct
gtagatgactgggttggttatgaaaac

SEQ ID NO: 4009 - DNA, 20 bp, Artificial Sequence
  Synthetic Construct
ccacagccagcagaaccata

SEQ ID NO: 4010 - DNA, 25 bp, Artificial Sequence
  Synthetic Construct
gactatgctcctcttcacaatttgg

SEQ ID NO: 4011 - DNA, 20 bp, Artificial Sequence
  Synthetic Construct
cacctcacaggatgcaccat

SEQ ID NO: 4012 - DNA, 22 bp, Artificial Sequence
  Synthetic Construct
acccagcccgaattctttgctt

SEQ ID NO: 4013 - DNA, 24 bp, Artificial Sequence
  Synthetic Construct
acagatagcgcttgtaaagttcca

SEQ ID NO: 4014 - DNA, 21 bp, Artificial Sequence
  Synthetic Construct
cgcaaagggcacttgttggat

SEQ ID NO: 4015 - DNA, 27 bp, Artificial Sequence
  Synthetic Construct
ctgctgaatttttaaggagaggaaggt

SEQ ID NO: 4016 - DNA, 22 bp, Artificial Sequence
  Synthetic Construct
ccagggtcacaaaaagcagaca

SEQ ID NO: 4017 - DNA, 25 bp, Artificial Sequence
  Synthetic Construct
ggcagatcaaaggaaccaggttttg

SEQ ID NO: 4018 - DNA, 25 bp, Artificial Sequence
  Synthetic Construct
gggatgacagtcaggaagtttttgg

SEQ ID NO: 4019 - DNA, 22 bp, Artificial Sequence
  Synthetic Construct
gcagttgggcagcagatattgt

SEQ ID NO: 4020 - DNA, 18 bp, Artificial Sequence
  Synthetic Construct
tgcccagccccacactgt

SEQ ID NO: 4021 - DNA, 19 bp, Artificial Sequence
  Synthetic Construct
agtaggggaggggcacatg

SEQ ID NO: 4022 - DNA, 24 bp, Artificial Sequence
  Synthetic Construct
gcttttaccaaagaacggctgttg

SEQ ID NO: 4023 - DNA, 20 bp, Artificial Sequence
  Synthetic Construct
atgggctctttgtgccacaa

SEQ ID NO: 4024 - DNA, 22 bp, Artificial Sequence
  Synthetic Construct
cctttatcccccatggcaagtt

SEQ ID NO: 4025 - DNA, 21 bp, Artificial Sequence
  Synthetic Construct
atcagcattggccagttctgt

SEQ ID NO: 4026 - DNA, 22 bp, Artificial Sequence
  Synthetic Construct
tgggccccactggatgtaaagt

SEQ ID NO: 4027 - DNA, 22 bp, Artificial Sequence
  Synthetic Construct
actcacaagggtgcaaggaatg

SEQ ID NO: 4028 - DNA, 23 bp, Artificial Sequence
  Synthetic Construct
agagcttcagaccctactgactt

SEQ ID NO: 4029 - DNA, 24 bp, Artificial Sequence
  Synthetic Construct
caagtgcaaaacatcatggttgga

SEQ ID NO: 4030 - DNA, 21 bp, Artificial Sequence
  Synthetic Construct
acggtggtcatgtctctacca

SEQ ID NO: 4031 - DNA, 22 bp, Artificial Sequence
  Synthetic Construct
tggccacacaacaggctcattt

SEQ ID NO: 4032 - DNA, 21 bp, Artificial Sequence
  Synthetic Construct
gccagttagtcacctgtgtga

SEQ ID NO: 4033 - DNA, 19 bp, Artificial Sequence
  Synthetic Construct
cacacccaggggcatgctt

SEQ ID NO: 4034 - DNA, 22 bp, Artificial Sequence
  Synthetic Construct
gcgctttctccacactctgttt

SEQ ID NO: 4035 - DNA, 22 bp, Artificial Sequence
  Synthetic Construct
tcctgcagtgaggcaaaacttc

SEQ ID NO: 4036 - DNA, 28 bp, Artificial Sequence
  Synthetic Construct
gagatcttaaggtgtcattgttcatagc

SEQ ID NO: 4037 - DNA, 25 bp, Artificial Sequence
  Synthetic Construct
cagaaggggtagaaaacagcctttc

SEQ ID NO: 4038 - DNA, 27 bp, Artificial Sequence
  Synthetic Construct
cctgagacacacttagtcactcctact

SEQ ID NO: 4039 - DNA, 21 bp, Artificial Sequence
  Synthetic Construct
tcaactgcagacccagaaacc

SEQ ID NO: 4040 - DNA, 22 bp, Artificial Sequence
  Synthetic Construct
tcttcagcaggtgtcaccagat

SEQ ID NO: 4041 - DNA, 22 bp, Artificial Sequence
  Synthetic Construct
atggctacagaccaggaaaagg

SEQ ID NO: 4042 - DNA, 22 bp, Artificial Sequence
  Synthetic Construct
tcaggtacagctcaacccatca

SEQ ID NO: 4043 - DNA, 21 bp, Artificial Sequence
  Synthetic Construct
ggggctgccaaaagtaaaacc

SEQ ID NO: 4044 - DNA, 27 bp, Artificial Sequence
  Synthetic Construct
cctgccaactgttctttgatcctctag

SEQ ID NO: 4045 - DNA, 21 bp, Artificial Sequence
  Synthetic Construct
agcagcaagcagcctattctg

SEQ ID NO: 4046 - DNA, 24 bp, Artificial Sequence
  Synthetic Construct
agcagggatcacagcattatactc

SEQ ID NO: 4047 - DNA, 19 bp, Artificial Sequence
  Synthetic Construct
aggcccacacaccccatga

SEQ ID NO: 4048 - DNA, 24 bp, Artificial Sequence
  Synthetic Construct
tcactggcttcttccctgagtaag

SEQ ID NO: 4049 - DNA, 21 bp, Artificial Sequence
  Synthetic Construct
gttgtttctgtgccccttcca

SEQ ID NO: 4050 - DNA, 22 bp, Artificial Sequence
  Synthetic Construct
tgttgtggagtgagtgcaagtt

SEQ ID NO: 4051 - DNA, 23 bp, Artificial Sequence
  Synthetic Construct
aacactggtctctggtagaagga

SEQ ID NO: 4052 - DNA, 22 bp, Artificial Sequence
  Synthetic Construct
tgacccctctggctatcacatt

SEQ ID NO: 4053 - DNA, 21 bp, Artificial Sequence
  Synthetic Construct
cactgggaggggtaacaagga

SEQ ID NO: 4054 - DNA, 22 bp, Artificial Sequence
  Synthetic Construct
acaactctgaagtgagcgttgt

SEQ ID NO: 4055 - DNA, 22 bp, Artificial Sequence
  Synthetic Construct
gcctgacatacatcctgggaaa

SEQ ID NO: 4056 - DNA, 20 bp, Artificial Sequence
  Synthetic Construct
ccctgcctccccaacagtga

SEQ ID NO: 4057 - DNA, 23 bp, Artificial Sequence
  Synthetic Construct
aggctacactcgagggatcttct

SEQ ID NO: 4058 - DNA, 25 bp, Artificial Sequence
  Synthetic Construct
tcattcatagcagtgcaagaatgga

SEQ ID NO: 4059 - DNA, 22 bp, Artificial Sequence
  Synthetic Construct
accttgcctggtatgggttgaa

SEQ ID NO: 4060 - DNA, 24 bp, Artificial Sequence
  Synthetic Construct
aataaaagtcctctgccgaagaca

SEQ ID NO: 4061 - DNA, 24 bp, Artificial Sequence
  Synthetic Construct
cctcttccctttcctactgtcaca

SEQ ID NO: 4062 - DNA, 24 bp, Artificial Sequence
  Synthetic Construct
atgaatcctgccatgtaggtgtag

SEQ ID NO: 4063 - DNA, 25 bp, Artificial Sequence
  Synthetic Construct
catgtatagcccttcctcctttctt

SEQ ID NO: 4064 - DNA, 23 bp, Artificial Sequence
  Synthetic Construct
cagcatgggaatttgggtagaca

SEQ ID NO: 4065 - DNA, 24 bp, Artificial Sequence
  Synthetic Construct
ggtctcagactaggcagaatttgg

SEQ ID NO: 4066 - DNA, 27 bp, Artificial Sequence
  Synthetic Construct
tgtggactttatttgaatggagactga

SEQ ID NO: 4067 - DNA, 20 bp, Artificial Sequence
  Synthetic Construct
tctgcaggccatctctgcat

SEQ ID NO: 4068 - DNA, 24 bp, Artificial Sequence
  Synthetic Construct
accagagccctccattcctaaact

SEQ ID NO: 4069 - DNA, 18 bp, Artificial Sequence
  Synthetic Construct
ccaggaggcgggaatcac

SEQ ID NO: 4070 - DNA, 29 bp, Artificial Sequence
  Synthetic Construct
ctgatcaaatttagtctggatgtgaccaa

SEQ ID NO: 4071 - DNA, 20 bp, Artificial Sequence
  Synthetic Construct
taggtgccatggcccagaca

SEQ ID NO: 4072 - DNA, 20 bp, Artificial Sequence
  Synthetic Construct
gcagaggctctgtgctatgt

SEQ ID NO: 4073 - DNA, 23 bp, Artificial Sequence
  Synthetic Construct
tgggggaatgaatggaagatgag

SEQ ID NO: 4074 - DNA, 24 bp, Artificial Sequence
  Synthetic Construct
gactaccctttgcaattggaagca

SEQ ID NO: 4075 - DNA, 22 bp, Artificial Sequence
  Synthetic Construct
caacagacctggctaggagcta

SEQ ID NO: 4076 - DNA, 18 bp, Artificial Sequence
  Synthetic Construct
agccctgtggtgccaaac

SEQ ID NO: 4077 - DNA, 25 bp, Artificial Sequence
  Synthetic Construct
ctgcatgaagtattctgcactactg

SEQ ID NO: 4078 - DNA, 24 bp, Artificial Sequence
  Synthetic Construct
caaactccctttggctagagagaa

SEQ ID NO: 4079 - DNA, 22 bp, Artificial Sequence
  Synthetic Construct
cactgggttagatcgccagttt

SEQ ID NO: 4080 - DNA, 22 bp, Artificial Sequence
  Synthetic Construct
tcctggtgatgtgggggaatat

SEQ ID NO: 4081 - DNA, 24 bp, Artificial Sequence
  Synthetic Construct
gctaggattcctgggtgttctgtt

SEQ ID NO: 4082 - DNA, 22 bp, Artificial Sequence
  Synthetic Construct
tctgggagccgaaattccttct

SEQ ID NO: 4083 - DNA, 24 bp, Artificial Sequence
  Synthetic Construct
gaacttaccaaggtagccagatgt

SEQ ID NO: 4084 - DNA, 22 bp, Artificial Sequence
  Synthetic Construct
caagatgctcaccccatacctt

SEQ ID NO: 4085 - DNA, 24 bp, Artificial Sequence
  Synthetic Construct
cccggccatcctgaattttattgc

SEQ ID NO: 4086 - DNA, 22 bp, Artificial Sequence
  Synthetic Construct
agaggactgggctcttgctatt

SEQ ID NO: 4087 - DNA, 20 bp, Artificial Sequence
  Synthetic Construct
ctggggccagtcatccctat

SEQ ID NO: 4088 - DNA, 20 bp, Artificial Sequence
  Synthetic Construct
tgaggcagggtgggctatca

SEQ ID NO: 4089 - DNA, 20 bp, Artificial Sequence
  Synthetic Construct
tgctcagttccacccaaacc

SEQ ID NO: 4090 - DNA, 25 bp, Artificial Sequence
  Synthetic Construct
aggctatatgagagcaggctaatct

SEQ ID NO: 4091 - DNA, 22 bp, Artificial Sequence
  Synthetic Construct
gcaacgggagggaaaagtttct

SEQ ID NO: 4092 - DNA, 22 bp, Artificial Sequence
  Synthetic Construct
tcccacctcctgtctcttgaga

SEQ ID NO: 4093 - DNA, 24 bp, Artificial Sequence
  Synthetic Construct
cccattggccataactcagctaca

SEQ ID NO: 4094 - DNA, 24 bp, Artificial Sequence
  Synthetic Construct
ggggccataacttctggattgtgt

SEQ ID NO: 4095 - DNA, 20 bp, Artificial Sequence
  Synthetic Construct
acctctgaggcaaggacctt

SEQ ID NO: 4096 - DNA, 25 bp, Artificial Sequence
  Synthetic Construct
ctaactgcacagagaagagcaaatg

SEQ ID NO: 4097 - DNA, 22 bp, Artificial Sequence
  Synthetic Construct
cgctgttcctgaatgccattag

SEQ ID NO: 4098 - DNA, 26 bp, Artificial Sequence
  Synthetic Construct
ctgagtaggacagtgatgttgtcaga

SEQ ID NO: 4099 - DNA, 22 bp, Artificial Sequence
  Synthetic Construct
agacctcttcgcctctttgttc

SEQ ID NO: 4100 - DNA, 27 bp, Artificial Sequence
  Synthetic Construct
gcaaaatgagagtaaaatgctgctgaa

SEQ ID NO: 4101 - DNA, 24 bp, Artificial Sequence
  Synthetic Construct
cctcctaaaaagccagtccctctt

SEQ ID NO: 4102 - DNA, 22 bp, Artificial Sequence
  Synthetic Construct
aacccagagacacacctatcct

SEQ ID NO: 4103 - DNA, 26 bp, Artificial Sequence
  Synthetic Construct
gcaggtctatacaatcctacccacaa

SEQ ID NO: 4104 - DNA, 22 bp, Artificial Sequence
  Synthetic Construct
tccctgtccttgacgcttaact

SEQ ID NO: 4105 - DNA, 24 bp, Artificial Sequence
  Synthetic Construct
cagagggtaataagtggcgcctta

SEQ ID NO: 4106 - DNA, 21 bp, Artificial Sequence
  Synthetic Construct
acccacgtggtctcagagtct

SEQ ID NO: 4107 - DNA, 22 bp, Artificial Sequence
  Synthetic Construct
aagcattcccttcctcctgcaa

SEQ ID NO: 4108 - DNA, 22 bp, Artificial Sequence
  Synthetic Construct
acccctcacttccaaccttttg

SEQ ID NO: 4109 - DNA, 24 bp, Artificial Sequence
  Synthetic Construct
ctggtggcatgagcaacttatagt

SEQ ID NO: 4110 - DNA, 24 bp, Artificial Sequence
  Synthetic Construct
ctgacttcctcccctcaattttct

SEQ ID NO: 4111 - DNA, 22 bp, Artificial Sequence
  Synthetic Construct
aggaaacgtcccctgctcacta

SEQ ID NO: 4112 - DNA, 24 bp, Artificial Sequence
  Synthetic Construct
gagtagattggaaggggcaaacag

SEQ ID NO: 4113 - DNA, 21 bp, Artificial Sequence
  Synthetic Construct
ctgacaacactcccagcaagt

SEQ ID NO: 4114 - DNA, 20 bp, Artificial Sequence
  Synthetic Construct
ggatgaaggccaggctgtag

SEQ ID NO: 4115 - DNA, 27 bp, Artificial Sequence
  Synthetic Construct
cgcttaagtgttcattgcctataacac

SEQ ID NO: 4116 - DNA, 23 bp, Artificial Sequence
  Synthetic Construct
cctctcctcagatgcctgtttct

SEQ ID NO: 4117 - DNA, 24 bp, Artificial Sequence
  Synthetic Construct
agacctactcatcccttgcttaga

SEQ ID NO: 4118 - DNA, 23 bp, Artificial Sequence
  Synthetic Construct
gttcaaacggtgctagcttagac

SEQ ID NO: 4119 - DNA, 26 bp, Artificial Sequence
  Synthetic Construct
acaacggtaagtgtatgatcatgtct

SEQ ID NO: 4120 - DNA, 22 bp, Artificial Sequence
  Synthetic Construct
aagttggtcagggaaggcagat

SEQ ID NO: 4121 - DNA, 22 bp, Artificial Sequence
  Synthetic Construct
cttggcactgtcccagttctaa

SEQ ID NO: 4122 - DNA, 26 bp, Artificial Sequence
  Synthetic Construct
catgactcatagaccctctactcaac

SEQ ID NO: 4123 - DNA, 22 bp, Artificial Sequence
  Synthetic Construct
gcaggcttcttgaggtcaagga

SEQ ID NO: 4124 - DNA, 20 bp, Artificial Sequence
  Synthetic Construct
atggtgactcgtggggtcat

SEQ ID NO: 4125 - DNA, 22 bp, Artificial Sequence
  Synthetic Construct
agctggatcctccggacaaaga

SEQ ID NO: 4126 - DNA, 24 bp, Artificial Sequence
  Synthetic Construct
gccttctcgacccatctgtgataa

SEQ ID NO: 4127 - DNA, 24 bp, Artificial Sequence
  Synthetic Construct
cctttaccttgacacgggacaaac

SEQ ID NO: 4128 - DNA, 24 bp, Artificial Sequence
  Synthetic Construct
tcccatgaaccacttttcctaagg

SEQ ID NO: 4129 - DNA, 22 bp, Artificial Sequence
  Synthetic Construct
tgtagagagccatgtccctgaa

SEQ ID NO: 4130 - DNA, 25 bp, Artificial Sequence
  Synthetic Construct
tgttccctgcagataccagttattg

SEQ ID NO: 4131 - DNA, 20 bp, Artificial Sequence
  Synthetic Construct
atgcaggctctggatttgca

SEQ ID NO: 4132 - DNA, 23 bp, Artificial Sequence
  Synthetic Construct
ggtgagaggcaagagaaagtctt

SEQ ID NO: 4133 - DNA, 26 bp, Artificial Sequence
  Synthetic Construct
gggggaggctttattcaaaaggagaa

SEQ ID NO: 4134 - DNA, 24 bp, Artificial Sequence
  Synthetic Construct
ggcagatagggaagagtctagact

SEQ ID NO: 4135 - DNA, 21 bp, Artificial Sequence
  Synthetic Construct
tggctcctgaactttggcttt

SEQ ID NO: 4136 - DNA, 21 bp, Artificial Sequence
  Synthetic Construct
tggcttctagtggccttttcc

SEQ ID NO: 4137 - DNA, 22 bp, Artificial Sequence
  Synthetic Construct
gccccttggtctctactcagta

SEQ ID NO: 4138 - DNA, 24 bp, Artificial Sequence
  Synthetic Construct
tctacacttcctacacagcttcac

SEQ ID NO: 4139 - DNA, 23 bp, Artificial Sequence
  Synthetic Construct
tgggaggatgttcacttctagct

SEQ ID NO: 4140 - DNA, 24 bp, Artificial Sequence
  Synthetic Construct
accggtaaagcagtactacaggta

SEQ ID NO: 4141 - DNA, 24 bp, Artificial Sequence
  Synthetic Construct
gctacctcgatccactttctaaca

SEQ ID NO: 4142 - DNA, 21 bp, Artificial Sequence
  Synthetic Construct
ttagcacccctgcggctttca

SEQ ID NO: 4143 - DNA, 22 bp, Artificial Sequence
  Synthetic Construct
gacagctgaaagggttggatgt

SEQ ID NO: 4144 - DNA, 24 bp, Artificial Sequence
  Synthetic Construct
gcacagctaatatgagggcagagt

SEQ ID NO: 4145 - DNA, 22 bp, Artificial Sequence
  Synthetic Construct
aaagccacaggactggaagaga

SEQ ID NO: 4146 - DNA, 26 bp, Artificial Sequence
  Synthetic Construct
gtgagggtagaaccagaatcaattcc

SEQ ID NO: 4147 - DNA, 26 bp, Artificial Sequence
  Synthetic Construct
gactggcattacatcttagtcactgt

SEQ ID NO: 4148 - DNA, 24 bp, Artificial Sequence
  Synthetic Construct
ggttttcttcctgttctccttggt

SEQ ID NO: 4149 - DNA, 24 bp, Artificial Sequence
  Synthetic Construct
gctttgtttgctactgatgcattg

SEQ ID NO: 4150 - DNA, 27 bp, Artificial Sequence
  Synthetic Construct
ctgcagctttatttttacacacttgct

SEQ ID NO: 4151 - DNA, 25 bp, Artificial Sequence
  Synthetic Construct
ctcatcaatgcctccttccttgaac

SEQ ID NO: 4152 - DNA, 26 bp, Artificial Sequence
  Synthetic Construct
cccaccaaatacaggatagctttgag

SEQ ID NO: 4153 - DNA, 27 bp, Artificial Sequence
  Synthetic Construct
cctgtcctatgcacccaaaattatgct

SEQ ID NO: 4154 - DNA, 23 bp, Artificial Sequence
  Synthetic Construct
ccacctgtaccctgtggtatgaa

SEQ ID NO: 4155 - DNA, 23 bp, Artificial Sequence
  Synthetic Construct
tttcccccatgtcttccataacc

SEQ ID NO: 4156 - DNA, 20 bp, Artificial Sequence
  Synthetic Construct
gccagaagccaggtgtcctt

SEQ ID NO: 4157 - DNA, 21 bp, Artificial Sequence
  Synthetic Construct
agtccctgtgtgagtccaact

SEQ ID NO: 4158 - DNA, 22 bp, Artificial Sequence
  Synthetic Construct
cacctatgcccacatacacaca

SEQ ID NO: 4159 - DNA, 23 bp, Artificial Sequence
  Synthetic Construct
gccttctatgtttctggccaact

SEQ ID NO: 4160 - DNA, 23 bp, Artificial Sequence
  Synthetic Construct
acatgctttgagctctgatggtt

SEQ ID NO: 4161 - DNA, 25 bp, Artificial Sequence
  Synthetic Construct
gcctcaagctatgtcttgtctgcat

SEQ ID NO: 4162 - DNA, 24 bp, Artificial Sequence
  Synthetic Construct
gcattgcaacctccatttctagct

SEQ ID NO: 4163 - DNA, 24 bp, Artificial Sequence
  Synthetic Construct
caaatcctcaccctttaggcatca

SEQ ID NO: 4164 - DNA, 20 bp, Artificial Sequence
  Synthetic Construct
gtcactgccagccaaatcct

SEQ ID NO: 4165 - DNA, 26 bp, Artificial Sequence
  Synthetic Construct
gctcatctttgtatctccagcagtga

SEQ ID NO: 4166 - DNA, 24 bp, Artificial Sequence
  Synthetic Construct
ctcagcttcctcatctcacaagga

SEQ ID NO: 4167 - DNA, 20 bp, Artificial Sequence
  Synthetic Construct
gatcccccagttccctccaa

SEQ ID NO: 4168 - DNA, 24 bp, Artificial Sequence
  Synthetic Construct
ggagattccttgaacatggagtct

SEQ ID NO: 4169 - DNA, 20 bp, Artificial Sequence
  Synthetic Construct
gcccactcagctccacacaa

SEQ ID NO: 4170 - DNA, 24 bp, Artificial Sequence
  Synthetic Construct
actcccagtgatccgacaaactat

SEQ ID NO: 4171 - DNA, 22 bp, Artificial Sequence
  Synthetic Construct
cctctgcacttgcttgttacgt

SEQ ID NO: 4172 - DNA, 21 bp, Artificial Sequence
  Synthetic Construct
aaaacctcctggtcccttcca

SEQ ID NO: 4173 - DNA, 24 bp, Artificial Sequence
  Synthetic Construct
ctggaaaattctgtggcaggctat

SEQ ID NO: 4174 - DNA, 24 bp, Artificial Sequence
  Synthetic Construct
gaaggtgtctgactatgccagttc

SEQ ID NO: 4175 - DNA, 20 bp, Artificial Sequence
  Synthetic Construct
agggatggggaacagaagca

SEQ ID NO: 4176 - DNA, 22 bp, Artificial Sequence
  Synthetic Construct
accccagaggaccctgatctta

SEQ ID NO: 4177 - DNA, 21 bp, Artificial Sequence
  Synthetic Construct
acctctcccctcccagaacat

SEQ ID NO: 4178 - DNA, 23 bp, Artificial Sequence
  Synthetic Construct
tgaaatcccgtgaaaccctgtga

SEQ ID NO: 4179 - DNA, 25 bp, Artificial Sequence
  Synthetic Construct
ccccactccctatgttttaggacat

SEQ ID NO: 4180 - DNA, 22 bp, Artificial Sequence
  Synthetic Construct
ggaaacctgctctccattgtga

SEQ ID NO: 4181 - DNA, 22 bp, Artificial Sequence
  Synthetic Construct
gggtgtccctaagatgcatcac

SEQ ID NO: 4182 - DNA, 20 bp, Artificial Sequence
  Synthetic Construct
ccttagtgctggtgctcgtt

SEQ ID NO: 4183 - DNA, 20 bp, Artificial Sequence
  Synthetic Construct
tggctgccaagtggatgctt

SEQ ID NO: 4184 - DNA, 22 bp, Artificial Sequence
  Synthetic Construct
tgcttccggatgtctacaccaa

SEQ ID NO: 4185 - DNA, 21 bp, Artificial Sequence
  Synthetic Construct
gcctcaggcacaagtgttgct

SEQ ID NO: 4186 - DNA, 25 bp, Artificial Sequence
  Synthetic Construct
ccgtcctacctctaaacacagaaca

SEQ ID NO: 4187 - DNA, 22 bp, Artificial Sequence
  Synthetic Construct
agaaggaacctgacagctctgt

SEQ ID NO: 4188 - DNA, 18 bp, Artificial Sequence
  Synthetic Construct
ccagggggaggccactta

SEQ ID NO: 4189 - DNA, 22 bp, Artificial Sequence
  Synthetic Construct
gtggcatgcagtctaggaactt

SEQ ID NO: 4190 - DNA, 20 bp, Artificial Sequence
  Synthetic Construct
gcagccttcccagctgaaga

SEQ ID NO: 4191 - DNA, 22 bp, Artificial Sequence
  Synthetic Construct
ccccctgaaaagcttgtccaat

SEQ ID NO: 4192 - DNA, 20 bp, Artificial Sequence
  Synthetic Construct
cctgcacagggctctgctat

SEQ ID NO: 4193 - DNA, 23 bp, Artificial Sequence
  Synthetic Construct
acctaagactagtgccgtgaagt

SEQ ID NO: 4194 - DNA, 27 bp, Artificial Sequence
  Synthetic Construct
gccaactgacagttatctggtgaagtc

SEQ ID NO: 4195 - DNA, 24 bp, Artificial Sequence
  Synthetic Construct
gctctttttgcccactcttcttca

SEQ ID NO: 4196 - DNA, 20 bp, Artificial Sequence
  Synthetic Construct
tccaagcaacccaacttgca

SEQ ID NO: 4197 - DNA, 24 bp, Artificial Sequence
  Synthetic Construct
gctggaacttcaaagtcccagagt

SEQ ID NO: 4198 - DNA, 27 bp, Artificial Sequence
  Synthetic Construct
tcaaccaatcaccagataactgttgat

SEQ ID NO: 4199 - DNA, 28 bp, Artificial Sequence
  Synthetic Construct
gcaaatagtgctgtgtgtagtgaataca

SEQ ID NO: 4200 - DNA, 22 bp, Artificial Sequence
  Synthetic Construct
gggtgattccgatgctcactta

SEQ ID NO: 4201 - DNA, 26 bp, Artificial Sequence
  Synthetic Construct
ccaacaaccacatgagtttggttgag

SEQ ID NO: 4202 - DNA, 18 bp, Artificial Sequence
  Synthetic Construct
atgcgggcttgctgcata

SEQ ID NO: 4203 - DNA, 24 bp, Artificial Sequence
  Synthetic Construct
gggccacttactcaaagcttcttg

SEQ ID NO: 4204 - DNA, 21 bp, Artificial Sequence
  Synthetic Construct
ttctcctcctgagggcttgct

SEQ ID NO: 4205 - DNA, 23 bp, Artificial Sequence
  Synthetic Construct
caagccatgtctagaaggaaggt

SEQ ID NO: 4206 - DNA, 23 bp, Artificial Sequence
  Synthetic Construct
ctgtcctgcagattccctttgat

SEQ ID NO: 4207 - DNA, 23 bp, Artificial Sequence
  Synthetic Construct
cccaatgaagagagcatggcatt

SEQ ID NO: 4208 - DNA, 23 bp, Artificial Sequence
  Synthetic Construct
ggctaagcaacacacatgtctac

SEQ ID NO: 4209 - DNA, 24 bp, Artificial Sequence
  Synthetic Construct
gcacattctgccccccagatattt

SEQ ID NO: 4210 - DNA, 28 bp, Artificial Sequence
  Synthetic Construct
caatatgggaatcagagggacttaaaac

SEQ ID NO: 4211 - DNA, 21 bp, Artificial Sequence
  Synthetic Construct
tgtcctggtgctctcaatgtc

SEQ ID NO: 4212 - DNA, 25 bp, Artificial Sequence
  Synthetic Construct
ggttgtaactcctgaccgtaatacg

SEQ ID NO: 4213 - DNA, 18 bp, Artificial Sequence
  Synthetic Construct
gggccactgtcgtttgca

SEQ ID NO: 4214 - DNA, 22 bp, Artificial Sequence
  Synthetic Construct
aggccctgaaggagtgagttca

SEQ ID NO: 4215 - DNA, 26 bp, Artificial Sequence
  Synthetic Construct
gagatagtgtcctttgtgtctgaaca

SEQ ID NO: 4216 - DNA, 22 bp, Artificial Sequence
  Synthetic Construct
ggcgtgttgggattttaaacca

SEQ ID NO: 4217 - DNA, 28 bp, Artificial Sequence
  Synthetic Construct
gtgatctatcagttgcaattcagatagc

SEQ ID NO: 4218 - DNA, 27 bp, Artificial Sequence
  Synthetic Construct
tgtggaccaggttaattacattgtctt

SEQ ID NO: 4219 - DNA, 18 bp, Artificial Sequence
  Synthetic Construct
gcgctgccctactttgct

SEQ ID NO: 4220 - DNA, 25 bp, Artificial Sequence
  Synthetic Construct
acaagcagagggagaaataggtcta

SEQ ID NO: 4221 - DNA, 24 bp, Artificial Sequence
  Synthetic Construct
cagttgttaggcagacatcggata

SEQ ID NO: 4222 - DNA, 21 bp, Artificial Sequence
  Synthetic Construct
caccccactcccattgtttga

SEQ ID NO: 4223 - DNA, 24 bp, Artificial Sequence
  Synthetic Construct
cctcccacaattttacccatgtct

SEQ ID NO: 4224 - DNA, 26 bp, Artificial Sequence
  Synthetic Construct
actctgagttgtgtcaaactatcact

SEQ ID NO: 4225 - DNA, 24 bp, Artificial Sequence
  Synthetic Construct
cagtagtttccccaacctcaatgg

SEQ ID NO: 4226 - DNA, 23 bp, Artificial Sequence
  Synthetic Construct
ggcaatgcgaatgagttcctaca

SEQ ID NO: 4227 - DNA, 26 bp, Artificial Sequence
  Synthetic Construct
ccataggtaatcatacgccctgaatc

SEQ ID NO: 4228 - DNA, 27 bp, Artificial Sequence
  Synthetic Construct
gagtttttgagcctagaatgtaaagct

SEQ ID NO: 4229 - DNA, 23 bp, Artificial Sequence
  Synthetic Construct
ggcctgacccatgatgaatagtt

SEQ ID NO: 4230 - DNA, 25 bp, Artificial Sequence
  Synthetic Construct
ccaggtttaaacccacactttatcc

SEQ ID NO: 4231 - DNA, 20 bp, Artificial Sequence
  Synthetic Construct
tggcacagagcagtcactgt

SEQ ID NO: 4232 - DNA, 22 bp, Artificial Sequence
  Synthetic Construct
tgcgaccacagaagtgcaaagt

SEQ ID NO: 4233 - DNA, 21 bp, Artificial Sequence
  Synthetic Construct
aaaacctgtgagggagttgca

SEQ ID NO: 4234 - DNA, 24 bp, Artificial Sequence
  Synthetic Construct
cgggggtactatttctgagatgag

SEQ ID NO: 4235 - DNA, 22 bp, Artificial Sequence
  Synthetic Construct
ctcaaactaccggtctcaagca

SEQ ID NO: 4236 - DNA, 22 bp, Artificial Sequence
  Synthetic Construct
tggcagttggtactagctgcta

SEQ ID NO: 4237 - DNA, 23 bp, Artificial Sequence
  Synthetic Construct
agctgctgcttcacctctttagc

SEQ ID NO: 4238 - DNA, 22 bp, Artificial Sequence
  Synthetic Construct
agcaagctcaaaccccagaagt

SEQ ID NO: 4239 - DNA, 24 bp, Artificial Sequence
  Synthetic Construct
ctctgccaattgttactccagcaa

SEQ ID NO: 4240 - DNA, 21 bp, Artificial Sequence
  Synthetic Construct
tcctgcaatgctgggaaagtg

SEQ ID NO: 4241 - DNA, 25 bp, Artificial Sequence
  Synthetic Construct
ctgaaattccagagggaggtctaag

SEQ ID NO: 4242 - DNA, 25 bp, Artificial Sequence
  Synthetic Construct
gactcgtcttgataggtgatttcca

SEQ ID NO: 4243 - DNA, 23 bp, Artificial Sequence
  Synthetic Construct
ctgttcctaaactgcagcaaagg

SEQ ID NO: 4244 - DNA, 30 bp, Artificial Sequence
  Synthetic Construct
ctctgttgatgaaggtatattccctatagc

SEQ ID NO: 4245 - DNA, 25 bp, Artificial Sequence
  Synthetic Construct
gcctactaacactgggttacaaagg

SEQ ID NO: 4246 - DNA, 21 bp, Artificial Sequence
  Synthetic Construct
tgacaaggagctgacctacct

SEQ ID NO: 4247 - DNA, 27 bp, Artificial Sequence
  Synthetic Construct
cccgcatagaaaagatgattccttggt

SEQ ID NO: 4248 - DNA, 25 bp, Artificial Sequence
  Synthetic Construct
gactgacgttctcaatgtatgcatt

SEQ ID NO: 4249 - DNA, 27 bp, Artificial Sequence
  Synthetic Construct
gaaagttctccttaagtgtctttgcaa

SEQ ID NO: 4250 - DNA, 26 bp, Artificial Sequence
  Synthetic Construct
gccttagaactccatctagacctgta

SEQ ID NO: 4251 - DNA, 25 bp, Artificial Sequence
  Synthetic Construct
gtgccagaaaaacttggtcatttgg

SEQ ID NO: 4252 - DNA, 25 bp, Artificial Sequence
  Synthetic Construct
ccctgtgataaggagggttgttttg

SEQ ID NO: 4253 - DNA, 22 bp, Artificial Sequence
  Synthetic Construct
tgtgacagagaggacagacact

SEQ ID NO: 4254 - DNA, 25 bp, Artificial Sequence
  Synthetic Construct
ctctttttgggtgcacatactcttg

SEQ ID NO: 4255 - DNA, 26 bp, Artificial Sequence
  Synthetic Construct
tgtcttagcatgtctttgttcctaca

SEQ ID NO: 4256 - DNA, 22 bp, Artificial Sequence
  Synthetic Construct
tgtcaggagggcactttcctat

SEQ ID NO: 4257 - DNA, 24 bp, Artificial Sequence
  Synthetic Construct
gcaaatgtgaccctaggcagaaac

SEQ ID NO: 4258 - DNA, 22 bp, Artificial Sequence
  Synthetic Construct
ttgactaacacgtcacgacact

SEQ ID NO: 4259 - DNA, 24 bp, Artificial Sequence
  Synthetic Construct
ccagagtcattacttctgcatgca

SEQ ID NO: 4260 - DNA, 28 bp, Artificial Sequence
  Synthetic Construct
gcagtctaggttttgttggttattcagt

SEQ ID NO: 4261 - DNA, 20 bp, Artificial Sequence
  Synthetic Construct
gccagtgtttgcaccttgga

SEQ ID NO: 4262 - DNA, 24 bp, Artificial Sequence
  Synthetic Construct
gagagccatattccacaagcaaca

SEQ ID NO: 4263 - DNA, 27 bp, Artificial Sequence
  Synthetic Construct
ggaactatttcctggagcctactgttt

SEQ ID NO: 4264 - DNA, 23 bp, Artificial Sequence
  Synthetic Construct
agacgtgttgtgttcaatgcatt

SEQ ID NO: 4265 - DNA, 20 bp, Artificial Sequence
  Synthetic Construct
atggggcagagggagaagca

SEQ ID NO: 4266 - DNA, 21 bp, Artificial Sequence
  Synthetic Construct
tggcctgaaaggatggttctg

SEQ ID NO: 4267 - DNA, 20 bp, Artificial Sequence
  Synthetic Construct
ctgccacatccttgctagct

SEQ ID NO: 4268 - DNA, 20 bp, Artificial Sequence
  Synthetic Construct
tctcccacccactgtaacca

SEQ ID NO: 4269 - DNA, 23 bp, Artificial Sequence
  Synthetic Construct
gcaaatcagtggaacatgttggt

SEQ ID NO: 4270 - DNA, 22 bp, Artificial Sequence
  Synthetic Construct
tgatagctgaggccaggtcata

SEQ ID NO: 4271 - DNA, 20 bp, Artificial Sequence
  Synthetic Construct
tcaatggcttggccctctga

SEQ ID NO: 4272 - DNA, 24 bp, Artificial Sequence
  Synthetic Construct
gcaaatggaccagaggaacagatg

SEQ ID NO: 4273 - DNA, 23 bp, Artificial Sequence
  Synthetic Construct
ggccctttcgcaacctttttttg

SEQ ID NO: 4274 - DNA, 21 bp, Artificial Sequence
  Synthetic Construct
cttcctccagcctctctgtga

SEQ ID NO: 4275 - DNA, 22 bp, Artificial Sequence
  Synthetic Construct
gtacccctgtgctaatgtggtt

SEQ ID NO: 4276 - DNA, 24 bp, Artificial Sequence
  Synthetic Construct
cagccttgcgaatagacaagacta

SEQ ID NO: 4277 - DNA, 25 bp, Artificial Sequence
  Synthetic Construct
gtctggtttcagtgtgactttagct

SEQ ID NO: 4278 - DNA, 23 bp, Artificial Sequence
  Synthetic Construct
tctcctgtccatttgtggaatgc

SEQ ID NO: 4279 - DNA, 18 bp, Artificial Sequence
  Synthetic Construct
gagcgcggcaatgtcgtt

SEQ ID NO: 4280 - DNA, 22 bp, Artificial Sequence
  Synthetic Construct
cgaaggttcaaagcccaaacac

SEQ ID NO: 4281 - DNA, 24 bp, Artificial Sequence
  Synthetic Construct
tggagtttgttccctgaattagca

SEQ ID NO: 4282 - DNA, 27 bp, Artificial Sequence
  Synthetic Construct
ccctctctctagattcaacccagaact

SEQ ID NO: 4283 - DNA, 21 bp, Artificial Sequence
  Synthetic Construct
tggctgcatggcaacttctca

SEQ ID NO: 4284 - DNA, 24 bp, Artificial Sequence
  Synthetic Construct
tgttcaatcagttggcagactttc

SEQ ID NO: 4285 - DNA, 21 bp, Artificial Sequence
  Synthetic Construct
aaagctgtggaggggtccttt

SEQ ID NO: 4286 - DNA, 23 bp, Artificial Sequence
  Synthetic Construct
ccttggcccagttatgttcttga

SEQ ID NO: 4287 - DNA, 28 bp, Artificial Sequence
  Synthetic Construct
ggaaattaggcccttcatgcatttctaa

SEQ ID NO: 4288 - DNA, 26 bp, Artificial Sequence
  Synthetic Construct
ggcagattttcaatctttggcttgca

SEQ ID NO: 4289 - DNA, 24 bp, Artificial Sequence
  Synthetic Construct
ggctcacccttaggctgatgataa

SEQ ID NO: 4290 - DNA, 24 bp, Artificial Sequence
  Synthetic Construct
ggcctatccttcctggtgattgta

SEQ ID NO: 4291 - DNA, 25 bp, Artificial Sequence
  Synthetic Construct
cacaacctagcaacctcttttacag

SEQ ID NO: 4292 - DNA, 26 bp, Artificial Sequence
  Synthetic Construct
ccaactagtctgtcctgcactttaga

SEQ ID NO: 4293 - DNA, 23 bp, Artificial Sequence
  Synthetic Construct
tgggttttaaagaccgtcgtcaa

SEQ ID NO: 4294 - DNA, 18 bp, Artificial Sequence
  Synthetic Construct
gccccagctgctgtgtgt

SEQ ID NO: 4295 - DNA, 22 bp, Artificial Sequence
  Synthetic Construct
ttgatgcctgctcgagacattg

SEQ ID NO: 4296 - DNA, 23 bp, Artificial Sequence
  Synthetic Construct
tgtggctacaattggctcttgag

SEQ ID NO: 4297 - DNA, 20 bp, Artificial Sequence
  Synthetic Construct
agttccgctcaccagtgcta

SEQ ID NO: 4298 - DNA, 23 bp, Artificial Sequence
  Synthetic Construct
gaagagtgaagagtgaccagcat

SEQ ID NO: 4299 - DNA, 21 bp, Artificial Sequence
  Synthetic Construct
agggcaggtgtttcaggaagt

SEQ ID NO: 4300 - DNA, 24 bp, Artificial Sequence
  Synthetic Construct
ccacagttcagtgaatgggagcat

SEQ ID NO: 4301 - DNA, 26 bp, Artificial Sequence
  Synthetic Construct
ctaatacccctgcaatttctcttcct

SEQ ID NO: 4302 - DNA, 20 bp, Artificial Sequence
  Synthetic Construct
agcaatctgccgccaggatt

SEQ ID NO: 4303 - DNA, 25 bp, Artificial Sequence
  Synthetic Construct
caggtcttggcttaaatgtcaacac

SEQ ID NO: 4304 - DNA, 23 bp, Artificial Sequence
  Synthetic Construct
tgcagtgggatcagctaccagta

SEQ ID NO: 4305 - DNA, 23 bp, Artificial Sequence
  Synthetic Construct
gccactgagaagactctgtcctt

SEQ ID NO: 4306 - DNA, 25 bp, Artificial Sequence
  Synthetic Construct
ggccaagactcctaaatctgaagct

SEQ ID NO: 4307 - DNA, 24 bp, Artificial Sequence
  Synthetic Construct
ggtgtgcctcaggtgtaagatgat

SEQ ID NO: 4308 - DNA, 25 bp, Artificial Sequence
  Synthetic Construct
tgacaatctcatcacgtctgacaag

SEQ ID NO: 4309 - DNA, 25 bp, Artificial Sequence
  Synthetic Construct
tcacacacatcagtctaaacctgaa

SEQ ID NO: 4310 - DNA, 24 bp, Artificial Sequence
  Synthetic Construct
cccaactgtctcactgttcatgga

SEQ ID NO: 4311 - DNA, 25 bp, Artificial Sequence
  Synthetic Construct
aagtgtagccacataaactggtgat

SEQ ID NO: 4312 - DNA, 22 bp, Artificial Sequence
  Synthetic Construct
tgccctaacctccgtttacaac

SEQ ID NO: 4313 - DNA, 25 bp, Artificial Sequence
  Synthetic Construct
cctatgtaatggccaaagacacttg

SEQ ID NO: 4314 - DNA, 20 bp, Artificial Sequence
  Synthetic Construct
tgggcatgttgtgtgatgct

SEQ ID NO: 4315 - DNA, 26 bp, Artificial Sequence
  Synthetic Construct
attttggttgccttttcccactatag

SEQ ID NO: 4316 - DNA, 22 bp, Artificial Sequence
  Synthetic Construct
tgctgaagaggctctgagtcat

SEQ ID NO: 4317 - DNA, 27 bp, Artificial Sequence
  Synthetic Construct
agtggtattcatgtcagcaagaaattg

SEQ ID NO: 4318 - DNA, 23 bp, Artificial Sequence
  Synthetic Construct
ggatcctgcactagtacaaagca

SEQ ID NO: 4319 - DNA, 20 bp, Artificial Sequence
  Synthetic Construct
catctggccacctgaacaca

SEQ ID NO: 4320 - DNA, 24 bp, Artificial Sequence
  Synthetic Construct
gaaagccagaagacatgtcatgag

SEQ ID NO: 4321 - DNA, 22 bp, Artificial Sequence
  Synthetic Construct
acctgagagccattgcctccta

SEQ ID NO: 4322 - DNA, 30 bp, Artificial Sequence
  Synthetic Construct
gcctaaggactgtgtaagaaggaaatacag

SEQ ID NO: 4323 - DNA, 26 bp, Artificial Sequence
  Synthetic Construct
gtgtcctctgaccactaaactatacc

SEQ ID NO: 4324 - DNA, 21 bp, Artificial Sequence
  Synthetic Construct
tctgtctcctgcatgcaactc

SEQ ID NO: 4325 - DNA, 26 bp, Artificial Sequence
  Synthetic Construct
ccacctatactgaacttaggggaaga

SEQ ID NO: 4326 - DNA, 26 bp, Artificial Sequence
  Synthetic Construct
agctggaaaggagtttattgaaagga

SEQ ID NO: 4327 - DNA, 20 bp, Artificial Sequence
  Synthetic Construct
tcaaggcaccctttccgttt

SEQ ID NO: 4328 - DNA, 23 bp, Artificial Sequence
  Synthetic Construct
gtgaggtaccagtggaggatctt

SEQ ID NO: 4329 - DNA, 21 bp, Artificial Sequence
  Synthetic Construct
acagtactgggccagatggaa

SEQ ID NO: 4330 - DNA, 24 bp, Artificial Sequence
  Synthetic Construct
aggatagcatacaccctacacagt

SEQ ID NO: 4331 - DNA, 22 bp, Artificial Sequence
  Synthetic Construct
ctcagcccctccacgtgggaat

SEQ ID NO: 4332 - DNA, 21 bp, Artificial Sequence
  Synthetic Construct
atggctgaagaggaccatgtg

SEQ ID NO: 4333 - DNA, 22 bp, Artificial Sequence
  Synthetic Construct
ccatgcctaccaagagctagtg

SEQ ID NO: 4334 - DNA, 20 bp, Artificial Sequence
  Synthetic Construct
ggggtacaggctggggattt

SEQ ID NO: 4335 - DNA, 24 bp, Artificial Sequence
  Synthetic Construct
gcactaggattgccttctgttctg

SEQ ID NO: 4336 - DNA, 27 bp, Artificial Sequence
  Synthetic Construct
ccacaatttaagactaaccaccatgct

SEQ ID NO: 4337 - DNA, 26 bp, Artificial Sequence
  Synthetic Construct
ttcagaaggtgtgaaagtgtatggta

SEQ ID NO: 4338 - DNA, 25 bp, Artificial Sequence
  Synthetic Construct
gtctcaagtagggttacgctgtatt

SEQ ID NO: 4339 - DNA, 25 bp, Artificial Sequence
  Synthetic Construct
tgatcaccatgcaggggtttattac

SEQ ID NO: 4340 - DNA, 30 bp, Artificial Sequence
  Synthetic Construct
catcaactatgactggtatttcagagttct

SEQ ID NO: 4341 - DNA, 21 bp, Artificial Sequence
  Synthetic Construct
ccttggcactgtggagcaaga

SEQ ID NO: 4342 - DNA, 27 bp, Artificial Sequence
  Synthetic Construct
ggtcatggtttcaaggaaatggattgg

SEQ ID NO: 4343 - DNA, 22 bp, Artificial Sequence
  Synthetic Construct
gggcagctgatgtaacaattcc

SEQ ID NO: 4344 - DNA, 22 bp, Artificial Sequence
  Synthetic Construct
tctggcagcttgttggagaaag

SEQ ID NO: 4345 - DNA, 22 bp, Artificial Sequence
  Synthetic Construct
aggacatctgggagcagaaaga

SEQ ID NO: 4346 - DNA, 23 bp, Artificial Sequence
  Synthetic Construct
gggaaagtacaccccatttctga

SEQ ID NO: 4347 - DNA, 27 bp, Artificial Sequence
  Synthetic Construct
gggacagttttcctgaaagtagagcta

SEQ ID NO: 4348 - DNA, 27 bp, Artificial Sequence
  Synthetic Construct
gtctgatttgaactgttatctgctgtt

SEQ ID NO: 4349 - DNA, 22 bp, Artificial Sequence
  Synthetic Construct
ggactaccagcctatgccatct

SEQ ID NO: 4350 - DNA, 19 bp, Artificial Sequence
  Synthetic Construct
agggctcgtcctcctgctt

SEQ ID NO: 4351 - DNA, 22 bp, Artificial Sequence
  Synthetic Construct
gctccttacagctccagcaaga

SEQ ID NO: 4352 - DNA, 22 bp, Artificial Sequence
  Synthetic Construct
tgtggggaactagagacccaaa

SEQ ID NO: 4353 - DNA, 25 bp, Artificial Sequence
  Synthetic Construct
tgagaactgtcctctcttcattctg

SEQ ID NO: 4354 - DNA, 25 bp, Artificial Sequence
  Synthetic Construct
agtagctggtgtattcaaggaacag

SEQ ID NO: 4355 - DNA, 22 bp, Artificial Sequence
  Synthetic Construct
aacacgcccttgatggatgaga

SEQ ID NO: 4356 - DNA, 24 bp, Artificial Sequence
  Synthetic Construct
gcatagctgtggtcaccaaacaac

SEQ ID NO: 4357 - DNA, 22 bp, Artificial Sequence
  Synthetic Construct
tcaaagccttgcctcagcttct

SEQ ID NO: 4358 - DNA, 24 bp, Artificial Sequence
  Synthetic Construct
tgctctgtttgtgggttagtttca

SEQ ID NO: 4359 - DNA, 26 bp, Artificial Sequence
  Synthetic Construct
caagaaggctttcccagtatcaactg

SEQ ID NO: 4360 - DNA, 23 bp, Artificial Sequence
  Synthetic Construct
cactgtctccagccatccctata

SEQ ID NO: 4361 - DNA, 21 bp, Artificial Sequence
  Synthetic Construct
ctccttacccatgggtttgct

SEQ ID NO: 4362 - DNA, 22 bp, Artificial Sequence
  Synthetic Construct
acggggtaggaaatgtcacctt

SEQ ID NO: 4363 - DNA, 25 bp, Artificial Sequence
  Synthetic Construct
ggagtgttaacagcttctgccattc

SEQ ID NO: 4364 - DNA, 27 bp, Artificial Sequence
  Synthetic Construct
gtggataaggtatagggagtacaggat

SEQ ID NO: 4365 - DNA, 24 bp, Artificial Sequence
  Synthetic Construct
ggctacaacaatgagggggaaatg

SEQ ID NO: 4366 - DNA, 22 bp, Artificial Sequence
  Synthetic Construct
ggtggtgcagtgtgccaaataa

SEQ ID NO: 4367 - DNA, 20 bp, Artificial Sequence
  Synthetic Construct
ccaggtaccctcaccactct

SEQ ID NO: 4368 - DNA, 24 bp, Artificial Sequence
  Synthetic Construct
gggaagcgaccattggaattagga

SEQ ID NO: 4369 - DNA, 23 bp, Artificial Sequence
  Synthetic Construct
tgttagcaaaagaccagggtgtt

SEQ ID NO: 4370 - DNA, 25 bp, Artificial Sequence
  Synthetic Construct
tcatatgtggagaacttggcatcaa

SEQ ID NO: 4371 - DNA, 20 bp, Artificial Sequence
  Synthetic Construct
ccttgcaatggtccccagat

SEQ ID NO: 4372 - DNA, 28 bp, Artificial Sequence
  Synthetic Construct
ggatcaggatcctacctttagactcctt

SEQ ID NO: 4373 - DNA, 27 bp, Artificial Sequence
  Synthetic Construct
tttgcatctgtgttcacattacactag

SEQ ID NO: 4374 - DNA, 24 bp, Artificial Sequence
  Synthetic Construct
ttgggtaataccaggactcccata

SEQ ID NO: 4375 - DNA, 22 bp, Artificial Sequence
  Synthetic Construct
tggtgggttgatgaggacaaga

SEQ ID NO: 4376 - DNA, 22 bp, Artificial Sequence
  Synthetic Construct
agctgctgcccatctttttcct

SEQ ID NO: 4377 - DNA, 21 bp, Artificial Sequence
  Synthetic Construct
tgtgaagcaaagccaccacaa

SEQ ID NO: 4378 - DNA, 24 bp, Artificial Sequence
  Synthetic Construct
gtgtcctcatagtctcaccttgca

SEQ ID NO: 4379 - DNA, 21 bp, Artificial Sequence
  Synthetic Construct
gcgtacctccgagaacacact

SEQ ID NO: 4380 - DNA, 26 bp, Artificial Sequence
  Synthetic Construct
actggtggttctttggtatttttcac

SEQ ID NO: 4381 - DNA, 24 bp, Artificial Sequence
  Synthetic Construct
cctggataaggcaagagacttgtc

SEQ ID NO: 4382 - DNA, 21 bp, Artificial Sequence
  Synthetic Construct
acaaacccaagggcacgtagt

SEQ ID NO: 4383 - DNA, 20 bp, Artificial Sequence
  Synthetic Construct
ccccatggcctggattaagc

SEQ ID NO: 4384 - DNA, 25 bp, Artificial Sequence
  Synthetic Construct
gcgctgatgatatttctggtgtgtt

SEQ ID NO: 4385 - DNA, 26 bp, Artificial Sequence
  Synthetic Construct
ggacctgttgactgaagaaatgatga

SEQ ID NO: 4386 - DNA, 24 bp, Artificial Sequence
  Synthetic Construct
ctttgaagtctctgcacctcagtt

SEQ ID NO: 4387 - DNA, 18 bp, Artificial Sequence
  Synthetic Construct
tcctgctggctgcacaca

SEQ ID NO: 4388 - DNA, 23 bp, Artificial Sequence
  Synthetic Construct
gaggaaacccagagtcaggaact

SEQ ID NO: 4389 - DNA, 25 bp, Artificial Sequence
  Synthetic Construct
catgcatcaggtgtacattaagctt

SEQ ID NO: 4390 - DNA, 26 bp, Artificial Sequence
  Synthetic Construct
gggtctcagtatcaagctgactgttg

SEQ ID NO: 4391 - DNA, 24 bp, Artificial Sequence
  Synthetic Construct
cctgaacctactccatctgttcct

SEQ ID NO: 4392 - DNA, 24 bp, Artificial Sequence
  Synthetic Construct
ctgagctgaggtcatgttcttcct

SEQ ID NO: 4393 - DNA, 27 bp, Artificial Sequence
  Synthetic Construct
aggaggtttatattgtgctcagacatt

SEQ ID NO: 4394 - DNA, 20 bp, Artificial Sequence
  Synthetic Construct
tggatccccccaccactctt

SEQ ID NO: 4395 - DNA, 18 bp, Artificial Sequence
  Synthetic Construct
tggccgtgctcctcagta

SEQ ID NO: 4396 - DNA, 22 bp, Artificial Sequence
  Synthetic Construct
ggtttggggttgctcctttagt

SEQ ID NO: 4397 - DNA, 23 bp, Artificial Sequence
  Synthetic Construct
ctctgtggggcatgtttagaact

SEQ ID NO: 4398 - DNA, 20 bp, Artificial Sequence
  Synthetic Construct
gaggtggtgagcacaaagga

SEQ ID NO: 4399 - DNA, 25 bp, Artificial Sequence
  Synthetic Construct
ctgctaaaaccctccaatggcttac

SEQ ID NO: 4400 - DNA, 21 bp, Artificial Sequence
  Synthetic Construct
gctgggacatggtgttagtgt

SEQ ID NO: 4401 - DNA, 22 bp, Artificial Sequence
  Synthetic Construct
actgaggctgactccattgaga

SEQ ID NO: 4402 - DNA, 20 bp, Artificial Sequence
  Synthetic Construct
gctggcgggaagtcacacaa

SEQ ID NO: 4403 - DNA, 26 bp, Artificial Sequence
  Synthetic Construct
gtgttatcactgccataatggtcaag

SEQ ID NO: 4404 - DNA, 22 bp, Artificial Sequence
  Synthetic Construct
tgtttctggcgtgtgaaagtga

SEQ ID NO: 4405 - DNA, 25 bp, Artificial Sequence
  Synthetic Construct
cagaactcagaggctagtctaggta

SEQ ID NO: 4406 - DNA, 19 bp, Artificial Sequence
  Synthetic Construct
cctcaggcagctggtgtct

SEQ ID NO: 4407 - DNA, 26 bp, Artificial Sequence
  Synthetic Construct
gatctcaaggtaggaatgtgtctcaa

SEQ ID NO: 4408 - DNA, 25 bp, Artificial Sequence
  Synthetic Construct
gtttccccaagtctgcctcatattt

SEQ ID NO: 4409 - DNA, 26 bp, Artificial Sequence
  Synthetic Construct
cactttgatctccttatgctgctagt

SEQ ID NO: 4410 - DNA, 28 bp, Artificial Sequence
  Synthetic Construct
catcttttaccacaagctaacagtacag

SEQ ID NO: 4411 - DNA, 24 bp, Artificial Sequence
  Synthetic Construct
ggtgatttgccaaccattcttgac

SEQ ID NO: 4412 - DNA, 23 bp, Artificial Sequence
  Synthetic Construct
agcaccccagaaaacttcttgag

SEQ ID NO: 4413 - DNA, 23 bp, Artificial Sequence
  Synthetic Construct
tctctctagagcaagcagacaca

SEQ ID NO: 4414 - DNA, 23 bp, Artificial Sequence
  Synthetic Construct
tggctcatgcttctgggaatgtg

SEQ ID NO: 4415 - DNA, 25 bp, Artificial Sequence
  Synthetic Construct
cagattcctaactcaccttcagcaa

SEQ ID NO: 4416 - DNA, 21 bp, Artificial Sequence
  Synthetic Construct
ggactgctgcagagactcttc

SEQ ID NO: 4417 - DNA, 19 bp, Artificial Sequence
  Synthetic Construct
tgccgtgagcgtgtgttca

SEQ ID NO: 4418 - DNA, 26 bp, Artificial Sequence
  Synthetic Construct
gagaagaaaaacgccatgaagaaacc

SEQ ID NO: 4419 - DNA, 26 bp, Artificial Sequence
  Synthetic Construct
gctgagagggcctcggaattatattg

SEQ ID NO: 4420 - DNA, 22 bp, Artificial Sequence
  Synthetic Construct
gaccactgtagctgcttttgtc

SEQ ID NO: 4421 - DNA, 22 bp, Artificial Sequence
  Synthetic Construct
gggtgaagtgggtgcatctaat

SEQ ID NO: 4422 - DNA, 24 bp, Artificial Sequence
  Synthetic Construct
tttgaagggtgcatttgtgatgtt

SEQ ID NO: 4423 - DNA, 28 bp, Artificial Sequence
  Synthetic Construct
gggattctgtgtcctagcacttttatgg

SEQ ID NO: 4424 - DNA, 22 bp, Artificial Sequence
  Synthetic Construct
cgcgctggaagttaatgcagta

SEQ ID NO: 4425 - DNA, 25 bp, Artificial Sequence
  Synthetic Construct
gcaatgaaaagtcttgcagtttgag

SEQ ID NO: 4426 - DNA, 24 bp, Artificial Sequence
  Synthetic Construct
agcagtctgagtcaccctatcctt

SEQ ID NO: 4427 - DNA, 25 bp, Artificial Sequence
  Synthetic Construct
tcctaggtaggcttccattcctatc

SEQ ID NO: 4428 - DNA, 27 bp, Artificial Sequence
  Synthetic Construct
aaggaaatgcaattgtatgtacagcat

SEQ ID NO: 4429 - DNA, 22 bp, Artificial Sequence
  Synthetic Construct
gggagccaaaggttttcaggaa

SEQ ID NO: 4430 - DNA, 28 bp, Artificial Sequence
  Synthetic Construct
gcttgtgtttgtccagggattttagttg

SEQ ID NO: 4431 - DNA, 25 bp, Artificial Sequence
  Synthetic Construct
agaacgcgattgacccattttaaac

SEQ ID NO: 4432 - DNA, 24 bp, Artificial Sequence
  Synthetic Construct
catcagaatttgctgcagcttaga

SEQ ID NO: 4433 - DNA, 22 bp, Artificial Sequence
  Synthetic Construct
cgcagcaagtcaagcaatggaa

SEQ ID NO: 4434 - DNA, 22 bp, Artificial Sequence
  Synthetic Construct
aggtaaggtgtctgccttcaca

SEQ ID NO: 4435 - DNA, 21 bp, Artificial Sequence
  Synthetic Construct
agggcagcaccagaagctaga

SEQ ID NO: 4436 - DNA, 22 bp, Artificial Sequence
  Synthetic Construct
ggagagtggttgattgggctaa

SEQ ID NO: 4437 - DNA, 22 bp, Artificial Sequence
  Synthetic Construct
ctctgcccacattctggttcaa

SEQ ID NO: 4438 - DNA, 21 bp, Artificial Sequence
  Synthetic Construct
cgatcttcctgtcgcctttcc

SEQ ID NO: 4439 - DNA, 23 bp, Artificial Sequence
  Synthetic Construct
ggccaccatcacttgatacttca

SEQ ID NO: 4440 - DNA, 29 bp, Artificial Sequence
  Synthetic Construct
gagataatgggaatagaagccttcatcag

SEQ ID NO: 4441 - DNA, 24 bp, Artificial Sequence
  Synthetic Construct
gtgtctggaacacctaaggactca

SEQ ID NO: 4442 - DNA, 23 bp, Artificial Sequence
  Synthetic Construct
aggctgccatactccagttagca

SEQ ID NO: 4443 - DNA, 26 bp, Artificial Sequence
  Synthetic Construct
ttaagccttactctgagccactttat

SEQ ID NO: 4444 - DNA, 20 bp, Artificial Sequence
  Synthetic Construct
ttggtgcccctcccctctat

SEQ ID NO: 4445 - DNA, 23 bp, Artificial Sequence
  Synthetic Construct
ctgaataggagggaggactcaca

SEQ ID NO: 4446 - DNA, 21 bp, Artificial Sequence
  Synthetic Construct
tgactcgggccaactgaaatg

SEQ ID NO: 4447 - DNA, 27 bp, Artificial Sequence
  Synthetic Construct
cactgtgggccatattatgagagtata

SEQ ID NO: 4448 - DNA, 24 bp, Artificial Sequence
  Synthetic Construct
ggggattaactcagtcacggcaat

SEQ ID NO: 4449 - DNA, 24 bp, Artificial Sequence
  Synthetic Construct
cggtttgtgacagcactactctca

SEQ ID NO: 4450 - DNA, 21 bp, Artificial Sequence
  Synthetic Construct
aggacttcctgggcagtgaaa

SEQ ID NO: 4451 - DNA, 27 bp, Artificial Sequence
  Synthetic Construct
tccatggatccacatgtctatccttat

SEQ ID NO: 4452 - DNA, 26 bp, Artificial Sequence
  Synthetic Construct
ccctagctaaaaaggtgatgcatcca

SEQ ID NO: 4453 - DNA, 21 bp, Artificial Sequence
  Synthetic Construct
cccagtgcacaatcccaattg

SEQ ID NO: 4454 - DNA, 22 bp, Artificial Sequence
  Synthetic Construct
ccacaaagcaggcgacactaaa

SEQ ID NO: 4455 - DNA, 21 bp, Artificial Sequence
  Synthetic Construct
ggtcccaagatgactgcaaga

SEQ ID NO: 4456 - DNA, 23 bp, Artificial Sequence
  Synthetic Construct
cagtcactgcttgaacaccatgt

SEQ ID NO: 4457 - DNA, 23 bp, Artificial Sequence
  Synthetic Construct
cccaagttctcttgcccatttga

SEQ ID NO: 4458 - DNA, 19 bp, Artificial Sequence
  Synthetic Construct
tgcactgctgagccacaga

SEQ ID NO: 4459 - DNA, 21 bp, Artificial Sequence
  Synthetic Construct
cacacacagctgcacagattg

SEQ ID NO: 4460 - DNA, 23 bp, Artificial Sequence
  Synthetic Construct
cctgcttatcagtgcctggtgat

SEQ ID NO: 4461 - DNA, 25 bp, Artificial Sequence
  Synthetic Construct
gcaaatgcaaaggttctgaggcaaa

SEQ ID NO: 4462 - DNA, 20 bp, Artificial Sequence
  Synthetic Construct
tgagcagtcctggtgctgta

SEQ ID NO: 4463 - DNA, 23 bp, Artificial Sequence
  Synthetic Construct
agaggagcagtgagtcctagttg

SEQ ID NO: 4464 - DNA, 24 bp, Artificial Sequence
  Synthetic Construct
cacgtgaaatgaattgccttctgt

SEQ ID NO: 4465 - DNA, 23 bp, Artificial Sequence
  Synthetic Construct
gcccaggactctctgacttaagc

SEQ ID NO: 4466 - DNA, 22 bp, Artificial Sequence
  Synthetic Construct
ttccacctcacattggcttctg

SEQ ID NO: 4467 - DNA, 22 bp, Artificial Sequence
  Synthetic Construct
gttgaggtctgctgtggtctaa

SEQ ID NO: 4468 - DNA, 29 bp, Artificial Sequence
  Synthetic Construct
cgaaagtgagacattatcagcatatatgg

SEQ ID NO: 4469 - DNA, 21 bp, Artificial Sequence
  Synthetic Construct
gaagaatggggcagacatgga

SEQ ID NO: 4470 - DNA, 21 bp, Artificial Sequence
  Synthetic Construct
actcctgcagctctctagtca

SEQ ID NO: 4471 - DNA, 22 bp, Artificial Sequence
  Synthetic Construct
tggcaatacagcagggcttcaa

SEQ ID NO: 4472 - DNA, 26 bp, Artificial Sequence
  Synthetic Construct
cccgtgaaagtcaagctattgattgc

SEQ ID NO: 4473 - DNA, 21 bp, Artificial Sequence
  Synthetic Construct
tgctgtcctggaggtgttgaa

SEQ ID NO: 4474 - DNA, 22 bp, Artificial Sequence
  Synthetic Construct
tgggcgcctaaacttcatcaca

SEQ ID NO: 4475 - DNA, 23 bp, Artificial Sequence
  Synthetic Construct
gacatgcatcacttctgctcaca

SEQ ID NO: 4476 - DNA, 20 bp, Artificial Sequence
  Synthetic Construct
ctcccccgaaacacctctct

SEQ ID NO: 4477 - DNA, 24 bp, Artificial Sequence
  Synthetic Construct
agataaggactccacagggactct

SEQ ID NO: 4478 - DNA, 22 bp, Artificial Sequence
  Synthetic Construct
ttgcccctgtttcagtgatgct

SEQ ID NO: 4479 - DNA, 21 bp, Artificial Sequence
  Synthetic Construct
cctggcacaagctgacacttt

SEQ ID NO: 4480 - DNA, 22 bp, Artificial Sequence
  Synthetic Construct
gtggtaggcgatgcatcttcaa

SEQ ID NO: 4481 - DNA, 20 bp, Artificial Sequence
  Synthetic Construct
aagcggagggggctttgtct

SEQ ID NO: 4482 - DNA, 21 bp, Artificial Sequence
  Synthetic Construct
gctgggtagcactcccttact

SEQ ID NO: 4483 - DNA, 22 bp, Artificial Sequence
  Synthetic Construct
gagagcggacttttctcccaat

SEQ ID NO: 4484 - DNA, 28 bp, Artificial Sequence
  Synthetic Construct
agtatgcgttgttagatgtttcaattcc

SEQ ID NO: 4485 - DNA, 26 bp, Artificial Sequence
  Synthetic Construct
catcatggttcatcatggttctcctt

SEQ ID NO: 4486 - DNA, 22 bp, Artificial Sequence
  Synthetic Construct
caccaagtcaccttctcccttt

SEQ ID NO: 4487 - DNA, 24 bp, Artificial Sequence
  Synthetic Construct
ctccctcttaacccaaggatacca

SEQ ID NO: 4488 - DNA, 26 bp, Artificial Sequence
  Synthetic Construct
ggctaccctgacaacttaaacagtct

SEQ ID NO: 4489 - DNA, 24 bp, Artificial Sequence
  Synthetic Construct
acctgtgaaagaccactgcatacc

SEQ ID NO: 4490 - DNA, 24 bp, Artificial Sequence
  Synthetic Construct
agctagacagagctgcacaagatg

SEQ ID NO: 4491 - DNA, 20 bp, Artificial Sequence
  Synthetic Construct
caacctcatggctggcatgt

SEQ ID NO: 4492 - DNA, 18 bp, Artificial Sequence
  Synthetic Construct
tcttcacccgcccatcca

SEQ ID NO: 4493 - DNA, 26 bp, Artificial Sequence
  Synthetic Construct
ggtcttcacccttgagagatgtaggt

SEQ ID NO: 4494 - DNA, 22 bp, Artificial Sequence
  Synthetic Construct
gctccacaaatcttgcccctat

SEQ ID NO: 4495 - DNA, 21 bp, Artificial Sequence
  Synthetic Construct
agcgccctagtccaaagacaa

SEQ ID NO: 4496 - DNA, 22 bp, Artificial Sequence
  Synthetic Construct
gtgccaaacacagagcttcatg

SEQ ID NO: 4497 - DNA, 28 bp, Artificial Sequence
  Synthetic Construct
ctaatgtggtacttagctcacagtaagt

SEQ ID NO: 4498 - DNA, 25 bp, Artificial Sequence
  Synthetic Construct
acagaggaccacaataaccttatcc

SEQ ID NO: 4499 - DNA, 24 bp, Artificial Sequence
  Synthetic Construct
cagagattggcactcttccctctt

SEQ ID NO: 4500 - DNA, 20 bp, Artificial Sequence
  Synthetic Construct
ctgctgaggcctgagacatg

SEQ ID NO: 4501 - DNA, 21 bp, Artificial Sequence
  Synthetic Construct
accctgcagttgacaatttgc

SEQ ID NO: 4502 - DNA, 30 bp, Artificial Sequence
  Synthetic Construct
gggagaggaagtatatgagtgtgaattagg

SEQ ID NO: 4503 - DNA, 28 bp, Artificial Sequence
  Synthetic Construct
ccaactacaagtccctagctcttttctc

SEQ ID NO: 4504 - DNA, 25 bp, Artificial Sequence
  Synthetic Construct
actaatattcactggccaactgtga

SEQ ID NO: 4505 - DNA, 23 bp, Artificial Sequence
  Synthetic Construct
acctgtaactccctgaggcagaa

SEQ ID NO: 4506 - DNA, 22 bp, Artificial Sequence
  Synthetic Construct
agagatagcccatcccagttgt

SEQ ID NO: 4507 - DNA, 25 bp, Artificial Sequence
  Synthetic Construct
gtgagtagcatgccttcattgaatc

SEQ ID NO: 4508 - DNA, 19 bp, Artificial Sequence
  Synthetic Construct
tggagaggggtggcttgct

SEQ ID NO: 4509 - DNA, 23 bp, Artificial Sequence
  Synthetic Construct
aaaacaatgtccctgcactcaag

SEQ ID NO: 4510 - DNA, 24 bp, Artificial Sequence
  Synthetic Construct
gacatgaccaggaagcatctctca

SEQ ID NO: 4511 - DNA, 19 bp, Artificial Sequence
  Synthetic Construct
acccgctccacacacacaa

SEQ ID NO: 4512 - DNA, 23 bp, Artificial Sequence
  Synthetic Construct
aggcctctcattgatcttttgct

SEQ ID NO: 4513 - DNA, 24 bp, Artificial Sequence
  Synthetic Construct
ccgaggaactatacccacttggtt

SEQ ID NO: 4514 - DNA, 21 bp, Artificial Sequence
  Synthetic Construct
cgtctcactgctgtcttctgt

SEQ ID NO: 4515 - DNA, 22 bp, Artificial Sequence
  Synthetic Construct
gcaaccccctctttaactttgc

SEQ ID NO: 4516 - DNA, 24 bp, Artificial Sequence
  Synthetic Construct
aggggatgaccaaccctgatcata

SEQ ID NO: 4517 - DNA, 26 bp, Artificial Sequence
  Synthetic Construct
cccaggttaatgagtagtaagtgtca

SEQ ID NO: 4518 - DNA, 27 bp, Artificial Sequence
  Synthetic Construct
ggcttcattcatcacatgactctgtga

SEQ ID NO: 4519 - DNA, 19 bp, Artificial Sequence
  Synthetic Construct
acgtggctgccttcatcct

SEQ ID NO: 4520 - DNA, 26 bp, Artificial Sequence
  Synthetic Construct
cagagaaaaatagctgtccccattgg

SEQ ID NO: 4521 - DNA, 21 bp, Artificial Sequence
  Synthetic Construct
attaagctgcacccacacact

SEQ ID NO: 4522 - DNA, 22 bp, Artificial Sequence
  Synthetic Construct
gggcgtttttgtccttcttggt

SEQ ID NO: 4523 - DNA, 21 bp, Artificial Sequence
  Synthetic Construct
aaggtggatgtgctcagcaat

SEQ ID NO: 4524 - DNA, 24 bp, Artificial Sequence
  Synthetic Construct
catcttggtttcttccctttgcaa

SEQ ID NO: 4525 - DNA, 26 bp, Artificial Sequence
  Synthetic Construct
gacttattgcctcaaacctctacact

SEQ ID NO: 4526 - DNA, 24 bp, Artificial Sequence
  Synthetic Construct
cgctggagattgagggtggaatta

SEQ ID NO: 4527 - DNA, 24 bp, Artificial Sequence
  Synthetic Construct
tcttgccatcaccatcagtcataa

SEQ ID NO: 4528 - DNA, 20 bp, Artificial Sequence
  Synthetic Construct
atgggcttaagggggtggaa

SEQ ID NO: 4529 - DNA, 22 bp, Artificial Sequence
  Synthetic Construct
actgtcagaatcccaggcagta

SEQ ID NO: 4530 - DNA, 22 bp, Artificial Sequence
  Synthetic Construct
tccggggaagaacattttgaca

SEQ ID NO: 4531 - DNA, 23 bp, Artificial Sequence
  Synthetic Construct
ggtaggagatggagccaatgaag

SEQ ID NO: 4532 - DNA, 19 bp, Artificial Sequence
  Synthetic Construct
gcgcaagacagcagaaacc

SEQ ID NO: 4533 - DNA, 24 bp, Artificial Sequence
  Synthetic Construct
ctcagactgtggcttatgatgtct

SEQ ID NO: 4534 - DNA, 26 bp, Artificial Sequence
  Synthetic Construct
agtgacaacacaactttgaagatgag

SEQ ID NO: 4535 - DNA, 26 bp, Artificial Sequence
  Synthetic Construct
cgggcagtaagaaatttcttgccaat

SEQ ID NO: 4536 - DNA, 22 bp, Artificial Sequence
  Synthetic Construct
gtccgaaagagagcaaggagtt

SEQ ID NO: 4537 - DNA, 20 bp, Artificial Sequence
  Synthetic Construct
accaggcagaccccatcagt

SEQ ID NO: 4538 - DNA, 22 bp, Artificial Sequence
  Synthetic Construct
aaactccctgagtctccgtgaa

SEQ ID NO: 4539 - DNA, 22 bp, Artificial Sequence
  Synthetic Construct
gcatctggcacctttctcaagt

SEQ ID NO: 4540 - DNA, 24 bp, Artificial Sequence
  Synthetic Construct
ctttctaagcagggtggacatcag

SEQ ID NO: 4541 - DNA, 23 bp, Artificial Sequence
  Synthetic Construct
tgacaaacacccaaggtaaacca

SEQ ID NO: 4542 - DNA, 22 bp, Artificial Sequence
  Synthetic Construct
tctcatgtcccagaccctactg

SEQ ID NO: 4543 - DNA, 22 bp, Artificial Sequence
  Synthetic Construct
ggacccgctgcatggaaattaa

SEQ ID NO: 4544 - DNA, 26 bp, Artificial Sequence
  Synthetic Construct
tgtcagttaagcaagtgttcctatct

SEQ ID NO: 4545 - DNA, 24 bp, Artificial Sequence
  Synthetic Construct
gctcacttgaggctcacttactgt

SEQ ID NO: 4546 - DNA, 26 bp, Artificial Sequence
  Synthetic Construct
gtgtttaggccaagtaggagacttct

SEQ ID NO: 4547 - DNA, 20 bp, Artificial Sequence
  Synthetic Construct
caagggttgggtgcagagaa

SEQ ID NO: 4548 - DNA, 22 bp, Artificial Sequence
  Synthetic Construct
tccttatgggatggctgtgttg

SEQ ID NO: 4549 - DNA, 23 bp, Artificial Sequence
  Synthetic Construct
gttgtgtgagtgagccaaatcac

SEQ ID NO: 4550 - DNA, 25 bp, Artificial Sequence
  Synthetic Construct
gtctagatcctgactcactgcttag

SEQ ID NO: 4551 - DNA, 19 bp, Artificial Sequence
  Synthetic Construct
tgctgccccaagctcctta

SEQ ID NO: 4552 - DNA, 27 bp, Artificial Sequence
  Synthetic Construct
cctgaaatacctagatcctctctttgc

SEQ ID NO: 4553 - DNA, 28 bp, Artificial Sequence
  Synthetic Construct
ggctgagaggatgaaatacttgtagtca

SEQ ID NO: 4554 - DNA, 20 bp, Artificial Sequence
  Synthetic Construct
gtggtgccactcttggaact

SEQ ID NO: 4555 - DNA, 24 bp, Artificial Sequence
  Synthetic Construct
catcgtgggagcatttacctaagg

SEQ ID NO: 4556 - DNA, 23 bp, Artificial Sequence
  Synthetic Construct
tcagcatcactaacgaggtcttc

SEQ ID NO: 4557 - DNA, 25 bp, Artificial Sequence
  Synthetic Construct
caccatgggaatgatctgtgtactg

SEQ ID NO: 4558 - DNA, 22 bp, Artificial Sequence
  Synthetic Construct
cacttgtggcccccatgtttat

SEQ ID NO: 4559 - DNA, 25 bp, Artificial Sequence
  Synthetic Construct
tcctaagtattcaggaggctgaagt

SEQ ID NO: 4560 - DNA, 27 bp, Artificial Sequence
  Synthetic Construct
gggctgcacatttgattatcattgtgt

SEQ ID NO: 4561 - DNA, 22 bp, Artificial Sequence
  Synthetic Construct
aaagccatggtggggtgtgaga

SEQ ID NO: 4562 - DNA, 21 bp, Artificial Sequence
  Synthetic Construct
actgctggctgctcaaagcta

SEQ ID NO: 4563 - DNA, 24 bp, Artificial Sequence
  Synthetic Construct
agctggggagacttagtcagatga

SEQ ID NO: 4564 - DNA, 24 bp, Artificial Sequence
  Synthetic Construct
tgagctgaagttcttgctgagatt

SEQ ID NO: 4565 - DNA, 22 bp, Artificial Sequence
  Synthetic Construct
tgcaggaagccacacagaagtt

SEQ ID NO: 4566 - DNA, 30 bp, Artificial Sequence
  Synthetic Construct
gcctaaaatatttgctgtctggccttttac

SEQ ID NO: 4567 - DNA, 24 bp, Artificial Sequence
  Synthetic Construct
aggcatggtcagaagggttaagag

SEQ ID NO: 4568 - DNA, 23 bp, Artificial Sequence
  Synthetic Construct
tccagatgtcccatggagtagga

SEQ ID NO: 4569 - DNA, 22 bp, Artificial Sequence
  Synthetic Construct
gcttggctccatctgaaattcc

SEQ ID NO: 4570 - DNA, 19 bp, Artificial Sequence
  Synthetic Construct
cctgctcaggccattccaa

SEQ ID NO: 4571 - DNA, 21 bp, Artificial Sequence
  Synthetic Construct
aagccttccagactgggcaaa

SEQ ID NO: 4572 - DNA, 24 bp, Artificial Sequence
  Synthetic Construct
ggactcaacacccaattccagaga

SEQ ID NO: 4573 - DNA, 22 bp, Artificial Sequence
  Synthetic Construct
ctgagccacagaacacacaagt

SEQ ID NO: 4574 - DNA, 25 bp, Artificial Sequence
  Synthetic Construct
gcacgtatgtgtgttgatggacata

SEQ ID NO: 4575 - DNA, 26 bp, Artificial Sequence
  Synthetic Construct
gttgcactacaaggtagattgggtta

SEQ ID NO: 4576 - DNA, 22 bp, Artificial Sequence
  Synthetic Construct
gacaagggcttgaggttacaca

SEQ ID NO: 4577 - DNA, 22 bp, Artificial Sequence
  Synthetic Construct
tcgtggatttgtcgttctttgc

SEQ ID NO: 4578 - DNA, 26 bp, Artificial Sequence
  Synthetic Construct
actgtaacaatgttaagaggcacaga

SEQ ID NO: 4579 - DNA, 30 bp, Artificial Sequence
  Synthetic Construct
gttgtccttaatatgccatagtcattcatg

SEQ ID NO: 4580 - DNA, 22 bp, Artificial Sequence
  Synthetic Construct
tcacagacagcagatccctgat

SEQ ID NO: 4581 - DNA, 29 bp, Artificial Sequence
  Synthetic Construct
gaacttatgctgagattccattaattcca

SEQ ID NO: 4582 - DNA, 28 bp, Artificial Sequence
  Synthetic Construct
agtaaatcaatgtcactggatccatgaa

SEQ ID NO: 4583 - DNA, 24 bp, Artificial Sequence
  Synthetic Construct
ggtgaccaacttgtcctgaggaaa

SEQ ID NO: 4584 - DNA, 24 bp, Artificial Sequence
  Synthetic Construct
ggtaggagttgggggaaaatgaaa

SEQ ID NO: 4585 - DNA, 22 bp, Artificial Sequence
  Synthetic Construct
gatgtcaccgccacttttaagc

SEQ ID NO: 4586 - DNA, 22 bp, Artificial Sequence
  Synthetic Construct
tgcacacttcctcggaaaacag

SEQ ID NO: 4587 - DNA, 26 bp, Artificial Sequence
  Synthetic Construct
ggtgtcagatttcattcagagaggat

SEQ ID NO: 4588 - DNA, 28 bp, Artificial Sequence
  Synthetic Construct
ccaaggttcttttcactatgtcctagct

SEQ ID NO: 4589 - DNA, 19 bp, Artificial Sequence
  Synthetic Construct
agggccacatcccccacaa

SEQ ID NO: 4590 - DNA, 25 bp, Artificial Sequence
  Synthetic Construct
gtgggagctctaacttgacactatt

SEQ ID NO: 4591 - DNA, 22 bp, Artificial Sequence
  Synthetic Construct
cctacacctgcttcctgtcctt

SEQ ID NO: 4592 - DNA, 23 bp, Artificial Sequence
  Synthetic Construct
accaactctgcgtatctggaatg

SEQ ID NO: 4593 - DNA, 21 bp, Artificial Sequence
  Synthetic Construct
ggcctcctagaccacttcaga

SEQ ID NO: 4594 - DNA, 25 bp, Artificial Sequence
  Synthetic Construct
tgctcctagaataaggacacactca

SEQ ID NO: 4595 - DNA, 25 bp, Artificial Sequence
  Synthetic Construct
cccaaggaccatatgtaacctacca

SEQ ID NO: 4596 - DNA, 22 bp, Artificial Sequence
  Synthetic Construct
cctgaacaaagacagcccaatg

SEQ ID NO: 4597 - DNA, 22 bp, Artificial Sequence
  Synthetic Construct
aaatgtcctcccacaggcactt

SEQ ID NO: 4598 - DNA, 24 bp, Artificial Sequence
  Synthetic Construct
cacatcagttctgtgggagatacc

SEQ ID NO: 4599 - DNA, 20 bp, Artificial Sequence
  Synthetic Construct
cacgtggttgtggggaacaa

SEQ ID NO: 4600 - DNA, 25 bp, Artificial Sequence
  Synthetic Construct
tccccatcaccttattttgacaaga

SEQ ID NO: 4601 - DNA, 23 bp, Artificial Sequence
  Synthetic Construct
gtcaacccgaatagctcctttct

SEQ ID NO: 4602 - DNA, 28 bp, Artificial Sequence
  Synthetic Construct
agagaattgagttatgctgccataaatc

SEQ ID NO: 4603 - DNA, 20 bp, Artificial Sequence
  Synthetic Construct
ccatgtggcaggaagaacca

SEQ ID NO: 4604 - DNA, 26 bp, Artificial Sequence
  Synthetic Construct
ccttgaaaggaatggacctagacatg

SEQ ID NO: 4605 - DNA, 24 bp, Artificial Sequence
  Synthetic Construct
ctccttctccaagacaggaaatcc

SEQ ID NO: 4606 - DNA, 24 bp, Artificial Sequence
  Synthetic Construct
ggacgccactttaaaatccaactg

SEQ ID NO: 4607 - DNA, 23 bp, Artificial Sequence
  Synthetic Construct
ttcctagccaggtgaccatctag

SEQ ID NO: 4608 - DNA, 21 bp, Artificial Sequence
  Synthetic Construct
tcctacctcatgcctgtcact

SEQ ID NO: 4609 - DNA, 25 bp, Artificial Sequence
  Synthetic Construct
ggatgattgccattttcctgaacac

SEQ ID NO: 4610 - DNA, 23 bp, Artificial Sequence
  Synthetic Construct
agaaagccacaatgttggagaga

SEQ ID NO: 4611 - DNA, 24 bp, Artificial Sequence
  Synthetic Construct
cctggtcaccatattccaggagta

SEQ ID NO: 4612 - DNA, 24 bp, Artificial Sequence
  Synthetic Construct
agacctagccatgggtactaagaa

SEQ ID NO: 4613 - DNA, 22 bp, Artificial Sequence
  Synthetic Construct
ccatctttgcacctccaagttg

SEQ ID NO: 4614 - DNA, 22 bp, Artificial Sequence
  Synthetic Construct
agcaacccacagaagccatgag

SEQ ID NO: 4615 - DNA, 20 bp, Artificial Sequence
  Synthetic Construct
ggtgcaagccattggtggtt

SEQ ID NO: 4616 - DNA, 27 bp, Artificial Sequence
  Synthetic Construct
caaggcatgtttatacaacaacaacag

SEQ ID NO: 4617 - DNA, 19 bp, Artificial Sequence
  Synthetic Construct
cagggcatggagggatgga

SEQ ID NO: 4618 - DNA, 24 bp, Artificial Sequence
  Synthetic Construct
ggaggtttctaactggtgggatgt

SEQ ID NO: 4619 - DNA, 26 bp, Artificial Sequence
  Synthetic Construct
gggagtactcaagctatgctgatgtg

SEQ ID NO: 4620 - DNA, 25 bp, Artificial Sequence
  Synthetic Construct
gcagtcatcatcaagttgagtctct

SEQ ID NO: 4621 - DNA, 21 bp, Artificial Sequence
  Synthetic Construct
aggaacttccagtgccaagga

SEQ ID NO: 4622 - DNA, 26 bp, Artificial Sequence
  Synthetic Construct
gtttttcaacccaattacctggatgt

SEQ ID NO: 4623 - DNA, 28 bp, Artificial Sequence
  Synthetic Construct
catctattacctgcattggttacattgc

SEQ ID NO: 4624 - DNA, 22 bp, Artificial Sequence
  Synthetic Construct
tccagagaggataggggatgtg

SEQ ID NO: 4625 - DNA, 22 bp, Artificial Sequence
  Synthetic Construct
agccaggcatccatacgaccta

SEQ ID NO: 4626 - DNA, 22 bp, Artificial Sequence
  Synthetic Construct
tgtttttccacttggcctagca

SEQ ID NO: 4627 - DNA, 26 bp, Artificial Sequence
  Synthetic Construct
ctcaggtccctattgctatggtaaag

SEQ ID NO: 4628 - DNA, 27 bp, Artificial Sequence
  Synthetic Construct
cactgaagccaaataaaccagaaacac

SEQ ID NO: 4629 - DNA, 26 bp, Artificial Sequence
  Synthetic Construct
cgtacatatggctattctggaactga

SEQ ID NO: 4630 - DNA, 23 bp, Artificial Sequence
  Synthetic Construct
tgagagaccctagaggcagctat

SEQ ID NO: 4631 - DNA, 24 bp, Artificial Sequence
  Synthetic Construct
ccttgaaagtaggcctgaagtagt

SEQ ID NO: 4632 - DNA, 23 bp, Artificial Sequence
  Synthetic Construct
cacaaaaccactacacccttcca

SEQ ID NO: 4633 - DNA, 24 bp, Artificial Sequence
  Synthetic Construct
gacaaaacacctgaggtcattggt

SEQ ID NO: 4634 - DNA, 21 bp, Artificial Sequence
  Synthetic Construct
aaagacggtccacctgaggtt

SEQ ID NO: 4635 - DNA, 22 bp, Artificial Sequence
  Synthetic Construct
agcgaacatgctgacacctact

SEQ ID NO: 4636 - DNA, 21 bp, Artificial Sequence
  Synthetic Construct
ccagggagagcaactgggttt

SEQ ID NO: 4637 - DNA, 19 bp, Artificial Sequence
  Synthetic Construct
aggcaatgggctcccttca

SEQ ID NO: 4638 - DNA, 26 bp, Artificial Sequence
  Synthetic Construct
tgattagatggccacaatgaattagc

SEQ ID NO: 4639 - DNA, 27 bp, Artificial Sequence
  Synthetic Construct
tcattcaatatgcccctgtgtttaatg

SEQ ID NO: 4640 - DNA, 21 bp, Artificial Sequence
  Synthetic Construct
gctccacactggcctctacaa

SEQ ID NO: 4641 - DNA, 22 bp, Artificial Sequence
  Synthetic Construct
cttcagctcaaccctccctttt

SEQ ID NO: 4642 - DNA, 24 bp, Artificial Sequence
  Synthetic Construct
ggtgtttctgcaaatggagcaaca

SEQ ID NO: 4643 - DNA, 26 bp, Artificial Sequence
  Synthetic Construct
cactctggtctactagtctggtatca

SEQ ID NO: 4644 - DNA, 22 bp, Artificial Sequence
  Synthetic Construct
agggcaaggagaatcctgactt

SEQ ID NO: 4645 - DNA, 26 bp, Artificial Sequence
  Synthetic Construct
cgacaaattccttgaaacaagttgtg

SEQ ID NO: 4646 - DNA, 21 bp, Artificial Sequence
  Synthetic Construct
tgcagtcattgggcccattgt

SEQ ID NO: 4647 - DNA, 19 bp, Artificial Sequence
  Synthetic Construct
aaaggagctggggcaatgc

SEQ ID NO: 4648 - DNA, 21 bp, Artificial Sequence
  Synthetic Construct
tgggcaggcagcttagtacat

SEQ ID NO: 4649 - DNA, 25 bp, Artificial Sequence
  Synthetic Construct
actttcatctaccccttgacatctc

SEQ ID NO: 4650 - DNA, 28 bp, Artificial Sequence
  Synthetic Construct
ggcttacacactttactgtcacacttag

SEQ ID NO: 4651 - DNA, 18 bp, Artificial Sequence
  Synthetic Construct
ctggcctctgggggtaca

SEQ ID NO: 4652 - DNA, 22 bp, Artificial Sequence
  Synthetic Construct
gtgggaatccatgaagctagct

SEQ ID NO: 4653 - DNA, 22 bp, Artificial Sequence
  Synthetic Construct
cacctggcaggaatgatggttt

SEQ ID NO: 4654 - DNA, 25 bp, Artificial Sequence
  Synthetic Construct
aaatgcttcaacacatcccttgaaa

SEQ ID NO: 4655 - DNA, 20 bp, Artificial Sequence
  Synthetic Construct
gcctctgccacttgctctgt

SEQ ID NO: 4656 - DNA, 20 bp, Artificial Sequence
  Synthetic Construct
acaccatcccctgagtgaca

SEQ ID NO: 4657 - DNA, 23 bp, Artificial Sequence
  Synthetic Construct
tccttcccagaccctatgctctt

SEQ ID NO: 4658 - DNA, 20 bp, Artificial Sequence
  Synthetic Construct
aactggagctggagcagttg

SEQ ID NO: 4659 - DNA, 27 bp, Artificial Sequence
  Synthetic Construct
gcaaacatccagtgaccttacatattg

SEQ ID NO: 4660 - DNA, 25 bp, Artificial Sequence
  Synthetic Construct
cagagtctctgaccatggattacac

SEQ ID NO: 4661 - DNA, 26 bp, Artificial Sequence
  Synthetic Construct
agtaacaggacagatgtcaattccat

SEQ ID NO: 4662 - DNA, 23 bp, Artificial Sequence
  Synthetic Construct
ctctactttcccacaggctttct

SEQ ID NO: 4663 - DNA, 22 bp, Artificial Sequence
  Synthetic Construct
atgctcttaggcatgggaagtc

SEQ ID NO: 4664 - DNA, 20 bp, Artificial Sequence
  Synthetic Construct
cagctcaggactgcagaaca

SEQ ID NO: 4665 - DNA, 21 bp, Artificial Sequence
  Synthetic Construct
acccacccagcttggaaaagg

SEQ ID NO: 4666 - DNA, 25 bp, Artificial Sequence
  Synthetic Construct
accctatagcctttatcagcaagga

SEQ ID NO: 4667 - DNA, 21 bp, Artificial Sequence
  Synthetic Construct
agaaccctggaatggcttcct

SEQ ID NO: 4668 - DNA, 20 bp, Artificial Sequence
  Synthetic Construct
gcgggtgacgttaggagaca

SEQ ID NO: 4669 - DNA, 20 bp, Artificial Sequence
  Synthetic Construct
aaggcagggacttggtgact

SEQ ID NO: 4670 - DNA, 22 bp, Artificial Sequence
  Synthetic Construct
aagctggctccactgagagaat

SEQ ID NO: 4671 - DNA, 19 bp, Artificial Sequence
  Synthetic Construct
cccccagcagtttgcatca

SEQ ID NO: 4672 - DNA, 19 bp, Artificial Sequence
  Synthetic Construct
ggtgccagttctgctgcat

SEQ ID NO: 4673 - DNA, 25 bp, Artificial Sequence
  Synthetic Construct
gtgcactacagctactttctgaagt

SEQ ID NO: 4674 - DNA, 25 bp, Artificial Sequence
  Synthetic Construct
ttcctacaccctcattcagttgttt

SEQ ID NO: 4675 - DNA, 19 bp, Artificial Sequence
  Synthetic Construct
ccggtcctcactgcctctt

SEQ ID NO: 4676 - DNA, 22 bp, Artificial Sequence
  Synthetic Construct
tcagtggtcgctcatctttgaa

SEQ ID NO: 4677 - DNA, 23 bp, Artificial Sequence
  Synthetic Construct
cctagaaaacggcttgtcatgga

SEQ ID NO: 4678 - DNA, 22 bp, Artificial Sequence
  Synthetic Construct
gggtaagctcacatgctctcat

SEQ ID NO: 4679 - DNA, 21 bp, Artificial Sequence
  Synthetic Construct
ctgggagcactccttgtcttt

SEQ ID NO: 4680 - DNA, 21 bp, Artificial Sequence
  Synthetic Construct
acaggccacccagagtaagac

SEQ ID NO: 4681 - DNA, 22 bp, Artificial Sequence
  Synthetic Construct
aagccagttttgctccctttgc

SEQ ID NO: 4682 - DNA, 28 bp, Artificial Sequence
  Synthetic Construct
tgcttttacttgagttatagctcagtca

SEQ ID NO: 4683 - DNA, 21 bp, Artificial Sequence
  Synthetic Construct
tctgcccatcaaaaccaacca

SEQ ID NO: 4684 - DNA, 22 bp, Artificial Sequence
  Synthetic Construct
agctcacccaatacctgtggaa

SEQ ID NO: 4685 - DNA, 26 bp, Artificial Sequence
  Synthetic Construct
gcaggagtgcattaagagtcaactag

SEQ ID NO: 4686 - DNA, 26 bp, Artificial Sequence
  Synthetic Construct
ctgaaatcctattgagtgtggatgca

SEQ ID NO: 4687 - DNA, 26 bp, Artificial Sequence
  Synthetic Construct
ccactcttagggagccatttcttacc

SEQ ID NO: 4688 - DNA, 21 bp, Artificial Sequence
  Synthetic Construct
tccatcacctgctagctgtga

SEQ ID NO: 4689 - DNA, 23 bp, Artificial Sequence
  Synthetic Construct
catcagtgtcagtgcagaacttg

SEQ ID NO: 4690 - DNA, 20 bp, Artificial Sequence
  Synthetic Construct
tgcggctgtgtgttaacaga

SEQ ID NO: 4691 - DNA, 20 bp, Artificial Sequence
  Synthetic Construct
acaaaacaggggcccatgga

SEQ ID NO: 4692 - DNA, 26 bp, Artificial Sequence
  Synthetic Construct
gaatgatgggagacagttttttagca

SEQ ID NO: 4693 - DNA, 19 bp, Artificial Sequence
  Synthetic Construct
agtggctggccggatccta

SEQ ID NO: 4694 - DNA, 25 bp, Artificial Sequence
  Synthetic Construct
gctaggtaggaggcaaattgtctca

SEQ ID NO: 4695 - DNA, 22 bp, Artificial Sequence
  Synthetic Construct
tctgccacccctcatgttctct

SEQ ID NO: 4696 - DNA, 22 bp, Artificial Sequence
  Synthetic Construct
tgcagtgggtcttctgattctg

SEQ ID NO: 4697 - DNA, 20 bp, Artificial Sequence
  Synthetic Construct
ggagaccccggcataagtct

SEQ ID NO: 4698 - DNA, 18 bp, Artificial Sequence
  Synthetic Construct
aggaggggcccacgctaa

SEQ ID NO: 4699 - DNA, 24 bp, Artificial Sequence
  Synthetic Construct
tggccttatcacagtctcttctct

SEQ ID NO: 4700 - DNA, 25 bp, Artificial Sequence
  Synthetic Construct
cctgagagtgtacttgttagttggt

SEQ ID NO: 4701 - DNA, 21 bp, Artificial Sequence
  Synthetic Construct
cgggagcttacttgcttctgt

SEQ ID NO: 4702 - DNA, 25 bp, Artificial Sequence
  Synthetic Construct
tcacaaatacagtggctaggtcatg

SEQ ID NO: 4703 - DNA, 22 bp, Artificial Sequence
  Synthetic Construct
tcctgagggccagtgaccttat

SEQ ID NO: 4704 - DNA, 22 bp, Artificial Sequence
  Synthetic Construct
gagctcactcctctcttttgca

SEQ ID NO: 4705 - DNA, 30 bp, Artificial Sequence
  Synthetic Construct
gccagtatcccatgtgaaatagactattgg

SEQ ID NO: 4706 - DNA, 18 bp, Artificial Sequence
  Synthetic Construct
cctgacccaggccagtct

SEQ ID NO: 4707 - DNA, 24 bp, Artificial Sequence
  Synthetic Construct
cctgttgtggttcgatggtttagc

SEQ ID NO: 4708 - DNA, 22 bp, Artificial Sequence
  Synthetic Construct
gtctcctttgctgcaggctttt

SEQ ID NO: 4709 - DNA, 20 bp, Artificial Sequence
  Synthetic Construct
ggggctacctttccctttcc

SEQ ID NO: 4710 - DNA, 22 bp, Artificial Sequence
  Synthetic Construct
gcttgtggtgatcgcttaaagg

SEQ ID NO: 4711 - DNA, 22 bp, Artificial Sequence
  Synthetic Construct
gcaaatctgcaacctggaagga

SEQ ID NO: 4712 - DNA, 22 bp, Artificial Sequence
  Synthetic Construct
tgttcagggcatgatcctgttc

SEQ ID NO: 4713 - DNA, 22 bp, Artificial Sequence
  Synthetic Construct
accacggtgctttctggaatgt

SEQ ID NO: 4714 - DNA, 26 bp, Artificial Sequence
  Synthetic Construct
gtccacaatacagagagtctcttctc

SEQ ID NO: 4715 - DNA, 23 bp, Artificial Sequence
  Synthetic Construct
aggttccagcaggtgtagaatgg

SEQ ID NO: 4716 - DNA, 22 bp, Artificial Sequence
  Synthetic Construct
tcactcggtctcagcgttagat

SEQ ID NO: 4717 - DNA, 26 bp, Artificial Sequence
  Synthetic Construct
ccaataaaatctgggggcttctcagt

SEQ ID NO: 4718 - DNA, 24 bp, Artificial Sequence
  Synthetic Construct
acggagcaagatcagcttcagtag

SEQ ID NO: 4719 - DNA, 24 bp, Artificial Sequence
  Synthetic Construct
gcagtctctatggggtcatagttg

SEQ ID NO: 4720 - DNA, 24 bp, Artificial Sequence
  Synthetic Construct
acttttctgcagtgatctccatct

SEQ ID NO: 4721 - DNA, 23 bp, Artificial Sequence
  Synthetic Construct
gcccagtcaagtctgtacccttt

SEQ ID NO: 4722 - DNA, 27 bp, Artificial Sequence
  Synthetic Construct
cccatttggaggtgaggaaatgtagtc

SEQ ID NO: 4723 - DNA, 24 bp, Artificial Sequence
  Synthetic Construct
tgagagctgaaatcaacactgctt

SEQ ID NO: 4724 - DNA, 20 bp, Artificial Sequence
  Synthetic Construct
acctgggcctgcctgtatga

SEQ ID NO: 4725 - DNA, 25 bp, Artificial Sequence
  Synthetic Construct
tctccagtttatagtgggtgagact

SEQ ID NO: 4726 - DNA, 24 bp, Artificial Sequence
  Synthetic Construct
ggtcactctatgtccctctgtgta

SEQ ID NO: 4727 - DNA, 24 bp, Artificial Sequence
  Synthetic Construct
gctcagctgtaggagatttgttct

SEQ ID NO: 4728 - DNA, 22 bp, Artificial Sequence
  Synthetic Construct
actgtttctgtcagggccagat

SEQ ID NO: 4729 - DNA, 23 bp, Artificial Sequence
  Synthetic Construct
ccttgcttttggtctggttttgg

SEQ ID NO: 4730 - DNA, 20 bp, Artificial Sequence
  Synthetic Construct
tggcgtgggcgtgttagaag

SEQ ID NO: 4731 - DNA, 26 bp, Artificial Sequence
  Synthetic Construct
ggtaggtagagggtaggttttgtaca

SEQ ID NO: 4732 - DNA, 22 bp, Artificial Sequence
  Synthetic Construct
gctttaggaatgcctgggatga

SEQ ID NO: 4733 - DNA, 28 bp, Artificial Sequence
  Synthetic Construct
ccaaactcttcccctaggttttatttgg

SEQ ID NO: 4734 - DNA, 28 bp, Artificial Sequence
  Synthetic Construct
ccctctagaaacctgtcttcatgggtta

SEQ ID NO: 4735 - DNA, 22 bp, Artificial Sequence
  Synthetic Construct
gggtccaatggcatttcagtga

SEQ ID NO: 4736 - DNA, 26 bp, Artificial Sequence
  Synthetic Construct
cctcagggactaagttctccatttcc

SEQ ID NO: 4737 - DNA, 22 bp, Artificial Sequence
  Synthetic Construct
gtgggaaggaaatgggacagat

SEQ ID NO: 4738 - DNA, 23 bp, Artificial Sequence
  Synthetic Construct
ctctgttctgccttgctgaaagt

SEQ ID NO: 4739 - DNA, 22 bp, Artificial Sequence
  Synthetic Construct
tggggtcacttggaagattgga

SEQ ID NO: 4740 - DNA, 24 bp, Artificial Sequence
  Synthetic Construct
tgtagccatttcccctatctaggt

SEQ ID NO: 4741 - DNA, 25 bp, Artificial Sequence
  Synthetic Construct
cttcaggcttggactagaagtacac

SEQ ID NO: 4742 - DNA, 24 bp, Artificial Sequence
  Synthetic Construct
ccagatcttcattgcgcctctgat

SEQ ID NO: 4743 - DNA, 26 bp, Artificial Sequence
  Synthetic Construct
ccaaccagctatgctaccatttctac

SEQ ID NO: 4744 - DNA, 26 bp, Artificial Sequence
  Synthetic Construct
gagagatggttcctatctctgaagct

SEQ ID NO: 4745 - DNA, 25 bp, Artificial Sequence
  Synthetic Construct
ctgttgattggtgtgaatggtagga

SEQ ID NO: 4746 - DNA, 23 bp, Artificial Sequence
  Synthetic Construct
cacaatacctgaggcacctagtg

SEQ ID NO: 4747 - DNA, 19 bp, Artificial Sequence
  Synthetic Construct
gctgagccactgcctcaca

SEQ ID NO: 4748 - DNA, 20 bp, Artificial Sequence
  Synthetic Construct
aggccatcgttgaagccaat

SEQ ID NO: 4749 - DNA, 26 bp, Artificial Sequence
  Synthetic Construct
tggaaaacccttcattcaaagtctga

SEQ ID NO: 4750 - DNA, 20 bp, Artificial Sequence
  Synthetic Construct
cacccgagctgttgtttgga

SEQ ID NO: 4751 - DNA, 20 bp, Artificial Sequence
  Synthetic Construct
gtgtctgctcagcacatggt

SEQ ID NO: 4752 - DNA, 21 bp, Artificial Sequence
  Synthetic Construct
tctctctgggcctcagaccat

SEQ ID NO: 4753 - DNA, 22 bp, Artificial Sequence
  Synthetic Construct
acagcccaccacagagattcat

SEQ ID NO: 4754 - DNA, 19 bp, Artificial Sequence
  Synthetic Construct
accgcactgcactgtggtt

SEQ ID NO: 4755 - DNA, 24 bp, Artificial Sequence
  Synthetic Construct
gtgaacagtgtctagggttttggt

SEQ ID NO: 4756 - DNA, 21 bp, Artificial Sequence
  Synthetic Construct
cgctcctctctcaccacctaa

SEQ ID NO: 4757 - DNA, 19 bp, Artificial Sequence
  Synthetic Construct
agcaagcaagcagcacact

SEQ ID NO: 4758 - DNA, 18 bp, Artificial Sequence
  Synthetic Construct
aggtgcagccccaagtga

SEQ ID NO: 4759 - DNA, 23 bp, Artificial Sequence
  Synthetic Construct
gtcttctcttctcaccccctact

SEQ ID NO: 4760 - DNA, 21 bp, Artificial Sequence
  Synthetic Construct
tgcttctccgtcacagctaag

SEQ ID NO: 4761 - DNA, 25 bp, Artificial Sequence
  Synthetic Construct
gctggccctttaaatatcccagaga

SEQ ID NO: 4762 - DNA, 22 bp, Artificial Sequence
  Synthetic Construct
tccagcagctagtaaggaagca

SEQ ID NO: 4763 - DNA, 21 bp, Artificial Sequence
  Synthetic Construct
tccccatgcacacaccctcta

SEQ ID NO: 4764 - DNA, 24 bp, Artificial Sequence
  Synthetic Construct
ttacattgacagcagggaacagat

SEQ ID NO: 4765 - DNA, 23 bp, Artificial Sequence
  Synthetic Construct
ccgaatggcgtcattgatgattt

SEQ ID NO: 4766 - DNA, 25 bp, Artificial Sequence
  Synthetic Construct
aaacctgaagagtacgtttggtttc

SEQ ID NO: 4767 - DNA, 20 bp, Artificial Sequence
  Synthetic Construct
gagccccagtctcctcttct

SEQ ID NO: 4768 - DNA, 25 bp, Artificial Sequence
  Synthetic Construct
gaggcactatcttgctaggatgtag

SEQ ID NO: 4769 - DNA, 26 bp, Artificial Sequence
  Synthetic Construct
aggttgattagtctctgtagtttgca

SEQ ID NO: 4770 - DNA, 26 bp, Artificial Sequence
  Synthetic Construct
gcttccattataggcttagcatctct

SEQ ID NO: 4771 - DNA, 27 bp, Artificial Sequence
  Synthetic Construct
gggagagaatgatcatcacttcttctc

SEQ ID NO: 4772 - DNA, 22 bp, Artificial Sequence
  Synthetic Construct
ctgtcactgacagtgctttcct

SEQ ID NO: 4773 - DNA, 22 bp, Artificial Sequence
  Synthetic Construct
tccatgataggggtgcattgca

SEQ ID NO: 4774 - DNA, 24 bp, Artificial Sequence
  Synthetic Construct
gagttctgagaaatagggcttgct

SEQ ID NO: 4775 - DNA, 20 bp, Artificial Sequence
  Synthetic Construct
tgattgtgccagctgactgt

SEQ ID NO: 4776 - DNA, 22 bp, Artificial Sequence
  Synthetic Construct
tgtgtcttctgtcccagagtca

SEQ ID NO: 4777 - DNA, 30 bp, Artificial Sequence
  Synthetic Construct
ggagagtagggatttttaccttttgcattc

SEQ ID NO: 4778 - DNA, 28 bp, Artificial Sequence
  Synthetic Construct
gtcattgacatggccacagagattaata

SEQ ID NO: 4779 - DNA, 23 bp, Artificial Sequence
  Synthetic Construct
gatattgccaaacgtccctcagt

SEQ ID NO: 4780 - DNA, 22 bp, Artificial Sequence
  Synthetic Construct
cagtgaatccaatgggccattg

SEQ ID NO: 4781 - DNA, 23 bp, Artificial Sequence
  Synthetic Construct
tgtctctgattgcctaggatggt

SEQ ID NO: 4782 - DNA, 26 bp, Artificial Sequence
  Synthetic Construct
aggagttaaataacttgcctgagcta

SEQ ID NO: 4783 - DNA, 23 bp, Artificial Sequence
  Synthetic Construct
tgctccaaccccacagtaaagtc

SEQ ID NO: 4784 - DNA, 22 bp, Artificial Sequence
  Synthetic Construct
gcagacaaggatccagttgcaa

SEQ ID NO: 4785 - DNA, 26 bp, Artificial Sequence
  Synthetic Construct
cgtgaacttcatcaacaccgaagtct

SEQ ID NO: 4786 - DNA, 22 bp, Artificial Sequence
  Synthetic Construct
ttcagatccctctgctggtaca

SEQ ID NO: 4787 - DNA, 20 bp, Artificial Sequence
  Synthetic Construct
ccagcaacagaaccgtctct

SEQ ID NO: 4788 - DNA, 19 bp, Artificial Sequence
  Synthetic Construct
aggagcccgtgcatttgct

SEQ ID NO: 4789 - DNA, 28 bp, Artificial Sequence
  Synthetic Construct
ggagataaccagaagtaaccatgaagct

SEQ ID NO: 4790 - DNA, 24 bp, Artificial Sequence
  Synthetic Construct
gacaatcagatggacctggtcttg

SEQ ID NO: 4791 - DNA, 22 bp, Artificial Sequence
  Synthetic Construct
tgctgctcaagtgtttccttct

SEQ ID NO: 4792 - DNA, 23 bp, Artificial Sequence
  Synthetic Construct
gctactctgcaatgtgccaacta

SEQ ID NO: 4793 - DNA, 25 bp, Artificial Sequence
  Synthetic Construct
agaacatttgttacaggcagaagtg

SEQ ID NO: 4794 - DNA, 22 bp, Artificial Sequence
  Synthetic Construct
tccacaatgggtgttgcatgtg

SEQ ID NO: 4795 - DNA, 20 bp, Artificial Sequence
  Synthetic Construct
gcatcctgggctccgaatgt

SEQ ID NO: 4796 - DNA, 27 bp, Artificial Sequence
  Synthetic Construct
tgggattttggctttctatcctttttg

SEQ ID NO: 4797 - DNA, 24 bp, Artificial Sequence
  Synthetic Construct
tctcagccaacattgagaggaaat

SEQ ID NO: 4798 - DNA, 22 bp, Artificial Sequence
  Synthetic Construct
tcgagtaacttgccaagggttt

SEQ ID NO: 4799 - DNA, 22 bp, Artificial Sequence
  Synthetic Construct
cacatccctcacaacctgttct

SEQ ID NO: 4800 - DNA, 22 bp, Artificial Sequence
  Synthetic Construct
tccaacagcaggtaggcaaatg

SEQ ID NO: 4801 - DNA, 21 bp, Artificial Sequence
  Synthetic Construct
ctgccaggttctcaggcattt

SEQ ID NO: 4802 - DNA, 22 bp, Artificial Sequence
  Synthetic Construct
tcaggcaggaactcttgctgta

SEQ ID NO: 4803 - DNA, 21 bp, Artificial Sequence
  Synthetic Construct
gatgaacccccaccctattgc

SEQ ID NO: 4804 - DNA, 29 bp, Artificial Sequence
  Synthetic Construct
gtcctggatataatttcaagactttgctt

SEQ ID NO: 4805 - DNA, 21 bp, Artificial Sequence
  Synthetic Construct
tcccacatcctgtcccattcc

SEQ ID NO: 4806 - DNA, 22 bp, Artificial Sequence
  Synthetic Construct
agggtgtgaaagaggaattgca

SEQ ID NO: 4807 - DNA, 24 bp, Artificial Sequence
  Synthetic Construct
ggccttatgtatagggaggaatgg

SEQ ID NO: 4808 - DNA, 23 bp, Artificial Sequence
  Synthetic Construct
aggcagagtctctctaccctttt

SEQ ID NO: 4809 - DNA, 21 bp, Artificial Sequence
  Synthetic Construct
tcaggaccctgggtactctct

SEQ ID NO: 4810 - DNA, 26 bp, Artificial Sequence
  Synthetic Construct
ccatcttaggtaccacagaaccttct

SEQ ID NO: 4811 - DNA, 22 bp, Artificial Sequence
  Synthetic Construct
gaagattcagcgccaagactca

SEQ ID NO: 4812 - DNA, 21 bp, Artificial Sequence
  Synthetic Construct
cgggcaaagcagaaggattcg

SEQ ID NO: 4813 - DNA, 27 bp, Artificial Sequence
  Synthetic Construct
tctacagatggaagtattctggacaag

SEQ ID NO: 4814 - DNA, 20 bp, Artificial Sequence
  Synthetic Construct
aaagctgggtggtgacgttt

SEQ ID NO: 4815 - DNA, 23 bp, Artificial Sequence
  Synthetic Construct
tgtaggcaaaaagctcaccctaa

SEQ ID NO: 4816 - DNA, 19 bp, Artificial Sequence
  Synthetic Construct
agcaccaccaccacgcaat

SEQ ID NO: 4817 - DNA, 21 bp, Artificial Sequence
  Synthetic Construct
atggggaagacagaggctcat

SEQ ID NO: 4818 - DNA, 24 bp, Artificial Sequence
  Synthetic Construct
tccctacctatacaccccaaaagg

SEQ ID NO: 4819 - DNA, 26 bp, Artificial Sequence
  Synthetic Construct
caaagatctttcatcatggccttcaa

SEQ ID NO: 4820 - DNA, 27 bp, Artificial Sequence
  Synthetic Construct
cccagagtacctatatattggccaatg

SEQ ID NO: 4821 - DNA, 19 bp, Artificial Sequence
  Synthetic Construct
agcacttccctggcaagca

SEQ ID NO: 4822 - DNA, 21 bp, Artificial Sequence
  Synthetic Construct
cacctgaggtggagtctagca

SEQ ID NO: 4823 - DNA, 22 bp, Artificial Sequence
  Synthetic Construct
ttctccagcatcacgtctctgt

SEQ ID NO: 4824 - DNA, 20 bp, Artificial Sequence
  Synthetic Construct
tgaccacaccccatcaggtt

SEQ ID NO: 4825 - DNA, 22 bp, Artificial Sequence
  Synthetic Construct
tctgcacttctacccaggcaat

SEQ ID NO: 4826 - DNA, 20 bp, Artificial Sequence
  Synthetic Construct
agcagagcctgaagcaatgg

SEQ ID NO: 4827 - DNA, 24 bp, Artificial Sequence
  Synthetic Construct
gtgcttttaccttcccactatgga

SEQ ID NO: 4828 - DNA, 24 bp, Artificial Sequence
  Synthetic Construct
gtgcaggagggttgtagacaagat

SEQ ID NO: 4829 - DNA, 27 bp, Artificial Sequence
  Synthetic Construct
gggcagtgtacaggcaaataaatcatc

SEQ ID NO: 4830 - DNA, 27 bp, Artificial Sequence
  Synthetic Construct
ttcattgtcaatcctggatctaagtgt

SEQ ID NO: 4831 - DNA, 19 bp, Artificial Sequence
  Synthetic Construct
gaggctcctccctgacaca

SEQ ID NO: 4832 - DNA, 27 bp, Artificial Sequence
  Synthetic Construct
gtaaatccaccagttacaattcccaat

SEQ ID NO: 4833 - DNA, 25 bp, Artificial Sequence
  Synthetic Construct
agataaaatcctccccactgagtct

SEQ ID NO: 4834 - DNA, 20 bp, Artificial Sequence
  Synthetic Construct
agtgtgctgagccttgtgtt

SEQ ID NO: 4835 - DNA, 29 bp, Artificial Sequence
  Synthetic Construct
agggcatatttaggaggttatctattcct

SEQ ID NO: 4836 - DNA, 19 bp, Artificial Sequence
  Synthetic Construct
aagggcctggagggtttgg

SEQ ID NO: 4837 - DNA, 24 bp, Artificial Sequence
  Synthetic Construct
gattcaagtagacagacccaagct

SEQ ID NO: 4838 - DNA, 25 bp, Artificial Sequence
  Synthetic Construct
ctgtgcagtttgtcctcctcatata

SEQ ID NO: 4839 - DNA, 22 bp, Artificial Sequence
  Synthetic Construct
aggaagaacagaggctgcatct

SEQ ID NO: 4840 - DNA, 25 bp, Artificial Sequence
  Synthetic Construct
gatatccaaggcctgaggatttcaa

SEQ ID NO: 4841 - DNA, 25 bp, Artificial Sequence
  Synthetic Construct
tgtgttctgtatgcattttgtgtgt

SEQ ID NO: 4842 - DNA, 24 bp, Artificial Sequence
  Synthetic Construct
ttggatccttctttccctcagttc

SEQ ID NO: 4843 - DNA, 27 bp, Artificial Sequence
  Synthetic Construct
cttgtaatgtcaccattttgtgaggat

SEQ ID NO: 4844 - DNA, 25 bp, Artificial Sequence
  Synthetic Construct
tctagtgacccaaaaacagcctaat

SEQ ID NO: 4845 - DNA, 24 bp, Artificial Sequence
  Synthetic Construct
ggtctgctgttttgcatgtttgct

SEQ ID NO: 4846 - DNA, 26 bp, Artificial Sequence
  Synthetic Construct
gacactgggtattaatggaggatctg

SEQ ID NO: 4847 - DNA, 28 bp, Artificial Sequence
  Synthetic Construct
ggagacaaacctgactagagttgagttg

SEQ ID NO: 4848 - DNA, 25 bp, Artificial Sequence
  Synthetic Construct
ccaagtgtgcttgtagctcattgag

SEQ ID NO: 4849 - DNA, 24 bp, Artificial Sequence
  Synthetic Construct
gtcgtattaggtgactgacactgt

SEQ ID NO: 4850 - DNA, 23 bp, Artificial Sequence
  Synthetic Construct
gcatgactaagcatgtgtttgca

SEQ ID NO: 4851 - DNA, 26 bp, Artificial Sequence
  Synthetic Construct
ccaaaccattggcctgtaaactttgt

SEQ ID NO: 4852 - DNA, 21 bp, Artificial Sequence
  Synthetic Construct
gacaatgggactgccatttgc

SEQ ID NO: 4853 - DNA, 25 bp, Artificial Sequence
  Synthetic Construct
gactaccttcaacatcatgggatca

SEQ ID NO: 4854 - DNA, 24 bp, Artificial Sequence
  Synthetic Construct
gggggtgtaatcacagctctgaat

SEQ ID NO: 4855 - DNA, 24 bp, Artificial Sequence
  Synthetic Construct
tctgagacatctttcctcgtttgg

SEQ ID NO: 4856 - DNA, 19 bp, Artificial Sequence
  Synthetic Construct
gggtgaacctggggacaca

SEQ ID NO: 4857 - DNA, 23 bp, Artificial Sequence
  Synthetic Construct
tccctagctctgagggtgaatgt

SEQ ID NO: 4858 - DNA, 19 bp, Artificial Sequence
  Synthetic Construct
cgtggctgctccaggttaa

SEQ ID NO: 4859 - DNA, 24 bp, Artificial Sequence
  Synthetic Construct
cctaccagagtcctgtgtcttcag

SEQ ID NO: 4860 - DNA, 25 bp, Artificial Sequence
  Synthetic Construct
tgtggactttgctgagcataactag

SEQ ID NO: 4861 - DNA, 23 bp, Artificial Sequence
  Synthetic Construct
agtgggtggatagtcaaggaaga

SEQ ID NO: 4862 - DNA, 24 bp, Artificial Sequence
  Synthetic Construct
gggaaactgagagagaagctgagt

SEQ ID NO: 4863 - DNA, 20 bp, Artificial Sequence
  Synthetic Construct
gttgtgggctacgcttgtca

SEQ ID NO: 4864 - DNA, 22 bp, Artificial Sequence
  Synthetic Construct
gctcacaggtacacgaaaatgg

SEQ ID NO: 4865 - DNA, 23 bp, Artificial Sequence
  Synthetic Construct
agaggaggagagaacaggacagt

SEQ ID NO: 4866 - DNA, 22 bp, Artificial Sequence
  Synthetic Construct
aaatgcccctcttgcctatgca

SEQ ID NO: 4867 - DNA, 22 bp, Artificial Sequence
  Synthetic Construct
tgctctgggctgtcgctaaatt

SEQ ID NO: 4868 - DNA, 26 bp, Artificial Sequence
  Synthetic Construct
gcagtcctgtcatccctctgttaatg

SEQ ID NO: 4869 - DNA, 20 bp, Artificial Sequence
  Synthetic Construct
aaacccacccaagccaacct

SEQ ID NO: 4870 - DNA, 24 bp, Artificial Sequence
  Synthetic Construct
ggtgtgaatggcagcctctaaatg

SEQ ID NO: 4871 - DNA, 20 bp, Artificial Sequence
  Synthetic Construct
ttggagggtggccttttgct

SEQ ID NO: 4872 - DNA, 22 bp, Artificial Sequence
  Synthetic Construct
ccggcatttctgaacactgtgt

SEQ ID NO: 4873 - DNA, 27 bp, Artificial Sequence
  Synthetic Construct
ctgagccagtagaaatttagacctcat

SEQ ID NO: 4874 - DNA, 22 bp, Artificial Sequence
  Synthetic Construct
tggtgaacttctccagcagttg

SEQ ID NO: 4875 - DNA, 19 bp, Artificial Sequence
  Synthetic Construct
tgtgtccgggcagagactt

SEQ ID NO: 4876 - DNA, 28 bp, Artificial Sequence
  Synthetic Construct
gagatgatagtaacataggggcatttgt

SEQ ID NO: 4877 - DNA, 24 bp, Artificial Sequence
  Synthetic Construct
ctccagaccccactttgattagtc

SEQ ID NO: 4878 - DNA, 20 bp, Artificial Sequence
  Synthetic Construct
atcttggtggtggcccttct

SEQ ID NO: 4879 - DNA, 24 bp, Artificial Sequence
  Synthetic Construct
ccttgctggaaccacgaattaaca

SEQ ID NO: 4880 - DNA, 26 bp, Artificial Sequence
  Synthetic Construct
cacacagctcaaattattggcagaga

SEQ ID NO: 4881 - DNA, 27 bp, Artificial Sequence
  Synthetic Construct
aggaattcaggtgaatatgttccaaca

SEQ ID NO: 4882 - DNA, 26 bp, Artificial Sequence
  Synthetic Construct
agttgaaaagaatctcaggtctggtt

SEQ ID NO: 4883 - DNA, 24 bp, Artificial Sequence
  Synthetic Construct
agtctccctctagccaagtattcc

SEQ ID NO: 4884 - DNA, 23 bp, Artificial Sequence
  Synthetic Construct
ccagtgtgagggttccttttctt

SEQ ID NO: 4885 - DNA, 27 bp, Artificial Sequence
  Synthetic Construct
gactcatcagtaaatgcagtcaactga

SEQ ID NO: 4886 - DNA, 26 bp, Artificial Sequence
  Synthetic Construct
gtctcactttttatgccgtggtttaa

SEQ ID NO: 4887 - DNA, 22 bp, Artificial Sequence
  Synthetic Construct
ccatctcactgcggagaagttt

SEQ ID NO: 4888 - DNA, 21 bp, Artificial Sequence
  Synthetic Construct
tctgctaggaagggctgagtt

SEQ ID NO: 4889 - DNA, 23 bp, Artificial Sequence
  Synthetic Construct
tgacccagaagagtttggagttg

SEQ ID NO: 4890 - DNA, 22 bp, Artificial Sequence
  Synthetic Construct
caacttgggcatcacagagcaa

SEQ ID NO: 4891 - DNA, 24 bp, Artificial Sequence
  Synthetic Construct
cttggggaaatacagggtcattct

SEQ ID NO: 4892 - DNA, 24 bp, Artificial Sequence
  Synthetic Construct
ctcttatgcccttggccatactct

SEQ ID NO: 4893 - DNA, 25 bp, Artificial Sequence
  Synthetic Construct
ccatcctggtgactgtttcctttca

SEQ ID NO: 4894 - DNA, 24 bp, Artificial Sequence
  Synthetic Construct
tgcttctttccttcctagctacca

SEQ ID NO: 4895 - DNA, 25 bp, Artificial Sequence
  Synthetic Construct
aaaaagagagagaggaaagcattgc

SEQ ID NO: 4896 - DNA, 21 bp, Artificial Sequence
  Synthetic Construct
cttggtctttgcgctgagaga

SEQ ID NO: 4897 - DNA, 28 bp, Artificial Sequence
  Synthetic Construct
ggaccataaaccgtttatgaatccctaa

SEQ ID NO: 4898 - DNA, 22 bp, Artificial Sequence
  Synthetic Construct
tggtggtttgctgtgtgtttac

SEQ ID NO: 4899 - DNA, 21 bp, Artificial Sequence
  Synthetic Construct
agaagctaccctgagcacaga

SEQ ID NO: 4900 - DNA, 23 bp, Artificial Sequence
  Synthetic Construct
tctgttttgaggaatggctgaca

SEQ ID NO: 4901 - DNA, 24 bp, Artificial Sequence
  Synthetic Construct
ggtctctcaggtgtgttcagtaga

SEQ ID NO: 4902 - DNA, 20 bp, Artificial Sequence
  Synthetic Construct
agtgcagcttttcccatggt

SEQ ID NO: 4903 - DNA, 21 bp, Artificial Sequence
  Synthetic Construct
atgagtacagggtggggacat

SEQ ID NO: 4904 - DNA, 22 bp, Artificial Sequence
  Synthetic Construct
ggtgaggcccctttatcctttt

SEQ ID NO: 4905 - DNA, 22 bp, Artificial Sequence
  Synthetic Construct
gcctcggaaactgtcagatggt

SEQ ID NO: 4906 - DNA, 30 bp, Artificial Sequence
  Synthetic Construct
gctactatgtaacatttcatatggcaaaga

SEQ ID NO: 4907 - DNA, 28 bp, Artificial Sequence
  Synthetic Construct
tgtctgaatctaagcttttctgcataga

SEQ ID NO: 4908 - DNA, 21 bp, Artificial Sequence
  Synthetic Construct
caaacagctggtgtgctcatc

SEQ ID NO: 4909 - DNA, 19 bp, Artificial Sequence
  Synthetic Construct
gtggcaggtccagggatct

SEQ ID NO: 4910 - DNA, 23 bp, Artificial Sequence
  Synthetic Construct
aggcctcctaacaggtattcaga

SEQ ID NO: 4911 - DNA, 25 bp, Artificial Sequence
  Synthetic Construct
gccaccacaaatacacttagaactc

SEQ ID NO: 4912 - DNA, 25 bp, Artificial Sequence
  Synthetic Construct
cctgctgggtatctgtaacaatgca

SEQ ID NO: 4913 - DNA, 23 bp, Artificial Sequence
  Synthetic Construct
agggattggcttatctcctctga

SEQ ID NO: 4914 - DNA, 23 bp, Artificial Sequence
  Synthetic Construct
acaacaaaatagggcaggtgcta

SEQ ID NO: 4915 - DNA, 29 bp, Artificial Sequence
  Synthetic Construct
tgataactgttgactgttaattccacaga

SEQ ID NO: 4916 - DNA, 22 bp, Artificial Sequence
  Synthetic Construct
aaagcaggcgggagaactagat

SEQ ID NO: 4917 - DNA, 24 bp, Artificial Sequence
  Synthetic Construct
cctcacctgtctttgcaactttgg

SEQ ID NO: 4918 - DNA, 24 bp, Artificial Sequence
  Synthetic Construct
acccctgatgaaggaaagggattg

SEQ ID NO: 4919 - DNA, 24 bp, Artificial Sequence
  Synthetic Construct
cagtgtgctgacagctgtatagca

SEQ ID NO: 4920 - DNA, 20 bp, Artificial Sequence
  Synthetic Construct
tgggtggggctcagtgttga

SEQ ID NO: 4921 - DNA, 24 bp, Artificial Sequence
  Synthetic Construct
gcagctacctgtctgtcctagaat

SEQ ID NO: 4922 - DNA, 22 bp, Artificial Sequence
  Synthetic Construct
agccattcggatcctggatggt

SEQ ID NO: 4923 - DNA, 22 bp, Artificial Sequence
  Synthetic Construct
gccaagttatgcgatgcattcc

SEQ ID NO: 4924 - DNA, 25 bp, Artificial Sequence
  Synthetic Construct
gtttttctcttcctcatgccccata

SEQ ID NO: 4925 - DNA, 20 bp, Artificial Sequence
  Synthetic Construct
ggtgcccctagtgctgagaa

SEQ ID NO: 4926 - DNA, 26 bp, Artificial Sequence
  Synthetic Construct
gagcctgtctagaaacctaagtggat

SEQ ID NO: 4927 - DNA, 25 bp, Artificial Sequence
  Synthetic Construct
ccaataccttgtgtctgtgtgttac

SEQ ID NO: 4928 - DNA, 22 bp, Artificial Sequence
  Synthetic Construct
tctggaactggacacacatgga

SEQ ID NO: 4929 - DNA, 23 bp, Artificial Sequence
  Synthetic Construct
cccatttgtgcttccacatactc

SEQ ID NO: 4930 - DNA, 20 bp, Artificial Sequence
  Synthetic Construct
ctggcaccaggtgttgctaa

SEQ ID NO: 4931 - DNA, 21 bp, Artificial Sequence
  Synthetic Construct
agcccaggtcaccaagagact

SEQ ID NO: 4932 - DNA, 19 bp, Artificial Sequence
  Synthetic Construct
agccccagttgctcacagt

SEQ ID NO: 4933 - DNA, 27 bp, Artificial Sequence
  Synthetic Construct
ggctgtgaggttttagatacacccttt

SEQ ID NO: 4934 - DNA, 26 bp, Artificial Sequence
  Synthetic Construct
ccaaaacagggcacttgaacattttg

SEQ ID NO: 4935 - DNA, 24 bp, Artificial Sequence
  Synthetic Construct
gcaaagtacaggccatgtgaacct

SEQ ID NO: 4936 - DNA, 25 bp, Artificial Sequence
  Synthetic Construct
gcaagaggaatggacagtagagaag

SEQ ID NO: 4937 - DNA, 20 bp, Artificial Sequence
  Synthetic Construct
tgagcagcttgagcacttgt

SEQ ID NO: 4938 - DNA, 23 bp, Artificial Sequence
  Synthetic Construct
ccctctccaaagaaaaggcctat

SEQ ID NO: 4939 - DNA, 22 bp, Artificial Sequence
  Synthetic Construct
gagcggaattcccagacatcat

SEQ ID NO: 4940 - DNA, 23 bp, Artificial Sequence
  Synthetic Construct
ggcattgtgtaggaaaggagaga

SEQ ID NO: 4941 - DNA, 18 bp, Artificial Sequence
  Synthetic Construct
gcgcacagccgtggaaag

SEQ ID NO: 4942 - DNA, 25 bp, Artificial Sequence
  Synthetic Construct
actgttcccagttagaggtgtaaca

SEQ ID NO: 4943 - DNA, 20 bp, Artificial Sequence
  Synthetic Construct
atgggccatcctgacatgct

SEQ ID NO: 4944 - DNA, 26 bp, Artificial Sequence
  Synthetic Construct
gtagctccagaaacctttctcatcta

SEQ ID NO: 4945 - DNA, 24 bp, Artificial Sequence
  Synthetic Construct
tcctgattgtagtcagcacagaga

SEQ ID NO: 4946 - DNA, 26 bp, Artificial Sequence
  Synthetic Construct
aggagaagagaagtacatgggttttc

SEQ ID NO: 4947 - DNA, 26 bp, Artificial Sequence
  Synthetic Construct
cctgatgccttcataaatgtgttgtg

SEQ ID NO: 4948 - DNA, 23 bp, Artificial Sequence
  Synthetic Construct
gaaatttgggtatgccgttgtca

SEQ ID NO: 4949 - DNA, 25 bp, Artificial Sequence
  Synthetic Construct
gtctggaaagatgcatggaagtaag

SEQ ID NO: 4950 - DNA, 24 bp, Artificial Sequence
  Synthetic Construct
ggaaacttagtgcagtagcggatt

SEQ ID NO: 4951 - DNA, 29 bp, Artificial Sequence
  Synthetic Construct
acaaaaatgatatgtgcaaaatccagttg

SEQ ID NO: 4952 - DNA, 24 bp, Artificial Sequence
  Synthetic Construct
acctctttaacccttcctgtagga

SEQ ID NO: 4953 - DNA, 20 bp, Artificial Sequence
  Synthetic Construct
cccaggcaccctctattcca

SEQ ID NO: 4954 - DNA, 22 bp, Artificial Sequence
  Synthetic Construct
tggtgcctgaatgtgagttcct

SEQ ID NO: 4955 - DNA, 25 bp, Artificial Sequence
  Synthetic Construct
tttatggcctacgctctttttgttc

SEQ ID NO: 4956 - DNA, 27 bp, Artificial Sequence
  Synthetic Construct
gcaatgggaatttgaatcaggtccaat

SEQ ID NO: 4957 - DNA, 22 bp, Artificial Sequence
  Synthetic Construct
gcaggcacagtattggctcaaa

SEQ ID NO: 4958 - DNA, 20 bp, Artificial Sequence
  Synthetic Construct
tgttgatgtggggggaagga

SEQ ID NO: 4959 - DNA, 24 bp, Artificial Sequence
  Synthetic Construct
acaccgcctgaggtagtgcaaata

SEQ ID NO: 4960 - DNA, 26 bp, Artificial Sequence
  Synthetic Construct
ctgaagtccagtaaggctctcacctt

SEQ ID NO: 4961 - DNA, 24 bp, Artificial Sequence
  Synthetic Construct
gaccaagatgtgagacctctttgg

SEQ ID NO: 4962 - DNA, 22 bp, Artificial Sequence
  Synthetic Construct
gcccataaacaccctggactca

SEQ ID NO: 4963 - DNA, 24 bp, Artificial Sequence
  Synthetic Construct
gcaagagcttcctggttgatctag

SEQ ID NO: 4964 - DNA, 20 bp, Artificial Sequence
  Synthetic Construct
cactgtgccaaccccttacc

SEQ ID NO: 4965 - DNA, 22 bp, Artificial Sequence
  Synthetic Construct
tgctctgtctctgctccattcc

SEQ ID NO: 4966 - DNA, 24 bp, Artificial Sequence
  Synthetic Construct
ttgtagcctgatgaacttcacaca

SEQ ID NO: 4967 - DNA, 23 bp, Artificial Sequence
  Synthetic Construct
gctgagactttcacagtgttcac

SEQ ID NO: 4968 - DNA, 24 bp, Artificial Sequence
  Synthetic Construct
tctaggcaagctacctgtaacttg

SEQ ID NO: 4969 - DNA, 20 bp, Artificial Sequence
  Synthetic Construct
acagccgtgaactccctaga

SEQ ID NO: 4970 - DNA, 20 bp, Artificial Sequence
  Synthetic Construct
cagggggacagcctgtctta

SEQ ID NO: 4971 - DNA, 24 bp, Artificial Sequence
  Synthetic Construct
gagaattccccaggtgtaggtgtt

SEQ ID NO: 4972 - DNA, 21 bp, Artificial Sequence
  Synthetic Construct
aggagccttcaaagccctgaa

SEQ ID NO: 4973 - DNA, 25 bp, Artificial Sequence
  Synthetic Construct
acagagagaatccacttggtttcaa

SEQ ID NO: 4974 - DNA, 25 bp, Artificial Sequence
  Synthetic Construct
aagcgttagttgctttggttagaag

SEQ ID NO: 4975 - DNA, 20 bp, Artificial Sequence
  Synthetic Construct
gcgttgcttaggccatttgc

SEQ ID NO: 4976 - DNA, 25 bp, Artificial Sequence
  Synthetic Construct
ggacacatgtcattgtgcagagatc

SEQ ID NO: 4977 - DNA, 24 bp, Artificial Sequence
  Synthetic Construct
gtgtcgagaaccggctgtaaatca

SEQ ID NO: 4978 - DNA, 28 bp, Artificial Sequence
  Synthetic Construct
ggggtataccttgtcatatggcataagc

SEQ ID NO: 4979 - DNA, 22 bp, Artificial Sequence
  Synthetic Construct
tgtctactgagccattgcagtt

SEQ ID NO: 4980 - DNA, 26 bp, Artificial Sequence
  Synthetic Construct
ggcagggagcttattcagatctacag

SEQ ID NO: 4981 - DNA, 19 bp, Artificial Sequence
  Synthetic Construct
tgctcacagtgccgtttga

SEQ ID NO: 4982 - DNA, 22 bp, Artificial Sequence
  Synthetic Construct
gcagaacatcaaaggccaatgt

SEQ ID NO: 4983 - DNA, 21 bp, Artificial Sequence
  Synthetic Construct
tcaatgcgctccctggtattt

SEQ ID NO: 4984 - DNA, 25 bp, Artificial Sequence
  Synthetic Construct
gtagtgatttccaagacctcaccat

SEQ ID NO: 4985 - DNA, 22 bp, Artificial Sequence
  Synthetic Construct
aagcagctcaggtgatcttcag

SEQ ID NO: 4986 - DNA, 25 bp, Artificial Sequence
  Synthetic Construct
gccagatagggtacagtgcctttaa

SEQ ID NO: 4987 - DNA, 28 bp, Artificial Sequence
  Synthetic Construct
cagtacttttccagttaggttcgttacc

SEQ ID NO: 4988 - DNA, 25 bp, Artificial Sequence
  Synthetic Construct
cgaccaaagagtcttaggcatatgc

SEQ ID NO: 4989 - DNA, 22 bp, Artificial Sequence
  Synthetic Construct
tcccttctcatgggggattacc

SEQ ID NO: 4990 - DNA, 28 bp, Artificial Sequence
  Synthetic Construct
caactggaaatgatgaaaataggctgat

SEQ ID NO: 4991 - DNA, 23 bp, Artificial Sequence
  Synthetic Construct
agtacagcaggaagtgggatagg

SEQ ID NO: 4992 - DNA, 22 bp, Artificial Sequence
  Synthetic Construct
gggcttttccatgcttctgcta

SEQ ID NO: 4993 - DNA, 25 bp, Artificial Sequence
  Synthetic Construct
gctctgaactgtcattggtggctat

SEQ ID NO: 4994 - DNA, 21 bp, Artificial Sequence
  Synthetic Construct
tggccaaagctctcaggtcat

SEQ ID NO: 4995 - DNA, 22 bp, Artificial Sequence
  Synthetic Construct
cctccagttctgtatgcaacca

SEQ ID NO: 4996 - DNA, 18 bp, Artificial Sequence
  Synthetic Construct
gtgcgtggtgggcttcat

SEQ ID NO: 4997 - DNA, 20 bp, Artificial Sequence
  Synthetic Construct
agcaaggaagggagcatcct

SEQ ID NO: 4998 - DNA, 29 bp, Artificial Sequence
  Synthetic Construct
gaatttgtgttaagcactatcctctactc

SEQ ID NO: 4999 - DNA, 24 bp, Artificial Sequence
  Synthetic Construct
gggaggatgactttggagctatgt

SEQ ID NO: 5000 - DNA, 21 bp, Artificial Sequence
  Synthetic Construct
atgtcagaagggggactgcat

SEQ ID NO: 5001 - DNA, 22 bp, Artificial Sequence
  Synthetic Construct
tgatcaggtgaaggggctaact

SEQ ID NO: 5002 - DNA, 21 bp, Artificial Sequence
  Synthetic Construct
ccatcaggcagtcacaatgct

SEQ ID NO: 5003 - DNA, 22 bp, Artificial Sequence
  Synthetic Construct
tggctccttgtccacagcataa

SEQ ID NO: 5004 - DNA, 29 bp, Artificial Sequence
  Synthetic Construct
ggactaagtagaagtagggtatcctatgt

SEQ ID NO: 5005 - DNA, 21 bp, Artificial Sequence
  Synthetic Construct
aagtgaaagggtggcattcca

SEQ ID NO: 5006 - DNA, 22 bp, Artificial Sequence
  Synthetic Construct
ttatcagcccatggagcaactc

SEQ ID NO: 5007 - DNA, 20 bp, Artificial Sequence
  Synthetic Construct
cgctgatcgccttcatacca

SEQ ID NO: 5008 - DNA, 28 bp, Artificial Sequence
  Synthetic Construct
ccactagtaaagggatttttctcatagc

SEQ ID NO: 5009 - DNA, 24 bp, Artificial Sequence
  Synthetic Construct
gagctcaagttcaaggtgaagctt

SEQ ID NO: 5010 - DNA, 25 bp, Artificial Sequence
  Synthetic Construct
gtctggtctcagtcctgtttaggtt

SEQ ID NO: 5011 - DNA, 22 bp, Artificial Sequence
  Synthetic Construct
aggcagggagaagcagctcatt

SEQ ID NO: 5012 - DNA, 21 bp, Artificial Sequence
  Synthetic Construct
ggtccctgggtgcattttagg

SEQ ID NO: 5013 - DNA, 22 bp, Artificial Sequence
  Synthetic Construct
tcccagggtaagttgccaagga

SEQ ID NO: 5014 - DNA, 20 bp, Artificial Sequence
  Synthetic Construct
ggcatggaggagacgagtgt

SEQ ID NO: 5015 - DNA, 21 bp, Artificial Sequence
  Synthetic Construct
agccatccttgcattgacagt

SEQ ID NO: 5016 - DNA, 23 bp, Artificial Sequence
  Synthetic Construct
cctctcaacgaaggcataatgct

SEQ ID NO: 5017 - DNA, 23 bp, Artificial Sequence
  Synthetic Construct
gcatttgtgcccagctaaatctt

SEQ ID NO: 5018 - DNA, 24 bp, Artificial Sequence
  Synthetic Construct
caaatgcctctatctcagctcaca

SEQ ID NO: 5019 - DNA, 23 bp, Artificial Sequence
  Synthetic Construct
agcagaatggctgagatttcaga

SEQ ID NO: 5020 - DNA, 22 bp, Artificial Sequence
  Synthetic Construct
aacatgggacctgaacaaacca

SEQ ID NO: 5021 - DNA, 27 bp, Artificial Sequence
  Synthetic Construct
gcttccactggagtttgagtttatgag

SEQ ID NO: 5022 - DNA, 23 bp, Artificial Sequence
  Synthetic Construct
gaaaataggcagactcggagcat

SEQ ID NO: 5023 - DNA, 20 bp, Artificial Sequence
  Synthetic Construct
ttcagggccactctgaagga

SEQ ID NO: 5024 - DNA, 24 bp, Artificial Sequence
  Synthetic Construct
caactctctgccttgaacttctgt

SEQ ID NO: 5025 - DNA, 25 bp, Artificial Sequence
  Synthetic Construct
acatgtacactgggtcagaatttgt

SEQ ID NO: 5026 - DNA, 22 bp, Artificial Sequence
  Synthetic Construct
gggaagactgttgtctgaagct

SEQ ID NO: 5027 - DNA, 27 bp, Artificial Sequence
  Synthetic Construct
gctacccattagacctatcagcatgtt

SEQ ID NO: 5028 - DNA, 22 bp, Artificial Sequence
  Synthetic Construct
ttccaggggcctgaacatcttt

SEQ ID NO: 5029 - DNA, 20 bp, Artificial Sequence
  Synthetic Construct
ccaacagccccacagagaga

SEQ ID NO: 5030 - DNA, 25 bp, Artificial Sequence
  Synthetic Construct
gattcacccaactcctctattctgt

SEQ ID NO: 5031 - DNA, 22 bp, Artificial Sequence
  Synthetic Construct
ggcttggaatgcagaagaggta

SEQ ID NO: 5032 - DNA, 26 bp, Artificial Sequence
  Synthetic Construct
acagtttctggcaaattctagaagct

SEQ ID NO: 5033 - DNA, 27 bp, Artificial Sequence
  Synthetic Construct
cctcaacaacccagtttttcagaaacc

SEQ ID NO: 5034 - DNA, 26 bp, Artificial Sequence
  Synthetic Construct
ctctcaagcacataaaagcacttacc

SEQ ID NO: 5035 - DNA, 21 bp, Artificial Sequence
  Synthetic Construct
cgggcagcgtcctgacatagt

SEQ ID NO: 5036 - DNA, 20 bp, Artificial Sequence
  Synthetic Construct
cccccctggagccctctttt

SEQ ID NO: 5037 - DNA, 26 bp, Artificial Sequence
  Synthetic Construct
caggatattgagcagttcccaaactc

SEQ ID NO: 5038 - DNA, 20 bp, Artificial Sequence
  Synthetic Construct
gctccagaggaagcggtcta

SEQ ID NO: 5039 - DNA, 22 bp, Artificial Sequence
  Synthetic Construct
aagccccagtaatgaccattgc

SEQ ID NO: 5040 - DNA, 22 bp, Artificial Sequence
  Synthetic Construct
gctggtgggatggaatgaatga

SEQ ID NO: 5041 - DNA, 24 bp, Artificial Sequence
  Synthetic Construct
gggcagtacagacaccatctctat

SEQ ID NO: 5042 - DNA, 24 bp, Artificial Sequence
  Synthetic Construct
gctgcatttgggtcgttttgtttc

SEQ ID NO: 5043 - DNA, 24 bp, Artificial Sequence
  Synthetic Construct
gacatttccaggcctgttgttagg

SEQ ID NO: 5044 - DNA, 20 bp, Artificial Sequence
  Synthetic Construct
tctgcaccccagttgtcact

SEQ ID NO: 5045 - DNA, 21 bp, Artificial Sequence
  Synthetic Construct
accgtccacatgttcctttcc

SEQ ID NO: 5046 - DNA, 22 bp, Artificial Sequence
  Synthetic Construct
cccaataggtgctgacctttgg

SEQ ID NO: 5047 - DNA, 26 bp, Artificial Sequence
  Synthetic Construct
ctgttcagttactttcaactctgctt

SEQ ID NO: 5048 - DNA, 27 bp, Artificial Sequence
  Synthetic Construct
cctactttgtgcctagagttgtactca

SEQ ID NO: 5049 - DNA, 28 bp, Artificial Sequence
  Synthetic Construct
gactaggaaattatcaagctggtttgtg

SEQ ID NO: 5050 - DNA, 22 bp, Artificial Sequence
  Synthetic Construct
ttctccaatgaccgggtgacaa

SEQ ID NO: 5051 - DNA, 27 bp, Artificial Sequence
  Synthetic Construct
ctggcactgttacatattttcctgaga

SEQ ID NO: 5052 - DNA, 24 bp, Artificial Sequence
  Synthetic Construct
agtatctgactgcaaggctgttac

SEQ ID NO: 5053 - DNA, 26 bp, Artificial Sequence
  Synthetic Construct
tggttgagacctgttatttccagtac

SEQ ID NO: 5054 - DNA, 26 bp, Artificial Sequence
  Synthetic Construct
tcaatgggctcatcagtagatatcag

SEQ ID NO: 5055 - DNA, 27 bp, Artificial Sequence
  Synthetic Construct
aacctgactttaatacaaacccaactg

SEQ ID NO: 5056 - DNA, 19 bp, Artificial Sequence
  Synthetic Construct
ggctgcatgcgagttcgtt

SEQ ID NO: 5057 - DNA, 26 bp, Artificial Sequence
  Synthetic Construct
gcatgttattctctccaggtccagaa

SEQ ID NO: 5058 - DNA, 23 bp, Artificial Sequence
  Synthetic Construct
gggacttgcaattcgatgtgaga

SEQ ID NO: 5059 - DNA, 21 bp, Artificial Sequence
  Synthetic Construct
gtggaaggtgaagcagagaca

SEQ ID NO: 5060 - DNA, 27 bp, Artificial Sequence
  Synthetic Construct
cctgattggtattggctttcaggatca

SEQ ID NO: 5061 - DNA, 26 bp, Artificial Sequence
  Synthetic Construct
gcaacaatccacatgaatggactatg

SEQ ID NO: 5062 - DNA, 23 bp, Artificial Sequence
  Synthetic Construct
agaagctcactggaattgcagat

SEQ ID NO: 5063 - DNA, 22 bp, Artificial Sequence
  Synthetic Construct
ggagctgctgtttttctgcttt

SEQ ID NO: 5064 - DNA, 24 bp, Artificial Sequence
  Synthetic Construct
gagtggtggaagttacctctcaac

SEQ ID NO: 5065 - DNA, 24 bp, Artificial Sequence
  Synthetic Construct
acagtttaagttttgcctgcttgt

SEQ ID NO: 5066 - DNA, 22 bp, Artificial Sequence
  Synthetic Construct
ctcttgccatggttctgctcta

SEQ ID NO: 5067 - DNA, 26 bp, Artificial Sequence
  Synthetic Construct
gggaatcatggttctctgctattgct

SEQ ID NO: 5068 - DNA, 27 bp, Artificial Sequence
  Synthetic Construct
cgataatgtcagtgatcctgggaattc

SEQ ID NO: 5069 - DNA, 22 bp, Artificial Sequence
  Synthetic Construct
tgcctccctgcatgatgattgt

SEQ ID NO: 5070 - DNA, 27 bp, Artificial Sequence
  Synthetic Construct
catagttctgggaatggattcatttgc

SEQ ID NO: 5071 - DNA, 27 bp, Artificial Sequence
  Synthetic Construct
cctcatatacctggaggaaaggagcat

SEQ ID NO: 5072 - DNA, 22 bp, Artificial Sequence
  Synthetic Construct
tgagattggcagcgaccttaac

SEQ ID NO: 5073 - DNA, 22 bp, Artificial Sequence
  Synthetic Construct
aggaggacatcagatcctgcat

SEQ ID NO: 5074 - DNA, 22 bp, Artificial Sequence
  Synthetic Construct
tgatggtggcttggacttcagt

SEQ ID NO: 5075 - DNA, 21 bp, Artificial Sequence
  Synthetic Construct
aagtgggttctcagggctcaa

SEQ ID NO: 5076 - DNA, 20 bp, Artificial Sequence
  Synthetic Construct
gtgcagccaagttggggaaa

SEQ ID NO: 5077 - DNA, 30 bp, Artificial Sequence
  Synthetic Construct
caaagtagataaaggttttcttccagtgtt

SEQ ID NO: 5078 - DNA, 18 bp, Artificial Sequence
  Synthetic Construct
ggccgcaagcactccttt

SEQ ID NO: 5079 - DNA, 22 bp, Artificial Sequence
  Synthetic Construct
agagtctggagggtggatccaa

SEQ ID NO: 5080 - DNA, 27 bp, Artificial Sequence
  Synthetic Construct
gcatttgaaaagcattatcgtctcatc

SEQ ID NO: 5081 - DNA, 23 bp, Artificial Sequence
  Synthetic Construct
accccacacaaccatacacaaag

SEQ ID NO: 5082 - DNA, 21 bp, Artificial Sequence
  Synthetic Construct
accttcctggtgcctgtgatg

SEQ ID NO: 5083 - DNA, 24 bp, Artificial Sequence
  Synthetic Construct
acacccacccctttctctaagtag

SEQ ID NO: 5084 - DNA, 26 bp, Artificial Sequence
  Synthetic Construct
gcctgataacctgctgattctcaaac

SEQ ID NO: 5085 - DNA, 19 bp, Artificial Sequence
  Synthetic Construct
aggtgggcaactgcaagca

SEQ ID NO: 5086 - DNA, 26 bp, Artificial Sequence
  Synthetic Construct
cagctatactgacggtaattgtaagc

SEQ ID NO: 5087 - DNA, 22 bp, Artificial Sequence
  Synthetic Construct
aagggaatggagcctgctagtt

SEQ ID NO: 5088 - DNA, 22 bp, Artificial Sequence
  Synthetic Construct
accaacttcctggactgcaaag

SEQ ID NO: 5089 - DNA, 25 bp, Artificial Sequence
  Synthetic Construct
gcatgtctatggcttggaaggtagt

SEQ ID NO: 5090 - DNA, 26 bp, Artificial Sequence
  Synthetic Construct
ggtatttggctgtctcaagattacac

SEQ ID NO: 5091 - DNA, 22 bp, Artificial Sequence
  Synthetic Construct
acgagcagcatcttctgactct

SEQ ID NO: 5092 - DNA, 23 bp, Artificial Sequence
  Synthetic Construct
tccataggtcaggctgactatgc

SEQ ID NO: 5093 - DNA, 25 bp, Artificial Sequence
  Synthetic Construct
gtcaagaatgatgcctggtttttgg

SEQ ID NO: 5094 - DNA, 21 bp, Artificial Sequence
  Synthetic Construct
gtggtgcctgtgccacaagaa

SEQ ID NO: 5095 - DNA, 21 bp, Artificial Sequence
  Synthetic Construct
agcagtagcaaggaggtgaca

SEQ ID NO: 5096 - DNA, 27 bp, Artificial Sequence
  Synthetic Construct
gggaggttagacttttactctctcaga

SEQ ID NO: 5097 - DNA, 21 bp, Artificial Sequence
  Synthetic Construct
gctggaaactccactgccatt

SEQ ID NO: 5098 - DNA, 22 bp, Artificial Sequence
  Synthetic Construct
tcccagttgcagccataactgt

SEQ ID NO: 5099 - DNA, 28 bp, Artificial Sequence
  Synthetic Construct
cagcaactacttctcaatctgtctacag

SEQ ID NO: 5100 - DNA, 23 bp, Artificial Sequence
  Synthetic Construct
gcatgtacaaaacaagcccttga

SEQ ID NO: 5101 - DNA, 24 bp, Artificial Sequence
  Synthetic Construct
ggagggtgagaccaagtctgtttt

SEQ ID NO: 5102 - DNA, 25 bp, Artificial Sequence
  Synthetic Construct
tcatcatgggtctgtgattgattga

SEQ ID NO: 5103 - DNA, 21 bp, Artificial Sequence
  Synthetic Construct
tgggatggtggtgtgagaagt

SEQ ID NO: 5104 - DNA, 22 bp, Artificial Sequence
  Synthetic Construct
tcctgagtggatggttgactct

SEQ ID NO: 5105 - DNA, 25 bp, Artificial Sequence
  Synthetic Construct
gataatgttgggagaggcaatttgg

SEQ ID NO: 5106 - DNA, 22 bp, Artificial Sequence
  Synthetic Construct
tgagaggtgagtggagtttgct

SEQ ID NO: 5107 - DNA, 23 bp, Artificial Sequence
  Synthetic Construct
cctgaatcccttttgtgcatgtg

SEQ ID NO: 5108 - DNA, 23 bp, Artificial Sequence
  Synthetic Construct
ccacctctgtaaacatgcaagga

SEQ ID NO: 5109 - DNA, 24 bp, Artificial Sequence
  Synthetic Construct
gtaaagggctctgttcttcaggaa

SEQ ID NO: 5110 - DNA, 21 bp, Artificial Sequence
  Synthetic Construct
tccaagacaagggagccagaa

SEQ ID NO: 5111 - DNA, 23 bp, Artificial Sequence
  Synthetic Construct
caccaaaaatcactggggttggt

SEQ ID NO: 5112 - DNA, 22 bp, Artificial Sequence
  Synthetic Construct
gcgacctctttcagtcaccaaa

SEQ ID NO: 5113 - DNA, 22 bp, Artificial Sequence
  Synthetic Construct
ctgctcctgtgagacagtaacc

SEQ ID NO: 5114 - DNA, 27 bp, Artificial Sequence
  Synthetic Construct
gacccatgtacttattagctgtgaact

SEQ ID NO: 5115 - DNA, 19 bp, Artificial Sequence
  Synthetic Construct
tgccgctctgccagattct

SEQ ID NO: 5116 - DNA, 24 bp, Artificial Sequence
  Synthetic Construct
tgccagagactttgccagatttcc

SEQ ID NO: 5117 - DNA, 23 bp, Artificial Sequence
  Synthetic Construct
tgctgagagaaggtgctatctct

SEQ ID NO: 5118 - DNA, 22 bp, Artificial Sequence
  Synthetic Construct
tctccatgccccttgatagtca

SEQ ID NO: 5119 - DNA, 22 bp, Artificial Sequence
  Synthetic Construct
ggcaaggagacctttcagatga

SEQ ID NO: 5120 - DNA, 23 bp, Artificial Sequence
  Synthetic Construct
actccctgaatgcctccttaacc

SEQ ID NO: 5121 - DNA, 21 bp, Artificial Sequence
  Synthetic Construct
gctgtggtcatgtaggaagct

SEQ ID NO: 5122 - DNA, 22 bp, Artificial Sequence
  Synthetic Construct
tgctgccccattgtcactttca

SEQ ID NO: 5123 - DNA, 21 bp, Artificial Sequence
  Synthetic Construct
tccccagctgacaatcatgca

SEQ ID NO: 5124 - DNA, 24 bp, Artificial Sequence
  Synthetic Construct
tgccaacaaggtgaaatagcagat

SEQ ID NO: 5125 - DNA, 26 bp, Artificial Sequence
  Synthetic Construct
cgagctgatctgagtacaatcacaga

SEQ ID NO: 5126 - DNA, 24 bp, Artificial Sequence
  Synthetic Construct
actcttttgtctctggctgtagag

SEQ ID NO: 5127 - DNA, 27 bp, Artificial Sequence
  Synthetic Construct
gcaaagatgaaaactggaagctacaac

SEQ ID NO: 5128 - DNA, 26 bp, Artificial Sequence
  Synthetic Construct
acatgacaggaaagtaaagctttgac

SEQ ID NO: 5129 - DNA, 25 bp, Artificial Sequence
  Synthetic Construct
ggggatagatgaagtgtggcaaaat

SEQ ID NO: 5130 - DNA, 25 bp, Artificial Sequence
  Synthetic Construct
tgaagtagaaggatgcagagacctt

SEQ ID NO: 5131 - DNA, 25 bp, Artificial Sequence
  Synthetic Construct
gagtttcctgtgacctaaccatgtg

SEQ ID NO: 5132 - DNA, 20 bp, Artificial Sequence
  Synthetic Construct
acgtgcctcagctgtgaaat

SEQ ID NO: 5133 - DNA, 25 bp, Artificial Sequence
  Synthetic Construct
ggacagacactgattaagggcaact

SEQ ID NO: 5134 - DNA, 22 bp, Artificial Sequence
  Synthetic Construct
cccagcatctttgtgaggagaa

SEQ ID NO: 5135 - DNA, 21 bp, Artificial Sequence
  Synthetic Construct
aggctcagctgcatcagacaa

SEQ ID NO: 5136 - DNA, 24 bp, Artificial Sequence
  Synthetic Construct
cttggaaaagtgagagcgttttga

SEQ ID NO: 5137 - DNA, 26 bp, Artificial Sequence
  Synthetic Construct
tttcaggcaagaaacaaatgatctgt

SEQ ID NO: 5138 - DNA, 21 bp, Artificial Sequence
  Synthetic Construct
atcggctcaggcacacttagt

SEQ ID NO: 5139 - DNA, 21 bp, Artificial Sequence
  Synthetic Construct
agggagtgtgtgggtttggtt

SEQ ID NO: 5140 - DNA, 22 bp, Artificial Sequence
  Synthetic Construct
gaaacagtgcctgcccaactat

SEQ ID NO: 5141 - DNA, 27 bp, Artificial Sequence
  Synthetic Construct
gcactaacagcccatgtacactaacag

SEQ ID NO: 5142 - DNA, 22 bp, Artificial Sequence
  Synthetic Construct
gaacaataggctgcctgtggtt

SEQ ID NO: 5143 - DNA, 23 bp, Artificial Sequence
  Synthetic Construct
tgaatctaggctgcctctgtaca

SEQ ID NO: 5144 - DNA, 26 bp, Artificial Sequence
  Synthetic Construct
gcatgctgatttgaaggaaactgtct

SEQ ID NO: 5145 - DNA, 22 bp, Artificial Sequence
  Synthetic Construct
gcaacaactgccagctttactg

SEQ ID NO: 5146 - DNA, 24 bp, Artificial Sequence
  Synthetic Construct
ccctgctagatcccaactgttcta

SEQ ID NO: 5147 - DNA, 20 bp, Artificial Sequence
  Synthetic Construct
acctgcagaggatggaagga

SEQ ID NO: 5148 - DNA, 22 bp, Artificial Sequence
  Synthetic Construct
acaaggctcaggattccaagct

SEQ ID NO: 5149 - DNA, 23 bp, Artificial Sequence
  Synthetic Construct
ctcagctttggattggaccttct

SEQ ID NO: 5150 - DNA, 22 bp, Artificial Sequence
  Synthetic Construct
ccaaaggccaggaagagggtat

SEQ ID NO: 5151 - DNA, 20 bp, Artificial Sequence
  Synthetic Construct
actgcactcagggcttgtca

SEQ ID NO: 5152 - DNA, 26 bp, Artificial Sequence
  Synthetic Construct
tgatttgggtgtcaatctgaaatcac

SEQ ID NO: 5153 - DNA, 22 bp, Artificial Sequence
  Synthetic Construct
aggtttctcaccaccctcatct

SEQ ID NO: 5154 - DNA, 22 bp, Artificial Sequence
  Synthetic Construct
cacatccagcgaccatcaacat

SEQ ID NO: 5155 - DNA, 22 bp, Artificial Sequence
  Synthetic Construct
caggttgcttgtttccaaacca

SEQ ID NO: 5156 - DNA, 22 bp, Artificial Sequence
  Synthetic Construct
tgttcccctctctgctctaacc

SEQ ID NO: 5157 - DNA, 28 bp, Artificial Sequence
  Synthetic Construct
ggttggcactataatagccaccattaaa

SEQ ID NO: 5158 - DNA, 21 bp, Artificial Sequence
  Synthetic Construct
acatgcagcatggagcaatgt

SEQ ID NO: 5159 - DNA, 26 bp, Artificial Sequence
  Synthetic Construct
gtgatgattggaatgggttagacaga

SEQ ID NO: 5160 - DNA, 20 bp, Artificial Sequence
  Synthetic Construct
gcttgctgcaattccccaaa

SEQ ID NO: 5161 - DNA, 21 bp, Artificial Sequence
  Synthetic Construct
acctctgccaggaacccagaa

SEQ ID NO: 5162 - DNA, 22 bp, Artificial Sequence
  Synthetic Construct
gtcttgctttaccgcagactga

SEQ ID NO: 5163 - DNA, 19 bp, Artificial Sequence
  Synthetic Construct
aggctcctctgcaggacat

SEQ ID NO: 5164 - DNA, 25 bp, Artificial Sequence
  Synthetic Construct
acaagccactgttacgtttctagat

SEQ ID NO: 5165 - DNA, 25 bp, Artificial Sequence
  Synthetic Construct
cctccgattgctttttgtgttccta

SEQ ID NO: 5166 - DNA, 28 bp, Artificial Sequence
  Synthetic Construct
tctcattgtgtttcatcaagatcactct

SEQ ID NO: 5167 - DNA, 22 bp, Artificial Sequence
  Synthetic Construct
cagtcacccaatgagctcatca

SEQ ID NO: 5168 - DNA, 19 bp, Artificial Sequence
  Synthetic Construct
tcgaggtgtggctgttcct

SEQ ID NO: 5169 - DNA, 19 bp, Artificial Sequence
  Synthetic Construct
tgctagcggctcagagctt

SEQ ID NO: 5170 - DNA, 26 bp, Artificial Sequence
  Synthetic Construct
agaccccatatttctccctattgaac

SEQ ID NO: 5171 - DNA, 24 bp, Artificial Sequence
  Synthetic Construct
cccgatgacatcacttttgcatct

SEQ ID NO: 5172 - DNA, 24 bp, Artificial Sequence
  Synthetic Construct
ccaagattccagcacaggtaccat

SEQ ID NO: 5173 - DNA, 24 bp, Artificial Sequence
  Synthetic Construct
gggggttttgccagtcatctaagt

SEQ ID NO: 5174 - DNA, 22 bp, Artificial Sequence
  Synthetic Construct
ggccacatggaaggcatgttta

SEQ ID NO: 5175 - DNA, 24 bp, Artificial Sequence
  Synthetic Construct
gcaaagttagggcagaaccaacca

SEQ ID NO: 5176 - DNA, 26 bp, Artificial Sequence
  Synthetic Construct
gggttcaataattccaccctcaactc

SEQ ID NO: 5177 - DNA, 24 bp, Artificial Sequence
  Synthetic Construct
gaccaagacctttccatcatccat

SEQ ID NO: 5178 - DNA, 23 bp, Artificial Sequence
  Synthetic Construct
tgtggcctctaagacctgagtag

SEQ ID NO: 5179 - DNA, 24 bp, Artificial Sequence
  Synthetic Construct
gagcagctgaacagtacaatacca

SEQ ID NO: 5180 - DNA, 26 bp, Artificial Sequence
  Synthetic Construct
gtcatatccttagggttcctggttct

SEQ ID NO: 5181 - DNA, 24 bp, Artificial Sequence
  Synthetic Construct
cagccacagtggaataaagtacca

SEQ ID NO: 5182 - DNA, 24 bp, Artificial Sequence
  Synthetic Construct
gttctgtgacaccatcttccatca

SEQ ID NO: 5183 - DNA, 23 bp, Artificial Sequence
  Synthetic Construct
tgctctccaggatctccagtcat

SEQ ID NO: 5184 - DNA, 26 bp, Artificial Sequence
  Synthetic Construct
agaacaacagcaaaacttgtgatctg

SEQ ID NO: 5185 - DNA, 21 bp, Artificial Sequence
  Synthetic Construct
tcagccaaccttgacctgtga

SEQ ID NO: 5186 - DNA, 27 bp, Artificial Sequence
  Synthetic Construct
gagatcctaagtctgtgatatggcaat

SEQ ID NO: 5187 - DNA, 24 bp, Artificial Sequence
  Synthetic Construct
ttctctctggatgtcccccttaag

SEQ ID NO: 5188 - DNA, 20 bp, Artificial Sequence
  Synthetic Construct
cctaggctgggtggatggat

SEQ ID NO: 5189 - DNA, 27 bp, Artificial Sequence
  Synthetic Construct
gtgggtagaaagaacatttcacattgc

SEQ ID NO: 5190 - DNA, 24 bp, Artificial Sequence
  Synthetic Construct
gagttgcttggtagggctggaatt

SEQ ID NO: 5191 - DNA, 22 bp, Artificial Sequence
  Synthetic Construct
acagatggtacccctgctgact

SEQ ID NO: 5192 - DNA, 25 bp, Artificial Sequence
  Synthetic Construct
gcacctatattcatgccaagagaga

SEQ ID NO: 5193 - DNA, 24 bp, Artificial Sequence
  Synthetic Construct
cctgaagatacaggcttccttcct

SEQ ID NO: 5194 - DNA, 21 bp, Artificial Sequence
  Synthetic Construct
tgcagtgggagtctccatgaa

SEQ ID NO: 5195 - DNA, 20 bp, Artificial Sequence
  Synthetic Construct
ctgtgagagccaacccacat

SEQ ID NO: 5196 - DNA, 23 bp, Artificial Sequence
  Synthetic Construct
acttgccttctaaaacccagtca

SEQ ID NO: 5197 - DNA, 21 bp, Artificial Sequence
  Synthetic Construct
cccactgagcctctgtctgta

SEQ ID NO: 5198 - DNA, 24 bp, Artificial Sequence
  Synthetic Construct
gcccacctgaaagtgtcaactaac

SEQ ID NO: 5199 - DNA, 24 bp, Artificial Sequence
  Synthetic Construct
gtatttgggtgcatgagttggttt

SEQ ID NO: 5200 - DNA, 22 bp, Artificial Sequence
  Synthetic Construct
ggaaaggcaggccagagtttaa

SEQ ID NO: 5201 - DNA, 23 bp, Artificial Sequence
  Synthetic Construct
ccacacctgcagaattagtacca

SEQ ID NO: 5202 - DNA, 20 bp, Artificial Sequence
  Synthetic Construct
acagggcttggggcttagga

SEQ ID NO: 5203 - DNA, 19 bp, Artificial Sequence
  Synthetic Construct
gggaaggagctggcgtgta

SEQ ID NO: 5204 - DNA, 23 bp, Artificial Sequence
  Synthetic Construct
tggtgcctgtgatggttaattcc

SEQ ID NO: 5205 - DNA, 24 bp, Artificial Sequence
  Synthetic Construct
aattagaatcagctgggcttagca

SEQ ID NO: 5206 - DNA, 22 bp, Artificial Sequence
  Synthetic Construct
agcacctgaattttggcagaga

SEQ ID NO: 5207 - DNA, 21 bp, Artificial Sequence
  Synthetic Construct
tttggggtggcatttcctgaa

SEQ ID NO: 5208 - DNA, 24 bp, Artificial Sequence
  Synthetic Construct
tctgacaggggatttcagctagtg

SEQ ID NO: 5209 - DNA, 21 bp, Artificial Sequence
  Synthetic Construct
gccactagcagacacctgtgt

SEQ ID NO: 5210 - DNA, 21 bp, Artificial Sequence
  Synthetic Construct
tgctgagctgatgggttgtag

SEQ ID NO: 5211 - DNA, 21 bp, Artificial Sequence
  Synthetic Construct
agccagactccagggatagag

SEQ ID NO: 5212 - DNA, 21 bp, Artificial Sequence
  Synthetic Construct
tgggtgagtcactggattgct

SEQ ID NO: 5213 - DNA, 25 bp, Artificial Sequence
  Synthetic Construct
cagagttagatgagtgggcttcctt

SEQ ID NO: 5214 - DNA, 27 bp, Artificial Sequence
  Synthetic Construct
ggttgtgaccctacttacttactcctt

SEQ ID NO: 5215 - DNA, 26 bp, Artificial Sequence
  Synthetic Construct
gaggatttattgagaggcgattgtca

SEQ ID NO: 5216 - DNA, 26 bp, Artificial Sequence
  Synthetic Construct
cccccaagaatcttaccttcagacta

SEQ ID NO: 5217 - DNA, 24 bp, Artificial Sequence
  Synthetic Construct
ctcgtgggctcctttccttaaatg

SEQ ID NO: 5218 - DNA, 22 bp, Artificial Sequence
  Synthetic Construct
gccttgtgaagagggggtagga

SEQ ID NO: 5219 - DNA, 24 bp, Artificial Sequence
  Synthetic Construct
cctgccttgaccagagtacagttt

SEQ ID NO: 5220 - DNA, 19 bp, Artificial Sequence
  Synthetic Construct
ccagcaccggtgagtgttt

SEQ ID NO: 5221 - DNA, 27 bp, Artificial Sequence
  Synthetic Construct
gcaggatagggattaggttcctaacag

SEQ ID NO: 5222 - DNA, 21 bp, Artificial Sequence
  Synthetic Construct
tgtggactcgtagccttcaga

SEQ ID NO: 5223 - DNA, 21 bp, Artificial Sequence
  Synthetic Construct
agctggtaaggggcatccatt

SEQ ID NO: 5224 - DNA, 25 bp, Artificial Sequence
  Synthetic Construct
ggggtctcttgtcttagagatgagt

SEQ ID NO: 5225 - DNA, 18 bp, Artificial Sequence
  Synthetic Construct
tggggccacgtctgaaca

SEQ ID NO: 5226 - DNA, 22 bp, Artificial Sequence
  Synthetic Construct
gtctcatgcagagttggtgact

SEQ ID NO: 5227 - DNA, 19 bp, Artificial Sequence
  Synthetic Construct
tcagcccaggctcgaacca

SEQ ID NO: 5228 - DNA, 23 bp, Artificial Sequence
  Synthetic Construct
acagattttgcccttggacagtt

SEQ ID NO: 5229 - DNA, 21 bp, Artificial Sequence
  Synthetic Construct
ttcctccaacactgccattgt

SEQ ID NO: 5230 - DNA, 27 bp, Artificial Sequence
  Synthetic Construct
ggaggttgggtgcatctaaatgtaagg

SEQ ID NO: 5231 - DNA, 29 bp, Artificial Sequence
  Synthetic Construct
aagtaagggtgtgatggtgtttattattc

SEQ ID NO: 5232 - DNA, 22 bp, Artificial Sequence
  Synthetic Construct
ggcagtgtgaaaggtgactgta

SEQ ID NO: 5233 - DNA, 25 bp, Artificial Sequence
  Synthetic Construct
caggtatgtttaggaacagcaagga

SEQ ID NO: 5234 - DNA, 22 bp, Artificial Sequence
  Synthetic Construct
aaggagcagcagactccaaagg

SEQ ID NO: 5235 - DNA, 24 bp, Artificial Sequence
  Synthetic Construct
gccaaaaactgacaagtggtactg

SEQ ID NO: 5236 - DNA, 21 bp, Artificial Sequence
  Synthetic Construct
ctgagtgtgttaggggcttgt

SEQ ID NO: 5237 - DNA, 18 bp, Artificial Sequence
  Synthetic Construct
tgctgcagcaacgtctgt

SEQ ID NO: 5238 - DNA, 26 bp, Artificial Sequence
  Synthetic Construct
gcatgactccaatgcactaagtagga

SEQ ID NO: 5239 - DNA, 26 bp, Artificial Sequence
  Synthetic Construct
gcttgctttagaactgactagcaaag

SEQ ID NO: 5240 - DNA, 22 bp, Artificial Sequence
  Synthetic Construct
tgggcttcctattcagcatcag

SEQ ID NO: 5241 - DNA, 25 bp, Artificial Sequence
  Synthetic Construct
ctgtagactgaaatcagggaattgc

SEQ ID NO: 5242 - DNA, 27 bp, Artificial Sequence
  Synthetic Construct
ggaagaatgttgggatgaaaagaaggt

SEQ ID NO: 5243 - DNA, 22 bp, Artificial Sequence
  Synthetic Construct
ggaatttggagggcaacatgga

SEQ ID NO: 5244 - DNA, 18 bp, Artificial Sequence
  Synthetic Construct
cagtgcgcgctccctgaa

SEQ ID NO: 5245 - DNA, 25 bp, Artificial Sequence
  Synthetic Construct
ctgggtctttcagaagtgacccata

SEQ ID NO: 5246 - DNA, 22 bp, Artificial Sequence
  Synthetic Construct
ggagcttgcttcccatttttcc

SEQ ID NO: 5247 - DNA, 23 bp, Artificial Sequence
  Synthetic Construct
agggaaggagttgtgagattcca

SEQ ID NO: 5248 - DNA, 22 bp, Artificial Sequence
  Synthetic Construct
tgaactggaattgcagcaacag

SEQ ID NO: 5249 - DNA, 22 bp, Artificial Sequence
  Synthetic Construct
gcaaagccttctctcgcacatt

SEQ ID NO: 5250 - DNA, 29 bp, Artificial Sequence
  Synthetic Construct
cctgtccatttgtatttaggtatgagctt

SEQ ID NO: 5251 - DNA, 29 bp, Artificial Sequence
  Synthetic Construct
gggttagctaggagtgagtattactaagc

SEQ ID NO: 5252 - DNA, 24 bp, Artificial Sequence
  Synthetic Construct
ggtggttccaaagaagggatcaga

SEQ ID NO: 5253 - DNA, 24 bp, Artificial Sequence
  Synthetic Construct
gcagacactcagtgcatgtttgtg

SEQ ID NO: 5254 - DNA, 21 bp, Artificial Sequence
  Synthetic Construct
cctcaagccagtggtctcttc

SEQ ID NO: 5255 - DNA, 22 bp, Artificial Sequence
  Synthetic Construct
tggcctaaaagtggcctgctat

SEQ ID NO: 5256 - DNA, 24 bp, Artificial Sequence
  Synthetic Construct
ctgtagtccttgaagggagaagga

SEQ ID NO: 5257 - DNA, 22 bp, Artificial Sequence
  Synthetic Construct
gatgtgctgagaagggttcaga

SEQ ID NO: 5258 - DNA, 25 bp, Artificial Sequence
  Synthetic Construct
gcaactttgtgcttaaacctgaagt

SEQ ID NO: 5259 - DNA, 18 bp, Artificial Sequence
  Synthetic Construct
aggcgggagtgctagcat

SEQ ID NO: 5260 - DNA, 22 bp, Artificial Sequence
  Synthetic Construct
cctgcctcattggtatgtggtt

SEQ ID NO: 5261 - DNA, 22 bp, Artificial Sequence
  Synthetic Construct
gctgagattttgcccagtacgt

SEQ ID NO: 5262 - DNA, 28 bp, Artificial Sequence
  Synthetic Construct
tgtatcttttgcagttacctcttaaacc

SEQ ID NO: 5263 - DNA, 22 bp, Artificial Sequence
  Synthetic Construct
aggaccacaacctgatgaagtc

SEQ ID NO: 5264 - DNA, 20 bp, Artificial Sequence
  Synthetic Construct
acctcatgcgtcaggactca

SEQ ID NO: 5265 - DNA, 26 bp, Artificial Sequence
  Synthetic Construct
tctgaatccctgttacattctttcca

SEQ ID NO: 5266 - DNA, 26 bp, Artificial Sequence
  Synthetic Construct
ccagagtatttgtctccaagctatcc

SEQ ID NO: 5267 - DNA, 21 bp, Artificial Sequence
  Synthetic Construct
ggcagtaaggaggccctgcta

SEQ ID NO: 5268 - DNA, 22 bp, Artificial Sequence
  Synthetic Construct
aacctgtattggctgcgtgagt

SEQ ID NO: 5269 - DNA, 22 bp, Artificial Sequence
  Synthetic Construct
agtttctgctctgccactacca

SEQ ID NO: 5270 - DNA, 25 bp, Artificial Sequence
  Synthetic Construct
gggtctagaatggattgcagctgtt

SEQ ID NO: 5271 - DNA, 19 bp, Artificial Sequence
  Synthetic Construct
aggccaagtcccaggtcaa

SEQ ID NO: 5272 - DNA, 19 bp, Artificial Sequence
  Synthetic Construct
tgggcccaagcaggactgt

SEQ ID NO: 5273 - DNA, 20 bp, Artificial Sequence
  Synthetic Construct
tcagtgcatggcctctctct

SEQ ID NO: 5274 - DNA, 23 bp, Artificial Sequence
  Synthetic Construct
tgtggccttcgagacaattactg

SEQ ID NO: 5275 - DNA, 24 bp, Artificial Sequence
  Synthetic Construct
cctgcaaaccgttgacaatttagg

SEQ ID NO: 5276 - DNA, 27 bp, Artificial Sequence
  Synthetic Construct
aaaatccacatagatttccaggtgaga

SEQ ID NO: 5277 - DNA, 23 bp, Artificial Sequence
  Synthetic Construct
ccatagggatgctgacatttgct

SEQ ID NO: 5278 - DNA, 24 bp, Artificial Sequence
  Synthetic Construct
ctgaggctcaaagtgatacagcta

SEQ ID NO: 5279 - DNA, 23 bp, Artificial Sequence
  Synthetic Construct
gaaaagaacagagctcccatgct

SEQ ID NO: 5280 - DNA, 24 bp, Artificial Sequence
  Synthetic Construct
cacgaacatcaaactgaggagcta

SEQ ID NO: 5281 - DNA, 28 bp, Artificial Sequence
  Synthetic Construct
ggttgtaacggaaatacaggttcagttg

SEQ ID NO: 5282 - DNA, 21 bp, Artificial Sequence
  Synthetic Construct
ctggctccaagctctttcgaa

SEQ ID NO: 5283 - DNA, 22 bp, Artificial Sequence
  Synthetic Construct
aaggtctgcctggtttctatgg

SEQ ID NO: 5284 - DNA, 28 bp, Artificial Sequence
  Synthetic Construct
agagtgagacttaggaatcattcattgg

SEQ ID NO: 5285 - DNA, 27 bp, Artificial Sequence
  Synthetic Construct
cgctcagtttacatatatgggttagga

SEQ ID NO: 5286 - DNA, 21 bp, Artificial Sequence
  Synthetic Construct
agaagtgtgcctgacgacaag

SEQ ID NO: 5287 - DNA, 22 bp, Artificial Sequence
  Synthetic Construct
gagctgggggtttgtgatcata

SEQ ID NO: 5288 - DNA, 24 bp, Artificial Sequence
  Synthetic Construct
ggaccaggtttctagcagtgagaa

SEQ ID NO: 5289 - DNA, 22 bp, Artificial Sequence
  Synthetic Construct
gcagacctggtcaagaagacat

SEQ ID NO: 5290 - DNA, 20 bp, Artificial Sequence
  Synthetic Construct
gccatggccctctgaaagca

SEQ ID NO: 5291 - DNA, 22 bp, Artificial Sequence
  Synthetic Construct
ccagcgatgttcagggatgtaa

SEQ ID NO: 5292 - DNA, 22 bp, Artificial Sequence
  Synthetic Construct
gtggtccttccatgacttgtga

SEQ ID NO: 5293 - DNA, 20 bp, Artificial Sequence
  Synthetic Construct
aatggacccaaggccacatg

SEQ ID NO: 5294 - DNA, 21 bp, Artificial Sequence
  Synthetic Construct
ctgcagggggattagggaaga

SEQ ID NO: 5295 - DNA, 25 bp, Artificial Sequence
  Synthetic Construct
cgcttccacctcttttgactgattc

SEQ ID NO: 5296 - DNA, 24 bp, Artificial Sequence
  Synthetic Construct
ggctggtgcagtaggaaattaacc

SEQ ID NO: 5297 - DNA, 24 bp, Artificial Sequence
  Synthetic Construct
cacctaccttcagcctttttagca

SEQ ID NO: 5298 - DNA, 18 bp, Artificial Sequence
  Synthetic Construct
gtaggcagcccccttcca

SEQ ID NO: 5299 - DNA, 22 bp, Artificial Sequence
  Synthetic Construct
gctccttcctactggcattcct

SEQ ID NO: 5300 - DNA, 22 bp, Artificial Sequence
  Synthetic Construct
ttgatgctgtgactgggagatg

SEQ ID NO: 5301 - DNA, 22 bp, Artificial Sequence
  Synthetic Construct
tgggagtcttcagacctgtctt

SEQ ID NO: 5302 - DNA, 25 bp, Artificial Sequence
  Synthetic Construct
cattactccaccagtgcaaatctct

SEQ ID NO: 5303 - DNA, 20 bp, Artificial Sequence
  Synthetic Construct
cagcagctggcactgacaca

SEQ ID NO: 5304 - DNA, 22 bp, Artificial Sequence
  Synthetic Construct
cccaatcaaggagccctgaaat

SEQ ID NO: 5305 - DNA, 27 bp, Artificial Sequence
  Synthetic Construct
ccaaacaaggaggcagaaaatgtaacc

SEQ ID NO: 5306 - DNA, 21 bp, Artificial Sequence
  Synthetic Construct
aaggacttctcagggcaagtg

SEQ ID NO: 5307 - DNA, 26 bp, Artificial Sequence
  Synthetic Construct
cagtagctgtcaagtttttccagaag

SEQ ID NO: 5308 - DNA, 24 bp, Artificial Sequence
  Synthetic Construct
gttttccccctttaccaggaatca

SEQ ID NO: 5309 - DNA, 22 bp, Artificial Sequence
  Synthetic Construct
aactgccacagaactccaagag

SEQ ID NO: 5310 - DNA, 22 bp, Artificial Sequence
  Synthetic Construct
ctatggggagcagcacattctt

SEQ ID NO: 5311 - DNA, 22 bp, Artificial Sequence
  Synthetic Construct
gaaggaagagacatgggccatt

SEQ ID NO: 5312 - DNA, 22 bp, Artificial Sequence
  Synthetic Construct
agtcccagcactaatcccaaga

SEQ ID NO: 5313 - DNA, 21 bp, Artificial Sequence
  Synthetic Construct
tgaacccaggcatgtgttcga

SEQ ID NO: 5314 - DNA, 24 bp, Artificial Sequence
  Synthetic Construct
ggagatagtcaccagtagcatgga

SEQ ID NO: 5315 - DNA, 26 bp, Artificial Sequence
  Synthetic Construct
tggttgatagcaagtacttgaaacct

SEQ ID NO: 5316 - DNA, 25 bp, Artificial Sequence
  Synthetic Construct
caattttccatttgcctgactctca

SEQ ID NO: 5317 - DNA, 23 bp, Artificial Sequence
  Synthetic Construct
ggtcaggaccaagagtggacata

SEQ ID NO: 5318 - DNA, 19 bp, Artificial Sequence
  Synthetic Construct
gggtgagtcccgtgtaggt

SEQ ID NO: 5319 - DNA, 26 bp, Artificial Sequence
  Synthetic Construct
ccttgtgctagacatgaagcaagatc

SEQ ID NO: 5320 - DNA, 27 bp, Artificial Sequence
  Synthetic Construct
ggatgtttttctcaccactatttccat

SEQ ID NO: 5321 - DNA, 25 bp, Artificial Sequence
  Synthetic Construct
gctgaccatttggcttcttggtttc

SEQ ID NO: 5322 - DNA, 26 bp, Artificial Sequence
  Synthetic Construct
gacacttaatacacactgtccggatt

SEQ ID NO: 5323 - DNA, 20 bp, Artificial Sequence
  Synthetic Construct
cgaggcaggaggtacacatc

SEQ ID NO: 5324 - DNA, 29 bp, Artificial Sequence
  Synthetic Construct
ccaatttagcacgtttcaaactggatttt

SEQ ID NO: 5325 - DNA, 22 bp, Artificial Sequence
  Synthetic Construct
cagtaagtgcacagtccttgct

SEQ ID NO: 5326 - DNA, 23 bp, Artificial Sequence
  Synthetic Construct
cgagatggatcctcgagtctttc

SEQ ID NO: 5327 - DNA, 24 bp, Artificial Sequence
  Synthetic Construct
ggaatcattgtgtcccaggaattg

SEQ ID NO: 5328 - DNA, 22 bp, Artificial Sequence
  Synthetic Construct
gcacagactgcacagatacact

SEQ ID NO: 5329 - DNA, 19 bp, Artificial Sequence
  Synthetic Construct
ccctgcagggttgcttagg

SEQ ID NO: 5330 - DNA, 23 bp, Artificial Sequence
  Synthetic Construct
tggggaaggtatctgtggtacct

SEQ ID NO: 5331 - DNA, 20 bp, Artificial Sequence
  Synthetic Construct
accccaagaagcaccttcca

SEQ ID NO: 5332 - DNA, 22 bp, Artificial Sequence
  Synthetic Construct
aagtccttgctgctggagaaga

SEQ ID NO: 5333 - DNA, 21 bp, Artificial Sequence
  Synthetic Construct
ctgctgagcagtggtactgtt

SEQ ID NO: 5334 - DNA, 21 bp, Artificial Sequence
  Synthetic Construct
agcaactgaacagcccattcc

SEQ ID NO: 5335 - DNA, 23 bp, Artificial Sequence
  Synthetic Construct
gcagtttccccttccaaattcac

SEQ ID NO: 5336 - DNA, 19 bp, Artificial Sequence
  Synthetic Construct
gggtcccagggggctgtaa

SEQ ID NO: 5337 - DNA, 21 bp, Artificial Sequence
  Synthetic Construct
cccagacaagaacaccagctt

SEQ ID NO: 5338 - DNA, 18 bp, Artificial Sequence
  Synthetic Construct
agctctggggtcgttgga

SEQ ID NO: 5339 - DNA, 25 bp, Artificial Sequence
  Synthetic Construct
cttgggtggtctgaaaaatgtaggt

SEQ ID NO: 5340 - DNA, 24 bp, Artificial Sequence
  Synthetic Construct
ccagctacctaggaccaagtcata

SEQ ID NO: 5341 - DNA, 26 bp, Artificial Sequence
  Synthetic Construct
agtcccatatccagctgattttaacc

SEQ ID NO: 5342 - DNA, 23 bp, Artificial Sequence
  Synthetic Construct
cgccttacagtccctacttcttc

SEQ ID NO: 5343 - DNA, 20 bp, Artificial Sequence
  Synthetic Construct
catgggagccaacagtcagt

SEQ ID NO: 5344 - DNA, 24 bp, Artificial Sequence
  Synthetic Construct
tttgaaatgaggaccacggtactt

SEQ ID NO: 5345 - DNA, 20 bp, Artificial Sequence
  Synthetic Construct
tgcatggaggatggggaagt

SEQ ID NO: 5346 - DNA, 23 bp, Artificial Sequence
  Synthetic Construct
caccgacaaaccttcccctcttt

SEQ ID NO: 5347 - DNA, 25 bp, Artificial Sequence
  Synthetic Construct
cagggaaagtgctgagtcattttca

SEQ ID NO: 5348 - DNA, 25 bp, Artificial Sequence
  Synthetic Construct
gaagagaagcaggtcactgaagtct

SEQ ID NO: 5349 - DNA, 24 bp, Artificial Sequence
  Synthetic Construct
gcttaagaaaccaggggccataac

SEQ ID NO: 5350 - DNA, 22 bp, Artificial Sequence
  Synthetic Construct
gggcttgaaaaacctgggtgtt

SEQ ID NO: 5351 - DNA, 22 bp, Artificial Sequence
  Synthetic Construct
gcgctttatggtgtccatacct

SEQ ID NO: 5352 - DNA, 25 bp, Artificial Sequence
  Synthetic Construct
gcatttcctaggactttctgtttgc

SEQ ID NO: 5353 - DNA, 20 bp, Artificial Sequence
  Synthetic Construct
tgtgctcatggaggctccta

SEQ ID NO: 5354 - DNA, 22 bp, Artificial Sequence
  Synthetic Construct
gtctcccatctctggtctctgt

SEQ ID NO: 5355 - DNA, 24 bp, Artificial Sequence
  Synthetic Construct
gtctgttcaggcttttgctttttg

SEQ ID NO: 5356 - DNA, 21 bp, Artificial Sequence
  Synthetic Construct
agggatgacagagcccaagta

SEQ ID NO: 5357 - DNA, 24 bp, Artificial Sequence
  Synthetic Construct
ggaggaatggtttctgaggagctt

SEQ ID NO: 5358 - DNA, 21 bp, Artificial Sequence
  Synthetic Construct
tgcccagtgaggtccaacagt

SEQ ID NO: 5359 - DNA, 22 bp, Artificial Sequence
  Synthetic Construct
acactggctctggaacaatgag

SEQ ID NO: 5360 - DNA, 22 bp, Artificial Sequence
  Synthetic Construct
tgaggttagttagggccaaagc

SEQ ID NO: 5361 - DNA, 21 bp, Artificial Sequence
  Synthetic Construct
cgagtttgggcaggcataagc

SEQ ID NO: 5362 - DNA, 21 bp, Artificial Sequence
  Synthetic Construct
ccgtccacctacatcatgctt

SEQ ID NO: 5363 - DNA, 23 bp, Artificial Sequence
  Synthetic Construct
gtgtttcgtggcttaacgtaagg

SEQ ID NO: 5364 - DNA, 25 bp, Artificial Sequence
  Synthetic Construct
catgaggtctatctgtcttcttgct

SEQ ID NO: 5365 - DNA, 22 bp, Artificial Sequence
  Synthetic Construct
gtgtgggccaaaggttgtagaa

SEQ ID NO: 5366 - DNA, 24 bp, Artificial Sequence
  Synthetic Construct
acaggaacttcccacctgatcttc

SEQ ID NO: 5367 - DNA, 22 bp, Artificial Sequence
  Synthetic Construct
acatgcaagatggcctcattca

SEQ ID NO: 5368 - DNA, 24 bp, Artificial Sequence
  Synthetic Construct
cctttagggcccttagacaccttt

SEQ ID NO: 5369 - DNA, 24 bp, Artificial Sequence
  Synthetic Construct
gaggctaaggacattgtacactgt

SEQ ID NO: 5370 - DNA, 24 bp, Artificial Sequence
  Synthetic Construct
gcatcataggggcttagaggttgt

SEQ ID NO: 5371 - DNA, 20 bp, Artificial Sequence
  Synthetic Construct
aggcctccacccctacttct

SEQ ID NO: 5372 - DNA, 23 bp, Artificial Sequence
  Synthetic Construct
cttatagtgaggcaagccctgtt

SEQ ID NO: 5373 - DNA, 20 bp, Artificial Sequence
  Synthetic Construct
aaggggaggggtgggagaaa

SEQ ID NO: 5374 - DNA, 25 bp, Artificial Sequence
  Synthetic Construct
cacctgtcccttgttcagtaatgag

SEQ ID NO: 5375 - DNA, 28 bp, Artificial Sequence
  Synthetic Construct
ggtgatacttagtaggaagcactgcttt

SEQ ID NO: 5376 - DNA, 24 bp, Artificial Sequence
  Synthetic Construct
cttagctctcatgcccctacatag

SEQ ID NO: 5377 - DNA, 21 bp, Artificial Sequence
  Synthetic Construct
caagcggggatgtcaagaaac

SEQ ID NO: 5378 - DNA, 21 bp, Artificial Sequence
  Synthetic Construct
accctcactcccttcaaccaa

SEQ ID NO: 5379 - DNA, 30 bp, Artificial Sequence
  Synthetic Construct
tgaatggttataacgacataatctgacact

SEQ ID NO: 5380 - DNA, 23 bp, Artificial Sequence
  Synthetic Construct
tggaagtgggagtagagggtaag

SEQ ID NO: 5381 - DNA, 21 bp, Artificial Sequence
  Synthetic Construct
aaggccaggattccagtgaag

SEQ ID NO: 5382 - DNA, 25 bp, Artificial Sequence
  Synthetic Construct
acctaagggaaatgggagtttgaat

SEQ ID NO: 5383 - DNA, 20 bp, Artificial Sequence
  Synthetic Construct
tgccccaccccatcaagact

SEQ ID NO: 5384 - DNA, 20 bp, Artificial Sequence
  Synthetic Construct
aggagtcccttgcactgttg

SEQ ID NO: 5385 - DNA, 21 bp, Artificial Sequence
  Synthetic Construct
acgctcataggtcacctgtct

SEQ ID NO: 5386 - DNA, 22 bp, Artificial Sequence
  Synthetic Construct
gggcttccactggtagacaaga

SEQ ID NO: 5387 - DNA, 19 bp, Artificial Sequence
  Synthetic Construct
ggcccgaaatggtgcttct

SEQ ID NO: 5388 - DNA, 20 bp, Artificial Sequence
  Synthetic Construct
aatgtgagcctggggattgg

SEQ ID NO: 5389 - DNA, 26 bp, Artificial Sequence
  Synthetic Construct
ggatgggatcatcaactcaaatgcaa

SEQ ID NO: 5390 - DNA, 22 bp, Artificial Sequence
  Synthetic Construct
acctagcaatgagacagcaaca

SEQ ID NO: 5391 - DNA, 20 bp, Artificial Sequence
  Synthetic Construct
acagcttcagtggctttgca

SEQ ID NO: 5392 - DNA, 26 bp, Artificial Sequence
  Synthetic Construct
ggctgattcagacttatctagcatga

SEQ ID NO: 5393 - DNA, 24 bp, Artificial Sequence
  Synthetic Construct
gcacaacatggactattgggtgtt

SEQ ID NO: 5394 - DNA, 22 bp, Artificial Sequence
  Synthetic Construct
tcttctcccaatccctgcaact

SEQ ID NO: 5395 - DNA, 20 bp, Artificial Sequence
  Synthetic Construct
ccagagctggccacactaag

SEQ ID NO: 5396 - DNA, 22 bp, Artificial Sequence
  Synthetic Construct
ttgagttcccacctgtctgttc

SEQ ID NO: 5397 - DNA, 23 bp, Artificial Sequence
  Synthetic Construct
ctcatctgctattgtcccaacct

SEQ ID NO: 5398 - DNA, 23 bp, Artificial Sequence
  Synthetic Construct
ggatggagaatgtgggaatcgaa

SEQ ID NO: 5399 - DNA, 24 bp, Artificial Sequence
  Synthetic Construct
gcaatggcaggtgtgatggtagaa

SEQ ID NO: 5400 - DNA, 21 bp, Artificial Sequence
  Synthetic Construct
aggttgttagcagggctgtga

SEQ ID NO: 5401 - DNA, 22 bp, Artificial Sequence
  Synthetic Construct
catcatggcagggattcaggtt

SEQ ID NO: 5402 - DNA, 28 bp, Artificial Sequence
  Synthetic Construct
aagaaaccatcttttaagtgttgggaat

SEQ ID NO: 5403 - DNA, 26 bp, Artificial Sequence
  Synthetic Construct
cctgtgagtgtggttgtaacaagaga

SEQ ID NO: 5404 - DNA, 22 bp, Artificial Sequence
  Synthetic Construct
ttccccaaatctggcagaagga

SEQ ID NO: 5405 - DNA, 21 bp, Artificial Sequence
  Synthetic Construct
tcccttcactctccccctcta

SEQ ID NO: 5406 - DNA, 20 bp, Artificial Sequence
  Synthetic Construct
ggagagggccatgtgacaag

SEQ ID NO: 5407 - DNA, 22 bp, Artificial Sequence
  Synthetic Construct
agctgttttccccaaagtgcta

SEQ ID NO: 5408 - DNA, 21 bp, Artificial Sequence
  Synthetic Construct
gccagctgggtttcattggaa

SEQ ID NO: 5409 - DNA, 24 bp, Artificial Sequence
  Synthetic Construct
gatgaagtgggatgtaggcaatga

SEQ ID NO: 5410 - DNA, 24 bp, Artificial Sequence
  Synthetic Construct
aacggccaaatagaacatgtagga

SEQ ID NO: 5411 - DNA, 23 bp, Artificial Sequence
  Synthetic Construct
gggaccaaagtctgtcacaatga

SEQ ID NO: 5412 - DNA, 24 bp, Artificial Sequence
  Synthetic Construct
gcagtgggctttccaaactgaaga

SEQ ID NO: 5413 - DNA, 22 bp, Artificial Sequence
  Synthetic Construct
tggtggctgatacatggcaagt

SEQ ID NO: 5414 - DNA, 27 bp, Artificial Sequence
  Synthetic Construct
cctctcccctgtatctactcaaatagc

SEQ ID NO: 5415 - DNA, 22 bp, Artificial Sequence
  Synthetic Construct
gagagaaggggacactgactca

SEQ ID NO: 5416 - DNA, 21 bp, Artificial Sequence
  Synthetic Construct
acaaggagcccatgtctttgc

SEQ ID NO: 5417 - DNA, 22 bp, Artificial Sequence
  Synthetic Construct
tggaacacagtgggagtcagta

SEQ ID NO: 5418 - DNA, 24 bp, Artificial Sequence
  Synthetic Construct
tccatctgtcaaggtgccatattt

SEQ ID NO: 5419 - DNA, 19 bp, Artificial Sequence
  Synthetic Construct
acccacccactcactccat

SEQ ID NO: 5420 - DNA, 22 bp, Artificial Sequence
  Synthetic Construct
aagccttggtgccctacttaga

SEQ ID NO: 5421 - DNA, 24 bp, Artificial Sequence
  Synthetic Construct
gtgtgatgtgatgtgatccacaag

SEQ ID NO: 5422 - DNA, 24 bp, Artificial Sequence
  Synthetic Construct
gacttccagttagaagcccacctt

SEQ ID NO: 5423 - DNA, 22 bp, Artificial Sequence
  Synthetic Construct
tcccagggccaaactctgagaa

SEQ ID NO: 5424 - DNA, 23 bp, Artificial Sequence
  Synthetic Construct
ctgtgttcaggtacaggtctgaa

SEQ ID NO: 5425 - DNA, 21 bp, Artificial Sequence
  Synthetic Construct
gctacccatgccactgggaaa

SEQ ID NO: 5426 - DNA, 24 bp, Artificial Sequence
  Synthetic Construct
agttaggtgtgtcagcttttcaca

SEQ ID NO: 5427 - DNA, 25 bp, Artificial Sequence
  Synthetic Construct
gcatccccttcagaatcatgaatcg

SEQ ID NO: 5428 - DNA, 20 bp, Artificial Sequence
  Synthetic Construct
gcacaggccgtcttcatgga

SEQ ID NO: 5429 - DNA, 21 bp, Artificial Sequence
  Synthetic Construct
caccgcccaacttgattcagt

SEQ ID NO: 5430 - DNA, 19 bp, Artificial Sequence
  Synthetic Construct
aggccaggacaaggtgtgt

SEQ ID NO: 5431 - DNA, 26 bp, Artificial Sequence
  Synthetic Construct
ggactcgaggaatggacattcatctg

SEQ ID NO: 5432 - DNA, 25 bp, Artificial Sequence
  Synthetic Construct
ctttgggagactgggtaacttttgc

SEQ ID NO: 5433 - DNA, 23 bp, Artificial Sequence
  Synthetic Construct
agggacctctatgactcctacac

SEQ ID NO: 5434 - DNA, 21 bp, Artificial Sequence
  Synthetic Construct
ggtttgtgtgacaggcattcc

SEQ ID NO: 5435 - DNA, 24 bp, Artificial Sequence
  Synthetic Construct
ctccctcaatccaggatgttcttc

SEQ ID NO: 5436 - DNA, 24 bp, Artificial Sequence
  Synthetic Construct
gcaggtcatcctttctccttctac

SEQ ID NO: 5437 - DNA, 24 bp, Artificial Sequence
  Synthetic Construct
tgtccctgagtctgagttttgttg

SEQ ID NO: 5438 - DNA, 25 bp, Artificial Sequence
  Synthetic Construct
tgatgagtggaagaagatgcaaaga

SEQ ID NO: 5439 - DNA, 23 bp, Artificial Sequence
  Synthetic Construct
gcaacttccctaaatccctccaa

SEQ ID NO: 5440 - DNA, 27 bp, Artificial Sequence
  Synthetic Construct
gctccaaatatctgaagagctcatgtg

SEQ ID NO: 5441 - DNA, 22 bp, Artificial Sequence
  Synthetic Construct
ctgacttcccctaggagtccat

SEQ ID NO: 5442 - DNA, 22 bp, Artificial Sequence
  Synthetic Construct
ctgtctgctggcattcagttca

SEQ ID NO: 5443 - DNA, 22 bp, Artificial Sequence
  Synthetic Construct
gcattgtgagctctccaaaggt

SEQ ID NO: 5444 - DNA, 20 bp, Artificial Sequence
  Synthetic Construct
ccagctctggcacctagaga

SEQ ID NO: 5445 - DNA, 27 bp, Artificial Sequence
  Synthetic Construct
gggtacaagctcaagttagaagtacag

SEQ ID NO: 5446 - DNA, 27 bp, Artificial Sequence
  Synthetic Construct
ggtaagacagttttccctactcttctc

SEQ ID NO: 5447 - DNA, 22 bp, Artificial Sequence
  Synthetic Construct
tgatggcagagcaaaccacaaa

SEQ ID NO: 5448 - DNA, 20 bp, Artificial Sequence
  Synthetic Construct
caggggcctcacacttgcat

SEQ ID NO: 5449 - DNA, 21 bp, Artificial Sequence
  Synthetic Construct
agctgcagtggttggaattgg

SEQ ID NO: 5450 - DNA, 22 bp, Artificial Sequence
  Synthetic Construct
acagggtgaggagactttctga

SEQ ID NO: 5451 - DNA, 26 bp, Artificial Sequence
  Synthetic Construct
cggcaagaacatcagctatgttaacc

SEQ ID NO: 5452 - DNA, 26 bp, Artificial Sequence
  Synthetic Construct
gccccagatcctagaaagagaatgtg

SEQ ID NO: 5453 - DNA, 23 bp, Artificial Sequence
  Synthetic Construct
tgagttgagagcctcagacttct

SEQ ID NO: 5454 - DNA, 20 bp, Artificial Sequence
  Synthetic Construct
agagccctctacccctctct

SEQ ID NO: 5455 - DNA, 24 bp, Artificial Sequence
  Synthetic Construct
accaagaaggacactgaggttcac

SEQ ID NO: 5456 - DNA, 21 bp, Artificial Sequence
  Synthetic Construct
actgtcccctctgcatggtat

SEQ ID NO: 5457 - DNA, 21 bp, Artificial Sequence
  Synthetic Construct
ttggctgctggggagcattta

SEQ ID NO: 5458 - DNA, 22 bp, Artificial Sequence
  Synthetic Construct
aggacaggacagagcttttgag

SEQ ID NO: 5459 - DNA, 26 bp, Artificial Sequence
  Synthetic Construct
tgtgcattcatagaggtgaggataaa

SEQ ID NO: 5460 - DNA, 21 bp, Artificial Sequence
  Synthetic Construct
ttgggcatgaacagcctacct

SEQ ID NO: 5461 - DNA, 24 bp, Artificial Sequence
  Synthetic Construct
gcagcagatggcacaatgtaaagg

SEQ ID NO: 5462 - DNA, 28 bp, Artificial Sequence
  Synthetic Construct
gtggaatccattatagggtgtgatacct

SEQ ID NO: 5463 - DNA, 22 bp, Artificial Sequence
  Synthetic Construct
tcagagcgtgctggctatgtta

SEQ ID NO: 5464 - DNA, 25 bp, Artificial Sequence
  Synthetic Construct
gcacagaactgttcagctagaggat

SEQ ID NO: 5465 - DNA, 22 bp, Artificial Sequence
  Synthetic Construct
ccctcatctccagatggcagaa

SEQ ID NO: 5466 - DNA, 25 bp, Artificial Sequence
  Synthetic Construct
gtcccagtgatctgttagagaaagg

SEQ ID NO: 5467 - DNA, 26 bp, Artificial Sequence
  Synthetic Construct
gccccaatcctagctaatcaggatca

SEQ ID NO: 5468 - DNA, 24 bp, Artificial Sequence
  Synthetic Construct
ccctactgtgtggcaatgaagaga

SEQ ID NO: 5469 - DNA, 25 bp, Artificial Sequence
  Synthetic Construct
agctatggcagaattatcactgctt

SEQ ID NO: 5470 - DNA, 24 bp, Artificial Sequence
  Synthetic Construct
gcgcacttctctctcaaacacact

SEQ ID NO: 5471 - DNA, 19 bp, Artificial Sequence
  Synthetic Construct
ggcctggaagacggggttt

SEQ ID NO: 5472 - DNA, 30 bp, Artificial Sequence
  Synthetic Construct
tgtctgataattacaacatctgtgtcatct

SEQ ID NO: 5473 - DNA, 21 bp, Artificial Sequence
  Synthetic Construct
agtggctgtggtggaaatcca

SEQ ID NO: 5474 - DNA, 21 bp, Artificial Sequence
  Synthetic Construct
aaacgaggctcttgggaatgg

SEQ ID NO: 5475 - DNA, 23 bp, Artificial Sequence
  Synthetic Construct
tgtatgtggactgcaaggttagg

SEQ ID NO: 5476 - DNA, 20 bp, Artificial Sequence
  Synthetic Construct
cctccctgaagcccaacaca

SEQ ID NO: 5477 - DNA, 26 bp, Artificial Sequence
  Synthetic Construct
ggtttttgtttgatctcacctggaaa

SEQ ID NO: 5478 - DNA, 19 bp, Artificial Sequence
  Synthetic Construct
aaggcaggcctcagaagca

SEQ ID NO: 5479 - DNA, 19 bp, Artificial Sequence
  Synthetic Construct
tggggagtgcagggagaga

SEQ ID NO: 5480 - DNA, 24 bp, Artificial Sequence
  Synthetic Construct
ctgatttacaccccgtgtaatgga

SEQ ID NO: 5481 - DNA, 19 bp, Artificial Sequence
  Synthetic Construct
ccaccaagaggcccaatgc

SEQ ID NO: 5482 - DNA, 26 bp, Artificial Sequence
  Synthetic Construct
ctgagatgtgtgagaggagatatgtg

SEQ ID NO: 5483 - DNA, 19 bp, Artificial Sequence
  Synthetic Construct
tggagagggctggcaatct

SEQ ID NO: 5484 - DNA, 29 bp, Artificial Sequence
  Synthetic Construct
gctacaaataatctggattcctgacatca

SEQ ID NO: 5485 - DNA, 21 bp, Artificial Sequence
  Synthetic Construct
tctggaagctctcccctatgc

SEQ ID NO: 5486 - DNA, 21 bp, Artificial Sequence
  Synthetic Construct
gagcccccagcattcagtgtt

SEQ ID NO: 5487 - DNA, 22 bp, Artificial Sequence
  Synthetic Construct
tttgctcctgggtgaagcaaga

SEQ ID NO: 5488 - DNA, 22 bp, Artificial Sequence
  Synthetic Construct
ggggccaatcaggaaattccat

SEQ ID NO: 5489 - DNA, 22 bp, Artificial Sequence
  Synthetic Construct
ctcatctgagggcttgaaacct

SEQ ID NO: 5490 - DNA, 20 bp, Artificial Sequence
  Synthetic Construct
aggcaggggaaacagaacca

SEQ ID NO: 5491 - DNA, 24 bp, Artificial Sequence
  Synthetic Construct
gtgctacagtagagacctgggaaa

SEQ ID NO: 5492 - DNA, 19 bp, Artificial Sequence
  Synthetic Construct
tgctcccgggagtccattg

SEQ ID NO: 5493 - DNA, 26 bp, Artificial Sequence
  Synthetic Construct
cactaggatgtttatcactgccatca

SEQ ID NO: 5494 - DNA, 23 bp, Artificial Sequence
  Synthetic Construct
gcagggagccatctgaaggtact

SEQ ID NO: 5495 - DNA, 21 bp, Artificial Sequence
  Synthetic Construct
tggaaggggatgatggagtgt

SEQ ID NO: 5496 - DNA, 22 bp, Artificial Sequence
  Synthetic Construct
ctgccacaggacactcaaattg

SEQ ID NO: 5497 - DNA, 24 bp, Artificial Sequence
  Synthetic Construct
aggtctcaccagacacagattcca

SEQ ID NO: 5498 - DNA, 21 bp, Artificial Sequence
  Synthetic Construct
tgcctgggacttcagctagca

SEQ ID NO: 5499 - DNA, 24 bp, Artificial Sequence
  Synthetic Construct
cactgctttattgtgtccagttgt

SEQ ID NO: 5500 - DNA, 23 bp, Artificial Sequence
  Synthetic Construct
gggtggcaaagctacaaaggaat

SEQ ID NO: 5501 - DNA, 22 bp, Artificial Sequence
  Synthetic Construct
gcaatggccacgtcaatatcct

SEQ ID NO: 5502 - DNA, 20 bp, Artificial Sequence
  Synthetic Construct
agacccgaagcacgtggtat

SEQ ID NO: 5503 - DNA, 22 bp, Artificial Sequence
  Synthetic Construct
tggagcatgtacctaggggaaa

SEQ ID NO: 5504 - DNA, 20 bp, Artificial Sequence
  Synthetic Construct
aggccaccataccacatgct

SEQ ID NO: 5505 - DNA, 26 bp, Artificial Sequence
  Synthetic Construct
ggctacacagtccatgtcataaatgc

SEQ ID NO: 5506 - DNA, 22 bp, Artificial Sequence
  Synthetic Construct
agactggggacaagatggcata

SEQ ID NO: 5507 - DNA, 27 bp, Artificial Sequence
  Synthetic Construct
ggccactgttaaaaaccaagttatgca

SEQ ID NO: 5508 - DNA, 24 bp, Artificial Sequence
  Synthetic Construct
gtttcccctcttctcttgccataa

SEQ ID NO: 5509 - DNA, 21 bp, Artificial Sequence
  Synthetic Construct
gcttggcggttgttgattggt

SEQ ID NO: 5510 - DNA, 21 bp, Artificial Sequence
  Synthetic Construct
ttctacagggcccttgggaat

SEQ ID NO: 5511 - DNA, 21 bp, Artificial Sequence
  Synthetic Construct
actggaggagacagcctttct

SEQ ID NO: 5512 - DNA, 26 bp, Artificial Sequence
  Synthetic Construct
gggtagagagaccgtttccacaatac

SEQ ID NO: 5513 - DNA, 22 bp, Artificial Sequence
  Synthetic Construct
aacttgctccagatcccatgtg

SEQ ID NO: 5514 - DNA, 23 bp, Artificial Sequence
  Synthetic Construct
gtgtgccaaggaaaagagacact

SEQ ID NO: 5515 - DNA, 23 bp, Artificial Sequence
  Synthetic Construct
cttgggataaggctctggttctc

SEQ ID NO: 5516 - DNA, 24 bp, Artificial Sequence
  Synthetic Construct
gacagaggagaacacatccttctc

SEQ ID NO: 5517 - DNA, 24 bp, Artificial Sequence
  Synthetic Construct
aaggtggatttatcgctcatgtct

SEQ ID NO: 5518 - DNA, 20 bp, Artificial Sequence
  Synthetic Construct
tcctcatctggcacgatggt

SEQ ID NO: 5519 - DNA, 23 bp, Artificial Sequence
  Synthetic Construct
tgcatcattgagggagtgtcatt

SEQ ID NO: 5520 - DNA, 27 bp, Artificial Sequence
  Synthetic Construct
gctaccattgaacttagggtgaaagtc

SEQ ID NO: 5521 - DNA, 24 bp, Artificial Sequence
  Synthetic Construct
ccgtaggtccctactactacaagt

SEQ ID NO: 5522 - DNA, 22 bp, Artificial Sequence
  Synthetic Construct
ctccagactgaattggccaact

SEQ ID NO: 5523 - DNA, 26 bp, Artificial Sequence
  Synthetic Construct
gggagagtgatctcaacatgtatcat

SEQ ID NO: 5524 - DNA, 23 bp, Artificial Sequence
  Synthetic Construct
ctcatcaccattgacgtcctaca

SEQ ID NO: 5525 - DNA, 22 bp, Artificial Sequence
  Synthetic Construct
cctgagtgttgggttgtgtgat

SEQ ID NO: 5526 - DNA, 22 bp, Artificial Sequence
  Synthetic Construct
tgtacctttggggagtcatcct

SEQ ID NO: 5527 - DNA, 25 bp, Artificial Sequence
  Synthetic Construct
tccttctaagacctgagagtgagaa

SEQ ID NO: 5528 - DNA, 23 bp, Artificial Sequence
  Synthetic Construct
gggaacagcaaccttatccagtt

SEQ ID NO: 5529 - DNA, 20 bp, Artificial Sequence
  Synthetic Construct
agtgggtagctggcacttct

SEQ ID NO: 5530 - DNA, 24 bp, Artificial Sequence
  Synthetic Construct
gtgaggatcagtcaaccaaccaat

SEQ ID NO: 5531 - DNA, 22 bp, Artificial Sequence
  Synthetic Construct
cctcaggtgtgctctccttgct

SEQ ID NO: 5532 - DNA, 23 bp, Artificial Sequence
  Synthetic Construct
ttggacaggcccaggataacatc

SEQ ID NO: 5533 - DNA, 22 bp, Artificial Sequence
  Synthetic Construct
tgttcacaccaggcagtgatct

SEQ ID NO: 5534 - DNA, 24 bp, Artificial Sequence
  Synthetic Construct
gcaaaccaaatcctagcacagaga

SEQ ID NO: 5535 - DNA, 21 bp, Artificial Sequence
  Synthetic Construct
tctgtcccacagctggagaag

SEQ ID NO: 5536 - DNA, 23 bp, Artificial Sequence
  Synthetic Construct
ccacactgcatttggaatttggt

SEQ ID NO: 5537 - DNA, 24 bp, Artificial Sequence
  Synthetic Construct
agtttctgggggaaggagtaacag

SEQ ID NO: 5538 - DNA, 22 bp, Artificial Sequence
  Synthetic Construct
cgaggtcgctcctttctaacca

SEQ ID NO: 5539 - DNA, 24 bp, Artificial Sequence
  Synthetic Construct
gggaagatttcctgcattcacctt

SEQ ID NO: 5540 - DNA, 22 bp, Artificial Sequence
  Synthetic Construct
cttaaggcagcaggatggtcaa

SEQ ID NO: 5541 - DNA, 20 bp, Artificial Sequence
  Synthetic Construct
agagtcagcagcatgcatgt

SEQ ID NO: 5542 - DNA, 22 bp, Artificial Sequence
  Synthetic Construct
aggagagtgctgaatggctgat

SEQ ID NO: 5543 - DNA, 20 bp, Artificial Sequence
  Synthetic Construct
ttgggggtcaggtgctcagt

SEQ ID NO: 5544 - DNA, 26 bp, Artificial Sequence
  Synthetic Construct
agaacatgtctgtagtccagatgttt

SEQ ID NO: 5545 - DNA, 18 bp, Artificial Sequence
  Synthetic Construct
ctgccaggccctgtcaca

SEQ ID NO: 5546 - DNA, 25 bp, Artificial Sequence
  Synthetic Construct
gacaggacagaagagtaggtaagct

SEQ ID NO: 5547 - DNA, 27 bp, Artificial Sequence
  Synthetic Construct
ggtgagaaatacataggtctcaggatt

SEQ ID NO: 5548 - DNA, 19 bp, Artificial Sequence
  Synthetic Construct
ccaggcctgagtcctgtgt

SEQ ID NO: 5549 - DNA, 27 bp, Artificial Sequence
  Synthetic Construct
aggaaggcatcatgctatataattgct

SEQ ID NO: 5550 - DNA, 28 bp, Artificial Sequence
  Synthetic Construct
gcctaaccttcaaagatacttcagtgtt

SEQ ID NO: 5551 - DNA, 26 bp, Artificial Sequence
  Synthetic Construct
ggtggtttagtacaaacatgctgagt

SEQ ID NO: 5552 - DNA, 22 bp, Artificial Sequence
  Synthetic Construct
gtcacgagcagctgcctaattt

SEQ ID NO: 5553 - DNA, 22 bp, Artificial Sequence
  Synthetic Construct
ccttttgcctttcccacctctt

SEQ ID NO: 5554 - DNA, 22 bp, Artificial Sequence
  Synthetic Construct
tggaggtcaaagtctccagcat

SEQ ID NO: 5555 - DNA, 20 bp, Artificial Sequence
  Synthetic Construct
gcctagcgcctgttgacctt

SEQ ID NO: 5556 - DNA, 26 bp, Artificial Sequence
  Synthetic Construct
cccagcccttaatcttaagtctaagc

SEQ ID NO: 5557 - DNA, 21 bp, Artificial Sequence
  Synthetic Construct
actgtgccagactctctttgg

SEQ ID NO: 5558 - DNA, 20 bp, Artificial Sequence
  Synthetic Construct
caggccttccacagaacaca

SEQ ID NO: 5559 - DNA, 20 bp, Artificial Sequence
  Synthetic Construct
ggccatccatgtgccaatcc

SEQ ID NO: 5560 - DNA, 24 bp, Artificial Sequence
  Synthetic Construct
caggatgttccaaggactcagaga

SEQ ID NO: 5561 - DNA, 26 bp, Artificial Sequence
  Synthetic Construct
ctgtgtgacatgtacaggtgaaagtt

SEQ ID NO: 5562 - DNA, 25 bp, Artificial Sequence
  Synthetic Construct
tccatagcttgcctcttctcatact

SEQ ID NO: 5563 - DNA, 22 bp, Artificial Sequence
  Synthetic Construct
ttggtgcagatgagaggtttgc

SEQ ID NO: 5564 - DNA, 23 bp, Artificial Sequence
  Synthetic Construct
atgtagtctagcctgggattcca

SEQ ID NO: 5565 - DNA, 20 bp, Artificial Sequence
  Synthetic Construct
aagccccacaccctggtaga

SEQ ID NO: 5566 - DNA, 19 bp, Artificial Sequence
  Synthetic Construct
tgcttgagcgtggcaggtt

SEQ ID NO: 5567 - DNA, 19 bp, Artificial Sequence
  Synthetic Construct
agccgtcctgaagctgtgt

SEQ ID NO: 5568 - DNA, 20 bp, Artificial Sequence
  Synthetic Construct
ccactggctcaaccctcctt

SEQ ID NO: 5569 - DNA, 24 bp, Artificial Sequence
  Synthetic Construct
ggtctcattttcctgccccttgaa

SEQ ID NO: 5570 - DNA, 24 bp, Artificial Sequence
  Synthetic Construct
aggagagcaccactttcagttctc

SEQ ID NO: 5571 - DNA, 27 bp, Artificial Sequence
  Synthetic Construct
cagagtgtcttacttttctcactgtca

SEQ ID NO: 5572 - DNA, 24 bp, Artificial Sequence
  Synthetic Construct
gtgaagcagcagagttaacaagac

SEQ ID NO: 5573 - DNA, 21 bp, Artificial Sequence
  Synthetic Construct
agatccgtcaggctcaacact

SEQ ID NO: 5574 - DNA, 26 bp, Artificial Sequence
  Synthetic Construct
gctgggtcatgttaatcctgtttgtc

SEQ ID NO: 5575 - DNA, 22 bp, Artificial Sequence
  Synthetic Construct
cctgggccttgtcattgtcttt

SEQ ID NO: 5576 - DNA, 27 bp, Artificial Sequence
  Synthetic Construct
cccacaaaaattagctgtgtagtcttg

SEQ ID NO: 5577 - DNA, 28 bp, Artificial Sequence
  Synthetic Construct
gcatgatatgtctttcagtcacctgtga

SEQ ID NO: 5578 - DNA, 26 bp, Artificial Sequence
  Synthetic Construct
ttatatgcattcagctcttccaggat

SEQ ID NO: 5579 - DNA, 23 bp, Artificial Sequence
  Synthetic Construct
atcctgggaggcatcggtgacaa

SEQ ID NO: 5580 - DNA, 24 bp, Artificial Sequence
  Synthetic Construct
gccagttgttctctatggccttaa

SEQ ID NO: 5581 - DNA, 24 bp, Artificial Sequence
  Synthetic Construct
tgtacctagagagacctgggaact

SEQ ID NO: 5582 - DNA, 26 bp, Artificial Sequence
  Synthetic Construct
aggatgctgtaatacaatgtcaggat

SEQ ID NO: 5583 - DNA, 30 bp, Artificial Sequence
  Synthetic Construct
tgatggttttgttgtaaaattctgtaggta

SEQ ID NO: 5584 - DNA, 26 bp, Artificial Sequence
  Synthetic Construct
caacaacccacttttgacatcatctc

SEQ ID NO: 5585 - DNA, 21 bp, Artificial Sequence
  Synthetic Construct
ttacctggctccaccgaaaca

SEQ ID NO: 5586 - DNA, 22 bp, Artificial Sequence
  Synthetic Construct
actggaagttggggggatttca

SEQ ID NO: 5587 - DNA, 23 bp, Artificial Sequence
  Synthetic Construct
gacagcccctgtccattaatagg

SEQ ID NO: 5588 - DNA, 21 bp, Artificial Sequence
  Synthetic Construct
caggactaagcagccaagaca

SEQ ID NO: 5589 - DNA, 20 bp, Artificial Sequence
  Synthetic Construct
tttgcaccaaggccatgcat

SEQ ID NO: 5590 - DNA, 21 bp, Artificial Sequence
  Synthetic Construct
agggaggttccagctcaatcc

SEQ ID NO: 5591 - DNA, 26 bp, Artificial Sequence
  Synthetic Construct
agtgaactgagtttttgtacctacct

SEQ ID NO: 5592 - DNA, 25 bp, Artificial Sequence
  Synthetic Construct
tcactgtctgaaatgcttgttacca

SEQ ID NO: 5593 - DNA, 25 bp, Artificial Sequence
  Synthetic Construct
ccaaagtaagtgacagcaaacttct

SEQ ID NO: 5594 - DNA, 22 bp, Artificial Sequence
  Synthetic Construct
ctttaccattggagggcttcct

SEQ ID NO: 5595 - DNA, 24 bp, Artificial Sequence
  Synthetic Construct
ccttctcttctcatgggacagaag

SEQ ID NO: 5596 - DNA, 28 bp, Artificial Sequence
  Synthetic Construct
ggagtctgaatgaaaaacggttctctca

SEQ ID NO: 5597 - DNA, 21 bp, Artificial Sequence
  Synthetic Construct
tccccaccaaagttgcagaca

SEQ ID NO: 5598 - DNA, 19 bp, Artificial Sequence
  Synthetic Construct
ttaacccccgccagtcgta

SEQ ID NO: 5599 - DNA, 28 bp, Artificial Sequence
  Synthetic Construct
atgaagaaattcaatctagacccatcct

SEQ ID NO: 5600 - DNA, 29 bp, Artificial Sequence
  Synthetic Construct
cgggactatactctaccgtagttcatcag

SEQ ID NO: 5601 - DNA, 28 bp, Artificial Sequence
  Synthetic Construct
gtccctatccactaaactgatatcacaa

SEQ ID NO: 5602 - DNA, 20 bp, Artificial Sequence
  Synthetic Construct
gtgacagcaggcttctctgt

SEQ ID NO: 5603 - DNA, 21 bp, Artificial Sequence
  Synthetic Construct
aactggggttgaggtgggaat

SEQ ID NO: 5604 - DNA, 27 bp, Artificial Sequence
  Synthetic Construct
tggagaataaaccccagatttctagtg

SEQ ID NO: 5605 - DNA, 19 bp, Artificial Sequence
  Synthetic Construct
agctgtgtgggccgcaaaa

SEQ ID NO: 5606 - DNA, 28 bp, Artificial Sequence
  Synthetic Construct
gcaaagatcaatgtgaacccatcatctc

SEQ ID NO: 5607 - DNA, 24 bp, Artificial Sequence
  Synthetic Construct
ctggttctgcagtaatacgtggtt

SEQ ID NO: 5608 - DNA, 22 bp, Artificial Sequence
  Synthetic Construct
agcaaatgctccctctgtgcat

SEQ ID NO: 5609 - DNA, 21 bp, Artificial Sequence
  Synthetic Construct
acccagtcctgaagccattgc

SEQ ID NO: 5610 - DNA, 22 bp, Artificial Sequence
  Synthetic Construct
tcaagttgagcaggccagtgaa

SEQ ID NO: 5611 - DNA, 20 bp, Artificial Sequence
  Synthetic Construct
cccctggggattgaccttga

SEQ ID NO: 5612 - DNA, 21 bp, Artificial Sequence
  Synthetic Construct
tctcacccacacgagacaagt

SEQ ID NO: 5613 - DNA, 24 bp, Artificial Sequence
  Synthetic Construct
agacatggattcctgagccatacc

SEQ ID NO: 5614 - DNA, 20 bp, Artificial Sequence
  Synthetic Construct
gtcactgcgccagtcataca

SEQ ID NO: 5615 - DNA, 30 bp, Artificial Sequence
  Synthetic Construct
cccaaaagtaagagatctccatttcatcag

SEQ ID NO: 5616 - DNA, 29 bp, Artificial Sequence
  Synthetic Construct
cctgattcctagtattttggggaggaatg

SEQ ID NO: 5617 - DNA, 21 bp, Artificial Sequence
  Synthetic Construct
ttgccacccatcgcatcaaga

SEQ ID NO: 5618 - DNA, 23 bp, Artificial Sequence
  Synthetic Construct
tcgggaaaagaggcctttattgg

SEQ ID NO: 5619 - DNA, 24 bp, Artificial Sequence
  Synthetic Construct
gataggccccaagatgatggtaag

SEQ ID NO: 5620 - DNA, 24 bp, Artificial Sequence
  Synthetic Construct
ctgcctttgttgacctagaatgca

SEQ ID NO: 5621 - DNA, 23 bp, Artificial Sequence
  Synthetic Construct
agattgcccctgacattttgtga

SEQ ID NO: 5622 - DNA, 23 bp, Artificial Sequence
  Synthetic Construct
gctccttagaacaacctgtgtga

SEQ ID NO: 5623 - DNA, 22 bp, Artificial Sequence
  Synthetic Construct
ggcagggaaagagtggacattt

SEQ ID NO: 5624 - DNA, 25 bp, Artificial Sequence
  Synthetic Construct
atggaatgttgatcctcctttccat

SEQ ID NO: 5625 - DNA, 21 bp, Artificial Sequence
  Synthetic Construct
caatgcccaccacagatgtga

SEQ ID NO: 5626 - DNA, 23 bp, Artificial Sequence
  Synthetic Construct
gtggccaaggagatttcaatgca

SEQ ID NO: 5627 - DNA, 28 bp, Artificial Sequence
  Synthetic Construct
tcattcctgaatctgggtatttgtagtc

SEQ ID NO: 5628 - DNA, 21 bp, Artificial Sequence
  Synthetic Construct
gggcttcgcagagactgatct

SEQ ID NO: 5629 - DNA, 23 bp, Artificial Sequence
  Synthetic Construct
cctgactttgcccccttttgatt

SEQ ID NO: 5630 - DNA, 22 bp, Artificial Sequence
  Synthetic Construct
agtcaatcaacccaggaaagca

SEQ ID NO: 5631 - DNA, 30 bp, Artificial Sequence
  Synthetic Construct
gtgttttttacccagattcctaaagtttcc

SEQ ID NO: 5632 - DNA, 21 bp, Artificial Sequence
  Synthetic Construct
gcccagtgtacctgtgtctca

SEQ ID NO: 5633 - DNA, 26 bp, Artificial Sequence
  Synthetic Construct
gcctggagtaccaaagtcactttgac

SEQ ID NO: 5634 - DNA, 25 bp, Artificial Sequence
  Synthetic Construct
caagttactacttctggtggccaaa

SEQ ID NO: 5635 - DNA, 23 bp, Artificial Sequence
  Synthetic Construct
aaagccaaggcatcccttagaaa

SEQ ID NO: 5636 - DNA, 19 bp, Artificial Sequence
  Synthetic Construct
gcaacctgggagccttgct

SEQ ID NO: 5637 - DNA, 24 bp, Artificial Sequence
  Synthetic Construct
cctcacagagtagtttgggcacta

SEQ ID NO: 5638 - DNA, 25 bp, Artificial Sequence
  Synthetic Construct
gctagggaataagatgccacagctt

SEQ ID NO: 5639 - DNA, 24 bp, Artificial Sequence
  Synthetic Construct
ggggtttaaatcacagaggtgttg

SEQ ID NO: 5640 - DNA, 22 bp, Artificial Sequence
  Synthetic Construct
ctctgtctcactcagccatcgt

SEQ ID NO: 5641 - DNA, 20 bp, Artificial Sequence
  Synthetic Construct
tgcctccacactggccaaag

SEQ ID NO: 5642 - DNA, 23 bp, Artificial Sequence
  Synthetic Construct
acatggtgatgttggctgtatcc

SEQ ID NO: 5643 - DNA, 20 bp, Artificial Sequence
  Synthetic Construct
accaaggcagcctcacaatt

SEQ ID NO: 5644 - DNA, 21 bp, Artificial Sequence
  Synthetic Construct
aggaaccctcttcccaaacgt

SEQ ID NO: 5645 - DNA, 25 bp, Artificial Sequence
  Synthetic Construct
caaaacaagttgtagaccggatctg

SEQ ID NO: 5646 - DNA, 28 bp, Artificial Sequence
  Synthetic Construct
gtgaatctttaaagacccaacacttgac

SEQ ID NO: 5647 - DNA, 20 bp, Artificial Sequence
  Synthetic Construct
ctgactgcgtgggacttctg

SEQ ID NO: 5648 - DNA, 28 bp, Artificial Sequence
  Synthetic Construct
ggagcaatactcttccagttctttcttc

SEQ ID NO: 5649 - DNA, 24 bp, Artificial Sequence
  Synthetic Construct
acatccgaatacccagttcctctt

SEQ ID NO: 5650 - DNA, 24 bp, Artificial Sequence
  Synthetic Construct
ggcactgtatccaggtatgatgag

SEQ ID NO: 5651 - DNA, 26 bp, Artificial Sequence
  Synthetic Construct
gggagaaagggtgatgtaaagggtta

SEQ ID NO: 5652 - DNA, 24 bp, Artificial Sequence
  Synthetic Construct
gcacaaggggaaagcatgatttag

SEQ ID NO: 5653 - DNA, 24 bp, Artificial Sequence
  Synthetic Construct
gctagcacacagcaagttaattgg

SEQ ID NO: 5654 - DNA, 20 bp, Artificial Sequence
  Synthetic Construct
tgcccaaacttccgctactg

SEQ ID NO: 5655 - DNA, 25 bp, Artificial Sequence
  Synthetic Construct
ctgcatagaaaaggagtgaggaaca

SEQ ID NO: 5656 - DNA, 26 bp, Artificial Sequence
  Synthetic Construct
gaaaagagccttttccttctgttgac

SEQ ID NO: 5657 - DNA, 25 bp, Artificial Sequence
  Synthetic Construct
atgatctcaacaccaaactcttcct

SEQ ID NO: 5658 - DNA, 27 bp, Artificial Sequence
  Synthetic Construct
gagaagattttgtaagcaaggtgaact

SEQ ID NO: 5659 - DNA, 24 bp, Artificial Sequence
  Synthetic Construct
ggaccatccctgactcttacattc

SEQ ID NO: 5660 - DNA, 26 bp, Artificial Sequence
  Synthetic Construct
ttcctgaactaagtttggctctaaca

SEQ ID NO: 5661 - DNA, 21 bp, Artificial Sequence
  Synthetic Construct
tgtgctctgaggactctctgt

SEQ ID NO: 5662 - DNA, 21 bp, Artificial Sequence
  Synthetic Construct
agggcccagaccacattagat

SEQ ID NO: 5663 - DNA, 22 bp, Artificial Sequence
  Synthetic Construct
aggagtttgcagagccaatcag

SEQ ID NO: 5664 - DNA, 23 bp, Artificial Sequence
  Synthetic Construct
gtgagcagttgcaagtaggtgat

SEQ ID NO: 5665 - DNA, 28 bp, Artificial Sequence
  Synthetic Construct
ggtttgcatgatgagagttgatggatac

SEQ ID NO: 5666 - DNA, 25 bp, Artificial Sequence
  Synthetic Construct
catgcagctgataaaaagctttcca

SEQ ID NO: 5667 - DNA, 27 bp, Artificial Sequence
  Synthetic Construct
gcatggataaccagaaaaagcctttgg

SEQ ID NO: 5668 - DNA, 23 bp, Artificial Sequence
  Synthetic Construct
gtcactggccatcaaaagtcatc

SEQ ID NO: 5669 - DNA, 22 bp, Artificial Sequence
  Synthetic Construct
ttcagggttactggcctaccaa

SEQ ID NO: 5670 - DNA, 23 bp, Artificial Sequence
  Synthetic Construct
accttccagtccagcctctagtg

SEQ ID NO: 5671 - DNA, 18 bp, Artificial Sequence
  Synthetic Construct
aggaggccagcccttgag

SEQ ID NO: 5672 - DNA, 23 bp, Artificial Sequence
  Synthetic Construct
ctgtggtcatcactgtgaaatgc

SEQ ID NO: 5673 - DNA, 19 bp, Artificial Sequence
  Synthetic Construct
cagcctccccatgggatca

SEQ ID NO: 5674 - DNA, 22 bp, Artificial Sequence
  Synthetic Construct
cagctgcatggaaagaggaaga

SEQ ID NO: 5675 - DNA, 22 bp, Artificial Sequence
  Synthetic Construct
tccccagcttatcctgaagtga

SEQ ID NO: 5676 - DNA, 24 bp, Artificial Sequence
  Synthetic Construct
ccatggccatagttcccactgtaa

SEQ ID NO: 5677 - DNA, 23 bp, Artificial Sequence
  Synthetic Construct
tcaccaggaccatgtacctagaa

SEQ ID NO: 5678 - DNA, 24 bp, Artificial Sequence
  Synthetic Construct
caggtatctctgtgatcccagcat

SEQ ID NO: 5679 - DNA, 26 bp, Artificial Sequence
  Synthetic Construct
agcatagcatttccaaatctctctct

SEQ ID NO: 5680 - DNA, 27 bp, Artificial Sequence
  Synthetic Construct
ctgaattccagaggcatctttatctca

SEQ ID NO: 5681 - DNA, 22 bp, Artificial Sequence
  Synthetic Construct
tggaatggctggcccttcatac

SEQ ID NO: 5682 - DNA, 22 bp, Artificial Sequence
  Synthetic Construct
cagtgttctttggggcttttgg

SEQ ID NO: 5683 - DNA, 23 bp, Artificial Sequence
  Synthetic Construct
ggtaaacagcccttacacttgga

SEQ ID NO: 5684 - DNA, 22 bp, Artificial Sequence
  Synthetic Construct
cctacccagatccagtgaacca

SEQ ID NO: 5685 - DNA, 21 bp, Artificial Sequence
  Synthetic Construct
tgctcagaaccccttgagtct

SEQ ID NO: 5686 - DNA, 26 bp, Artificial Sequence
  Synthetic Construct
ccaccacactgatgtcaagagatctg

SEQ ID NO: 5687 - DNA, 27 bp, Artificial Sequence
  Synthetic Construct
gcaggtagtttagatttcagtctatgc

SEQ ID NO: 5688 - DNA, 22 bp, Artificial Sequence
  Synthetic Construct
cgaatcccatttggtcctggta

SEQ ID NO: 5689 - DNA, 24 bp, Artificial Sequence
  Synthetic Construct
cacaacagcctttctccatgaagt

SEQ ID NO: 5690 - DNA, 22 bp, Artificial Sequence
  Synthetic Construct
catgaggagggatcaccactga

SEQ ID NO: 5691 - DNA, 25 bp, Artificial Sequence
  Synthetic Construct
acagtgaattctgttccaagtcaac

SEQ ID NO: 5692 - DNA, 24 bp, Artificial Sequence
  Synthetic Construct
ggaaccttctcatgcatcgtttcc

SEQ ID NO: 5693 - DNA, 24 bp, Artificial Sequence
  Synthetic Construct
tctctgagaagacacctgctcttc

SEQ ID NO: 5694 - DNA, 24 bp, Artificial Sequence
  Synthetic Construct
ctcagccacaagtgctacaagatc

SEQ ID NO: 5695 - DNA, 21 bp, Artificial Sequence
  Synthetic Construct
agtctgcctttctgggatgca

SEQ ID NO: 5696 - DNA, 29 bp, Artificial Sequence
  Synthetic Construct
ccacaataagatgtctatccactaaacac

SEQ ID NO: 5697 - DNA, 22 bp, Artificial Sequence
  Synthetic Construct
ggaccagcagccaagaagatta

SEQ ID NO: 5698 - DNA, 23 bp, Artificial Sequence
  Synthetic Construct
aaagtgtgcacctgaagaatgtg

SEQ ID NO: 5699 - DNA, 22 bp, Artificial Sequence
  Synthetic Construct
cagcaaagatgtgtggcatgac

SEQ ID NO: 5700 - DNA, 23 bp, Artificial Sequence
  Synthetic Construct
gatactagctgccactggctaaa

SEQ ID NO: 5701 - DNA, 21 bp, Artificial Sequence
  Synthetic Construct
tgtggcttggttacccactga

SEQ ID NO: 5702 - DNA, 22 bp, Artificial Sequence
  Synthetic Construct
gcaagtgcaccctatttgttgt

SEQ ID NO: 5703 - DNA, 23 bp, Artificial Sequence
  Synthetic Construct
gagacccatttgcttgtgagaca

SEQ ID NO: 5704 - DNA, 23 bp, Artificial Sequence
  Synthetic Construct
ggctcaacattaggcactcaaca

SEQ ID NO: 5705 - DNA, 30 bp, Artificial Sequence
  Synthetic Construct
gaaccaagtaaatttcacataacctggtat

SEQ ID NO: 5706 - DNA, 18 bp, Artificial Sequence
  Synthetic Construct
ccctgtgtgccccatagc

SEQ ID NO: 5707 - DNA, 19 bp, Artificial Sequence
  Synthetic Construct
gcagcccagttggacagaa

SEQ ID NO: 5708 - DNA, 24 bp, Artificial Sequence
  Synthetic Construct
gtgattggccaagagactgatgag

SEQ ID NO: 5709 - DNA, 23 bp, Artificial Sequence
  Synthetic Construct
acgacaaccacatacacgtcatc

SEQ ID NO: 5710 - DNA, 22 bp, Artificial Sequence
  Synthetic Construct
aaatactctgcctccccttgtg

SEQ ID NO: 5711 - DNA, 24 bp, Artificial Sequence
  Synthetic Construct
ccaattggcaatacgttgggtaac

SEQ ID NO: 5712 - DNA, 25 bp, Artificial Sequence
  Synthetic Construct
gcctgtaacctcttcttccacattc

SEQ ID NO: 5713 - DNA, 22 bp, Artificial Sequence
  Synthetic Construct
gtgggcttcatgctagggtttt

SEQ ID NO: 5714 - DNA, 21 bp, Artificial Sequence
  Synthetic Construct
gcctggactgcaggaatgtct

SEQ ID NO: 5715 - DNA, 24 bp, Artificial Sequence
  Synthetic Construct
gggaacagggaaggagttaaagtc

SEQ ID NO: 5716 - DNA, 23 bp, Artificial Sequence
  Synthetic Construct
gccaagcacttgcatttctagca

SEQ ID NO: 5717 - DNA, 22 bp, Artificial Sequence
  Synthetic Construct
cctggggagctatggaactgaa

SEQ ID NO: 5718 - DNA, 24 bp, Artificial Sequence
  Synthetic Construct
caagcactggagatgcagagtatc

SEQ ID NO: 5719 - DNA, 24 bp, Artificial Sequence
  Synthetic Construct
ggttacagactgcatccatttcca

SEQ ID NO: 5720 - DNA, 25 bp, Artificial Sequence
  Synthetic Construct
ccctgtttttagtcggtccaaacac

SEQ ID NO: 5721 - DNA, 22 bp, Artificial Sequence
  Synthetic Construct
ttccaggccttgagaggagtgt

SEQ ID NO: 5722 - DNA, 23 bp, Artificial Sequence
  Synthetic Construct
gagcaaacattccaggtggatga

SEQ ID NO: 5723 - DNA, 25 bp, Artificial Sequence
  Synthetic Construct
gtctcctcactttacccttcagcta

SEQ ID NO: 5724 - DNA, 22 bp, Artificial Sequence
  Synthetic Construct
accaggtgctaggtactgtgtt

SEQ ID NO: 5725 - DNA, 24 bp, Artificial Sequence
  Synthetic Construct
gtgcagatcctcatgcatttagga

SEQ ID NO: 5726 - DNA, 24 bp, Artificial Sequence
  Synthetic Construct
gtcagaaggtcgatcatcctgtct

SEQ ID NO: 5727 - DNA, 27 bp, Artificial Sequence
  Synthetic Construct
gggaactatgcagagatgatgggtaaa

SEQ ID NO: 5728 - DNA, 21 bp, Artificial Sequence
  Synthetic Construct
gctgacagctgtggtcagaga

SEQ ID NO: 5729 - DNA, 23 bp, Artificial Sequence
  Synthetic Construct
tctatctgctccatgctcattgc

SEQ ID NO: 5730 - DNA, 25 bp, Artificial Sequence
  Synthetic Construct
agaggatgaagtaggctctaatcct

SEQ ID NO: 5731 - DNA, 22 bp, Artificial Sequence
  Synthetic Construct
tgggagaggctgtcagttgtga

SEQ ID NO: 5732 - DNA, 21 bp, Artificial Sequence
  Synthetic Construct
ttgggcccctcaagttctgtt

SEQ ID NO: 5733 - DNA, 22 bp, Artificial Sequence
  Synthetic Construct
ggacacagagctctcaattgca

SEQ ID NO: 5734 - DNA, 24 bp, Artificial Sequence
  Synthetic Construct
tccaggcacactgagatgcccata

SEQ ID NO: 5735 - DNA, 20 bp, Artificial Sequence
  Synthetic Construct
aacagctcacccctggattg

SEQ ID NO: 5736 - DNA, 25 bp, Artificial Sequence
  Synthetic Construct
acattgcagaaaggacaggttactc

SEQ ID NO: 5737 - DNA, 19 bp, Artificial Sequence
  Synthetic Construct
tgggcttgcggtagacact

SEQ ID NO: 5738 - DNA, 23 bp, Artificial Sequence
  Synthetic Construct
gccacattcaaagtccctgtagt

SEQ ID NO: 5739 - DNA, 19 bp, Artificial Sequence
  Synthetic Construct
acgcacatggaggctttcc

SEQ ID NO: 5740 - DNA, 20 bp, Artificial Sequence
  Synthetic Construct
agagcctcacagggaagcaa

SEQ ID NO: 5741 - DNA, 21 bp, Artificial Sequence
  Synthetic Construct
tgaggtcctgcttccggtatt

SEQ ID NO: 5742 - DNA, 23 bp, Artificial Sequence
  Synthetic Construct
actccagattggggatgatagct

SEQ ID NO: 5743 - DNA, 20 bp, Artificial Sequence
  Synthetic Construct
aagaccaaggcagtgcaagt

SEQ ID NO: 5744 - DNA, 26 bp, Artificial Sequence
  Synthetic Construct
gggctaagtttaagaagtgggattgg

SEQ ID NO: 5745 - DNA, 29 bp, Artificial Sequence
  Synthetic Construct
ggctacaatctacacacttcattcccaat

SEQ ID NO: 5746 - DNA, 22 bp, Artificial Sequence
  Synthetic Construct
agcccatacagccttccagaga

SEQ ID NO: 5747 - DNA, 21 bp, Artificial Sequence
  Synthetic Construct
tcccaggctgaggctatcctt

SEQ ID NO: 5748 - DNA, 23 bp, Artificial Sequence
  Synthetic Construct
cagactttcccttgcagaacagt

SEQ ID NO: 5749 - DNA, 24 bp, Artificial Sequence
  Synthetic Construct
ctgccatacaggaagctaaaatcg

SEQ ID NO: 5750 - DNA, 22 bp, Artificial Sequence
  Synthetic Construct
cacagtctctctcagcaatgca

SEQ ID NO: 5751 - DNA, 22 bp, Artificial Sequence
  Synthetic Construct
tgctgaccttgtcttcctacca

SEQ ID NO: 5752 - DNA, 20 bp, Artificial Sequence
  Synthetic Construct
tgactccagcacagggttga

SEQ ID NO: 5753 - DNA, 24 bp, Artificial Sequence
  Synthetic Construct
gtgaggaagctatggctcataagt

SEQ ID NO: 5754 - DNA, 19 bp, Artificial Sequence
  Synthetic Construct
ccgacgtaggctggaccaa

SEQ ID NO: 5755 - DNA, 21 bp, Artificial Sequence
  Synthetic Construct
cccagcatcacccagctttgc

SEQ ID NO: 5756 - DNA, 24 bp, Artificial Sequence
  Synthetic Construct
ggcgcttcctttagagtgtgtttc

SEQ ID NO: 5757 - DNA, 24 bp, Artificial Sequence
  Synthetic Construct
gaagcgagcttggaacttcttact

SEQ ID NO: 5758 - DNA, 25 bp, Artificial Sequence
  Synthetic Construct
actgggcctttatactccattactg

SEQ ID NO: 5759 - DNA, 18 bp, Artificial Sequence
  Synthetic Construct
caagcaccggcccatgtg

SEQ ID NO: 5760 - DNA, 25 bp, Artificial Sequence
  Synthetic Construct
gttaaccaagcacctccttatatgc

SEQ ID NO: 5761 - DNA, 18 bp, Artificial Sequence
  Synthetic Construct
agccccaggaggcaatgg

SEQ ID NO: 5762 - DNA, 25 bp, Artificial Sequence
  Synthetic Construct
ctgttttcacagttctctggcaaca

SEQ ID NO: 5763 - DNA, 24 bp, Artificial Sequence
  Synthetic Construct
gcagatgctcagtggatgtttgtg

SEQ ID NO: 5764 - DNA, 24 bp, Artificial Sequence
  Synthetic Construct
gggcttagtgatgctaaggatctg

SEQ ID NO: 5765 - DNA, 24 bp, Artificial Sequence
  Synthetic Construct
caccttaaccacagcatgatgttg

SEQ ID NO: 5766 - DNA, 30 bp, Artificial Sequence
  Synthetic Construct
ggagatagaagttagtttagcagttacctt

SEQ ID NO: 5767 - DNA, 23 bp, Artificial Sequence
  Synthetic Construct
ggcctgtttcaagacaagaagga

SEQ ID NO: 5768 - DNA, 26 bp, Artificial Sequence
  Synthetic Construct
cacaaacggtagggtagtaagtacct

SEQ ID NO: 5769 - DNA, 22 bp, Artificial Sequence
  Synthetic Construct
aaccaaagtccccaaccccttt

SEQ ID NO: 5770 - DNA, 25 bp, Artificial Sequence
  Synthetic Construct
aggggaaactatagagggggtaaac

SEQ ID NO: 5771 - DNA, 20 bp, Artificial Sequence
  Synthetic Construct
actccaagatgccacaacgt

SEQ ID NO: 5772 - DNA, 25 bp, Artificial Sequence
  Synthetic Construct
ggaacttatgggtcagatctggaaa

SEQ ID NO: 5773 - DNA, 26 bp, Artificial Sequence
  Synthetic Construct
ggtcattgagaaagtcatcccatctt

SEQ ID NO: 5774 - DNA, 22 bp, Artificial Sequence
  Synthetic Construct
aggtgggatccagttctgacaa

SEQ ID NO: 5775 - DNA, 22 bp, Artificial Sequence
  Synthetic Construct
cttccccttccctactctcctt

SEQ ID NO: 5776 - DNA, 24 bp, Artificial Sequence
  Synthetic Construct
atgtttgtgaacttggcagagaag

SEQ ID NO: 5777 - DNA, 28 bp, Artificial Sequence
  Synthetic Construct
agcaaatagacaaggtttttctcattcc

SEQ ID NO: 5778 - DNA, 24 bp, Artificial Sequence
  Synthetic Construct
ccctggtttagaggaatgctactc

SEQ ID NO: 5779 - DNA, 26 bp, Artificial Sequence
  Synthetic Construct
gtatgattccatgtacgtgagtttgg

SEQ ID NO: 5780 - DNA, 20 bp, Artificial Sequence
  Synthetic Construct
tgttggctgatggggggaaa

SEQ ID NO: 5781 - DNA, 22 bp, Artificial Sequence
  Synthetic Construct
gaatagagaggcccttgtgcat

SEQ ID NO: 5782 - DNA, 25 bp, Artificial Sequence
  Synthetic Construct
tttcagcccatagcatcatacttct

SEQ ID NO: 5783 - DNA, 24 bp, Artificial Sequence
  Synthetic Construct
tgtggttagacttcctgagaacca

SEQ ID NO: 5784 - DNA, 21 bp, Artificial Sequence
  Synthetic Construct
tggctagtgggcttgctttca

SEQ ID NO: 5785 - DNA, 22 bp, Artificial Sequence
  Synthetic Construct
gctcatgaatcctgctggctat

SEQ ID NO: 5786 - DNA, 24 bp, Artificial Sequence
  Synthetic Construct
tccctctctctccaacttttagct

SEQ ID NO: 5787 - DNA, 29 bp, Artificial Sequence
  Synthetic Construct
gctgattctgagatgtaataggctacaca

SEQ ID NO: 5788 - DNA, 24 bp, Artificial Sequence
  Synthetic Construct
ggttgggtttctgcatcctttgtg

SEQ ID NO: 5789 - DNA, 22 bp, Artificial Sequence
  Synthetic Construct
gcaatgccaagttcagccactt

SEQ ID NO: 5790 - DNA, 18 bp, Artificial Sequence
  Synthetic Construct
ggacaggcgagcgtatgg

SEQ ID NO: 5791 - DNA, 23 bp, Artificial Sequence
  Synthetic Construct
gaccaaggggctgacaaagttct

SEQ ID NO: 5792 - DNA, 25 bp, Artificial Sequence
  Synthetic Construct
gggtccaaatcagtgctggaaatga

SEQ ID NO: 5793 - DNA, 22 bp, Artificial Sequence
  Synthetic Construct
tcccttaatcggaaggcagtga

SEQ ID NO: 5794 - DNA, 24 bp, Artificial Sequence
  Synthetic Construct
aatgccacctggtaatgaagagaa

SEQ ID NO: 5795 - DNA, 23 bp, Artificial Sequence
  Synthetic Construct
gcatcagatgttccttggttcct

SEQ ID NO: 5796 - DNA, 22 bp, Artificial Sequence
  Synthetic Construct
agtggagctgggattctcaaca

SEQ ID NO: 5797 - DNA, 23 bp, Artificial Sequence
  Synthetic Construct
tccagattgggagagtgtttcct

SEQ ID NO: 5798 - DNA, 25 bp, Artificial Sequence
  Synthetic Construct
catttgttggtggctaattgaggat

SEQ ID NO: 5799 - DNA, 25 bp, Artificial Sequence
  Synthetic Construct
acaaatgatgccaacactgagatga

SEQ ID NO: 5800 - DNA, 24 bp, Artificial Sequence
  Synthetic Construct
ccatcagatgggtctattcacaca

SEQ ID NO: 5801 - DNA, 22 bp, Artificial Sequence
  Synthetic Construct
gctgttggagctgaatcaccta

SEQ ID NO: 5802 - DNA, 19 bp, Artificial Sequence
  Synthetic Construct
ggcaaggcctcgagaaagg

SEQ ID NO: 5803 - DNA, 23 bp, Artificial Sequence
  Synthetic Construct
ggctggggctatcttctcattca

SEQ ID NO: 5804 - DNA, 22 bp, Artificial Sequence
  Synthetic Construct
tccctgtgctgtcaatgagctt

SEQ ID NO: 5805 - DNA, 22 bp, Artificial Sequence
  Synthetic Construct
aacctgcatcctaggctctctt

SEQ ID NO: 5806 - DNA, 24 bp, Artificial Sequence
  Synthetic Construct
gacagcctattggtgaggataaca

SEQ ID NO: 5807 - DNA, 19 bp, Artificial Sequence
  Synthetic Construct
cccaggccctttgcttcct

SEQ ID NO: 5808 - DNA, 21 bp, Artificial Sequence
  Synthetic Construct
ttgatccgccctctctactca

SEQ ID NO: 5809 - DNA, 20 bp, Artificial Sequence
  Synthetic Construct
agactggggatggggcaaaa

SEQ ID NO: 5810 - DNA, 24 bp, Artificial Sequence
  Synthetic Construct
acctgaaaattgtcccgaatgtct

SEQ ID NO: 5811 - DNA, 26 bp, Artificial Sequence
  Synthetic Construct
ggacagttacataaaccagcagttac

SEQ ID NO: 5812 - DNA, 25 bp, Artificial Sequence
  Synthetic Construct
tctggatcttgaattccacactcaa

SEQ ID NO: 5813 - DNA, 21 bp, Artificial Sequence
  Synthetic Construct
tccgtcgtccccactgagtaa

SEQ ID NO: 5814 - DNA, 23 bp, Artificial Sequence
  Synthetic Construct
actatgtcactgaggctggagta

SEQ ID NO: 5815 - DNA, 24 bp, Artificial Sequence
  Synthetic Construct
gctgactttcttagccaccgtaca

SEQ ID NO: 5816 - DNA, 26 bp, Artificial Sequence
  Synthetic Construct
cccttgatctatctggagttcaccat

SEQ ID NO: 5817 - DNA, 22 bp, Artificial Sequence
  Synthetic Construct
ccgcccatgaaaatgcgatcat

SEQ ID NO: 5818 - DNA, 27 bp, Artificial Sequence
  Synthetic Construct
ctctgtcgaataatcatgtgtccacta

SEQ ID NO: 5819 - DNA, 24 bp, Artificial Sequence
  Synthetic Construct
cctcctaagtgttgcgttctttcg

SEQ ID NO: 5820 - DNA, 24 bp, Artificial Sequence
  Synthetic Construct
tgatccctgatgttggaggtaaga

SEQ ID NO: 5821 - DNA, 25 bp, Artificial Sequence
  Synthetic Construct
ggctgatgaattgcatgtgggtttc

SEQ ID NO: 5822 - DNA, 24 bp, Artificial Sequence
  Synthetic Construct
tctgacactgattcagggaaagag

SEQ ID NO: 5823 - DNA, 20 bp, Artificial Sequence
  Synthetic Construct
acagtgggccggtgtgataa

SEQ ID NO: 5824 - DNA, 26 bp, Artificial Sequence
  Synthetic Construct
gtcgtgaatcctagaatgtacatgct

SEQ ID NO: 5825 - DNA, 22 bp, Artificial Sequence
  Synthetic Construct
ctcatttcccacccaactccat

SEQ ID NO: 5826 - DNA, 20 bp, Artificial Sequence
  Synthetic Construct
atgccacacagcaagatcca

SEQ ID NO: 5827 - DNA, 20 bp, Artificial Sequence
  Synthetic Construct
tgtagctctccagccattgc

SEQ ID NO: 5828 - DNA, 18 bp, Artificial Sequence
  Synthetic Construct
ggcctgaggggagggaaa

SEQ ID NO: 5829 - DNA, 24 bp, Artificial Sequence
  Synthetic Construct
ctctggaatagaccgtgacaaagg

SEQ ID NO: 5830 - DNA, 25 bp, Artificial Sequence
  Synthetic Construct
cggagatttcaccattagcacttct

SEQ ID NO: 5831 - DNA, 20 bp, Artificial Sequence
  Synthetic Construct
ttgccccttcaggaagcaaa

SEQ ID NO: 5832 - DNA, 20 bp, Artificial Sequence
  Synthetic Construct
tggttgtggtgggggtggaa

SEQ ID NO: 5833 - DNA, 29 bp, Artificial Sequence
  Synthetic Construct
gcaaactaacacagcagtgaattgtaagt

SEQ ID NO: 5834 - DNA, 24 bp, Artificial Sequence
  Synthetic Construct
gggacatgggtaacagtcacattg

SEQ ID NO: 5835 - DNA, 24 bp, Artificial Sequence
  Synthetic Construct
ggaatcccagaagtctgacagtgt

SEQ ID NO: 5836 - DNA, 28 bp, Artificial Sequence
  Synthetic Construct
ccttttctactgacaaggggatatttgg

SEQ ID NO: 5837 - DNA, 23 bp, Artificial Sequence
  Synthetic Construct
ctcctagccaaacaaagcaagac

SEQ ID NO: 5838 - DNA, 21 bp, Artificial Sequence
  Synthetic Construct
tacctccactgccaccaccaa

SEQ ID NO: 5839 - DNA, 23 bp, Artificial Sequence
  Synthetic Construct
cccagtctgtgcttcctccttct

SEQ ID NO: 5840 - DNA, 24 bp, Artificial Sequence
  Synthetic Construct
ttgtaaaaaccaccctagcagtca

SEQ ID NO: 5841 - DNA, 22 bp, Artificial Sequence
  Synthetic Construct
tcacagccaagcatacctctgt

SEQ ID NO: 5842 - DNA, 23 bp, Artificial Sequence
  Synthetic Construct
aatcctggcaagatccccagatc

SEQ ID NO: 5843 - DNA, 20 bp, Artificial Sequence
  Synthetic Construct
gcccatctcaagtggctctt

SEQ ID NO: 5844 - DNA, 21 bp, Artificial Sequence
  Synthetic Construct
accgactgcagaaagctcaca

SEQ ID NO: 5845 - DNA, 24 bp, Artificial Sequence
  Synthetic Construct
ctgttgaatccacaagaccaaacc

SEQ ID NO: 5846 - DNA, 28 bp, Artificial Sequence
  Synthetic Construct
gactatactcacacacaaaattgctttg

SEQ ID NO: 5847 - DNA, 27 bp, Artificial Sequence
  Synthetic Construct
gcaaaagcaagatgactaagtgttcgt

SEQ ID NO: 5848 - DNA, 25 bp, Artificial Sequence
  Synthetic Construct
cctccagggtagtagacatatgtgt

SEQ ID NO: 5849 - DNA, 22 bp, Artificial Sequence
  Synthetic Construct
aggaagcttaggccttgttagc

SEQ ID NO: 5850 - DNA, 21 bp, Artificial Sequence
  Synthetic Construct
ggatgcaactgagggagcaaa

SEQ ID NO: 5851 - DNA, 19 bp, Artificial Sequence
  Synthetic Construct
aggcctgagtggggatgtc

SEQ ID NO: 5852 - DNA, 24 bp, Artificial Sequence
  Synthetic Construct
caccaagagatcgtgtcctcaaag

SEQ ID NO: 5853 - DNA, 28 bp, Artificial Sequence
  Synthetic Construct
gggaactccatcaatatttgtcctcgtt

SEQ ID NO: 5854 - DNA, 22 bp, Artificial Sequence
  Synthetic Construct
aggtctctaaagcccagtgcat

SEQ ID NO: 5855 - DNA, 24 bp, Artificial Sequence
  Synthetic Construct
aatgctgtatgtaggttggaagct

SEQ ID NO: 5856 - DNA, 24 bp, Artificial Sequence
  Synthetic Construct
gtgtttgagaaggtcagtctgaca

SEQ ID NO: 5857 - DNA, 25 bp, Artificial Sequence
  Synthetic Construct
ccttctgttaaagccagaactgtgt

SEQ ID NO: 5858 - DNA, 20 bp, Artificial Sequence
  Synthetic Construct
cccgcaatatgggcaacgtt

SEQ ID NO: 5859 - DNA, 27 bp, Artificial Sequence
  Synthetic Construct
ctaaaatagtatgtgagctgcattggt

SEQ ID NO: 5860 - DNA, 24 bp, Artificial Sequence
  Synthetic Construct
tgtaggtagttcccccaaactttc

SEQ ID NO: 5861 - DNA, 22 bp, Artificial Sequence
  Synthetic Construct
gtgagggaggtagggtttcaag

SEQ ID NO: 5862 - DNA, 24 bp, Artificial Sequence
  Synthetic Construct
caatctggtctcattgacgttgtc

SEQ ID NO: 5863 - DNA, 24 bp, Artificial Sequence
  Synthetic Construct
cccacattttacgggtgcatgttc

SEQ ID NO: 5864 - DNA, 22 bp, Artificial Sequence
  Synthetic Construct
ctatggagttttggcccacaga

SEQ ID NO: 5865 - DNA, 21 bp, Artificial Sequence
  Synthetic Construct
actgttctggatgggcaagtg

SEQ ID NO: 5866 - DNA, 28 bp, Artificial Sequence
  Synthetic Construct
ggcaatctactagctagaggtagttcag

SEQ ID NO: 5867 - DNA, 24 bp, Artificial Sequence
  Synthetic Construct
cctattttcctgcttgtggttacg

SEQ ID NO: 5868 - DNA, 20 bp, Artificial Sequence
  Synthetic Construct
atccacagccagcaaacagt

SEQ ID NO: 5869 - DNA, 22 bp, Artificial Sequence
  Synthetic Construct
aggttctgctctggcattttgg

SEQ ID NO: 5870 - DNA, 21 bp, Artificial Sequence
  Synthetic Construct
agagatgatggcagggacaga

SEQ ID NO: 5871 - DNA, 23 bp, Artificial Sequence
  Synthetic Construct
gcaatgctcccctattctgaaca

SEQ ID NO: 5872 - DNA, 27 bp, Artificial Sequence
  Synthetic Construct
cccaggtcaaaacccaaaatgttatcc

SEQ ID NO: 5873 - DNA, 24 bp, Artificial Sequence
  Synthetic Construct
cctccattaccctagtgagtacca

SEQ ID NO: 5874 - DNA, 25 bp, Artificial Sequence
  Synthetic Construct
ggcagtcattcaaacctaactctgt

SEQ ID NO: 5875 - DNA, 26 bp, Artificial Sequence
  Synthetic Construct
tggtaggaagtaagaggcaggttagg

SEQ ID NO: 5876 - DNA, 22 bp, Artificial Sequence
  Synthetic Construct
gcctagtgggttcagtcaagct

SEQ ID NO: 5877 - DNA, 23 bp, Artificial Sequence
  Synthetic Construct
ctggacttcaaagaaccgtgatg

SEQ ID NO: 5878 - DNA, 21 bp, Artificial Sequence
  Synthetic Construct
agccccacactactgatctca

SEQ ID NO: 5879 - DNA, 28 bp, Artificial Sequence
  Synthetic Construct
cccagaacacatgttaaatttcccctta

SEQ ID NO: 5880 - DNA, 24 bp, Artificial Sequence
  Synthetic Construct
acctgagcctacatctgagctctt

SEQ ID NO: 5881 - DNA, 26 bp, Artificial Sequence
  Synthetic Construct
tctccaactgaaaaccaatgtaaggt

SEQ ID NO: 5882 - DNA, 21 bp, Artificial Sequence
  Synthetic Construct
gcaaaaccctgaggcccttca

SEQ ID NO: 5883 - DNA, 21 bp, Artificial Sequence
  Synthetic Construct
gctgatttgcattggctcaca

SEQ ID NO: 5884 - DNA, 24 bp, Artificial Sequence
  Synthetic Construct
gtgcaggaagatggggagattaca

SEQ ID NO: 5885 - DNA, 21 bp, Artificial Sequence
  Synthetic Construct
tgctagattccgaggctggaa

SEQ ID NO: 5886 - DNA, 22 bp, Artificial Sequence
  Synthetic Construct
tggcatggctttaaaggttgga

SEQ ID NO: 5887 - DNA, 19 bp, Artificial Sequence
  Synthetic Construct
gcctggtgaatggcaaggt

SEQ ID NO: 5888 - DNA, 23 bp, Artificial Sequence
  Synthetic Construct
ccaacctgacaagtggagatctg

SEQ ID NO: 5889 - DNA, 21 bp, Artificial Sequence
  Synthetic Construct
acgaacccacatcagccagta

SEQ ID NO: 5890 - DNA, 24 bp, Artificial Sequence
  Synthetic Construct
tcctgctacctatgaagggtagga

SEQ ID NO: 5891 - DNA, 23 bp, Artificial Sequence
  Synthetic Construct
tgtcctggcctgataaggaagga

SEQ ID NO: 5892 - DNA, 29 bp, Artificial Sequence
  Synthetic Construct
tgatatcctgtgtcttggtgttaatacag

SEQ ID NO: 5893 - DNA, 27 bp, Artificial Sequence
  Synthetic Construct
ggactgcagagtaaatttttggctttg

SEQ ID NO: 5894 - DNA, 26 bp, Artificial Sequence
  Synthetic Construct
aagtgttgcagtaaaagaccatacag

SEQ ID NO: 5895 - DNA, 25 bp, Artificial Sequence
  Synthetic Construct
aggatgctgttgattgtatgtagca

SEQ ID NO: 5896 - DNA, 22 bp, Artificial Sequence
  Synthetic Construct
cacaagctcacctcactgctta

SEQ ID NO: 5897 - DNA, 24 bp, Artificial Sequence
  Synthetic Construct
tgtacccccttcttcctacagcta

SEQ ID NO: 5898 - DNA, 24 bp, Artificial Sequence
  Synthetic Construct
gctgttatagtcgtggtggttgtg

SEQ ID NO: 5899 - DNA, 21 bp, Artificial Sequence
  Synthetic Construct
tgctctgctcactccccattc

SEQ ID NO: 5900 - DNA, 23 bp, Artificial Sequence
  Synthetic Construct
ctaggaaaggccctacactgttc

SEQ ID NO: 5901 - DNA, 20 bp, Artificial Sequence
  Synthetic Construct
aactgaaaggccacgtgcaa

SEQ ID NO: 5902 - DNA, 20 bp, Artificial Sequence
  Synthetic Construct
ttcctggtggctggaatgct

SEQ ID NO: 5903 - DNA, 25 bp, Artificial Sequence
  Synthetic Construct
cgacttgactgaacaggtcttagac

SEQ ID NO: 5904 - DNA, 21 bp, Artificial Sequence
  Synthetic Construct
agctgagctcttcgccaggta

SEQ ID NO: 5905 - DNA, 22 bp, Artificial Sequence
  Synthetic Construct
gcttcagcagcatcatccagaa

SEQ ID NO: 5906 - DNA, 21 bp, Artificial Sequence
  Synthetic Construct
aatgcctggaggggtgtgtca

SEQ ID NO: 5907 - DNA, 20 bp, Artificial Sequence
  Synthetic Construct
aggggggttgggaacttcca

SEQ ID NO: 5908 - DNA, 22 bp, Artificial Sequence
  Synthetic Construct
tctcaaccaaggggtacagaga

SEQ ID NO: 5909 - DNA, 24 bp, Artificial Sequence
  Synthetic Construct
cctttgtgctcaggctttgaaggt

SEQ ID NO: 5910 - DNA, 24 bp, Artificial Sequence
  Synthetic Construct
ctgtcttgccatttttgcccaata

SEQ ID NO: 5911 - DNA, 25 bp, Artificial Sequence
  Synthetic Construct
gaaaggctcagtacagctttttagc

SEQ ID NO: 5912 - DNA, 20 bp, Artificial Sequence
  Synthetic Construct
ggcttggccacaatgttgct

SEQ ID NO: 5913 - DNA, 19 bp, Artificial Sequence
  Synthetic Construct
aaccaccagtgcctttgca

SEQ ID NO: 5914 - DNA, 22 bp, Artificial Sequence
  Synthetic Construct
ggggagcctcacatttgacatt

SEQ ID NO: 5915 - DNA, 22 bp, Artificial Sequence
  Synthetic Construct
gacaatggcagagaaggcagtt

SEQ ID NO: 5916 - DNA, 22 bp, Artificial Sequence
  Synthetic Construct
ccttggtttgcactgtgtttgg

SEQ ID NO: 5917 - DNA, 22 bp, Artificial Sequence
  Synthetic Construct
tgccctttttgtgctggtaggt

SEQ ID NO: 5918 - DNA, 20 bp, Artificial Sequence
  Synthetic Construct
ttccccaggctggcctttaa

SEQ ID NO: 5919 - DNA, 25 bp, Artificial Sequence
  Synthetic Construct
tgatgttgagtagaggtgtgatgtc

SEQ ID NO: 5920 - DNA, 22 bp, Artificial Sequence
  Synthetic Construct
caaaccccacccagtttagctt

SEQ ID NO: 5921 - DNA, 22 bp, Artificial Sequence
  Synthetic Construct
gtgtcctggtatgtggaacgtt

SEQ ID NO: 5922 - DNA, 26 bp, Artificial Sequence
  Synthetic Construct
tcaaaagtttttagcctgccttagtc

SEQ ID NO: 5923 - DNA, 25 bp, Artificial Sequence
  Synthetic Construct
cgtgaagcttgggttaacagttcca

SEQ ID NO: 5924 - DNA, 22 bp, Artificial Sequence
  Synthetic Construct
ggcaaaaacctgctggaatgct

SEQ ID NO: 5925 - DNA, 23 bp, Artificial Sequence
  Synthetic Construct
cccaggatgcaggatctactgta

SEQ ID NO: 5926 - DNA, 25 bp, Artificial Sequence
  Synthetic Construct
gggaatggagaacactcttcttgct

SEQ ID NO: 5927 - DNA, 22 bp, Artificial Sequence
  Synthetic Construct
tgcagctggacaaactcccatt

SEQ ID NO: 5928 - DNA, 24 bp, Artificial Sequence
  Synthetic Construct
agctgaaagaaaacccactttgtc

SEQ ID NO: 5929 - DNA, 24 bp, Artificial Sequence
  Synthetic Construct
cgcgtagggtgttggattcttttg

SEQ ID NO: 5930 - DNA, 26 bp, Artificial Sequence
  Synthetic Construct
atttgggaagtaagacttgcaatctg

SEQ ID NO: 5931 - DNA, 26 bp, Artificial Sequence
  Synthetic Construct
gggttaataatgtggaggtcactgaa

SEQ ID NO: 5932 - DNA, 25 bp, Artificial Sequence
  Synthetic Construct
catttacatcctcgaagtcctgtgt

SEQ ID NO: 5933 - DNA, 23 bp, Artificial Sequence
  Synthetic Construct
ggatgagtttggccctgattttc

SEQ ID NO: 5934 - DNA, 24 bp, Artificial Sequence
  Synthetic Construct
cactccttggcattcaggtaacac

SEQ ID NO: 5935 - DNA, 25 bp, Artificial Sequence
  Synthetic Construct
gtttccaccattgctttcacaatct

SEQ ID NO: 5936 - DNA, 25 bp, Artificial Sequence
  Synthetic Construct
ctgttaccttgactcatctcaggtt

SEQ ID NO: 5937 - DNA, 24 bp, Artificial Sequence
  Synthetic Construct
tggtgctattacaggcataaacca

SEQ ID NO: 5938 - DNA, 22 bp, Artificial Sequence
  Synthetic Construct
agtttcagcagctaagccagaa

SEQ ID NO: 5939 - DNA, 25 bp, Artificial Sequence
  Synthetic Construct
ctgaaaagttgcatagctggaatcc

SEQ ID NO: 5940 - DNA, 23 bp, Artificial Sequence
  Synthetic Construct
gataccagagcaagccttcatga

SEQ ID NO: 5941 - DNA, 22 bp, Artificial Sequence
  Synthetic Construct
tggactggatgaggacagcatt

SEQ ID NO: 5942 - DNA, 24 bp, Artificial Sequence
  Synthetic Construct
gggggtcttttatctccaggaaag

SEQ ID NO: 5943 - DNA, 20 bp, Artificial Sequence
  Synthetic Construct
tctcacccgacaccccatat

SEQ ID NO: 5944 - DNA, 24 bp, Artificial Sequence
  Synthetic Construct
aataacctgttgcactggttctct

SEQ ID NO: 5945 - DNA, 22 bp, Artificial Sequence
  Synthetic Construct
tcacagtggaagaggcaaaggt

SEQ ID NO: 5946 - DNA, 25 bp, Artificial Sequence
  Synthetic Construct
ggttgcaccggaaaagaacagattc

SEQ ID NO: 5947 - DNA, 26 bp, Artificial Sequence
  Synthetic Construct
ggtcacagaaatgggcagaaattgtt

SEQ ID NO: 5948 - DNA, 28 bp, Artificial Sequence
  Synthetic Construct
ggtttgggtcatgacaatagatccctta

SEQ ID NO: 5949 - DNA, 22 bp, Artificial Sequence
  Synthetic Construct
ttctcacttgccagtggtgact

SEQ ID NO: 5950 - DNA, 20 bp, Artificial Sequence
  Synthetic Construct
tgcagtggctgagttgctaa

SEQ ID NO: 5951 - DNA, 22 bp, Artificial Sequence
  Synthetic Construct
agtagagtttctcgccctctga

SEQ ID NO: 5952 - DNA, 22 bp, Artificial Sequence
  Synthetic Construct
actccagtactggcactatcca

SEQ ID NO: 5953 - DNA, 22 bp, Artificial Sequence
  Synthetic Construct
agcagtatgcactggggaaagg

SEQ ID NO: 5954 - DNA, 21 bp, Artificial Sequence
  Synthetic Construct
tgccttcgttccccggtacta

SEQ ID NO: 5955 - DNA, 19 bp, Artificial Sequence
  Synthetic Construct
tgtgcctggtggggagaca

SEQ ID NO: 5956 - DNA, 28 bp, Artificial Sequence
  Synthetic Construct
gcagatcttggtgaaatacatggatgct

SEQ ID NO: 5957 - DNA, 22 bp, Artificial Sequence
  Synthetic Construct
tgagctcaggtgtgggaaattc

SEQ ID NO: 5958 - DNA, 26 bp, Artificial Sequence
  Synthetic Construct
cttgggaaatacacaaatacgtggaa

SEQ ID NO: 5959 - DNA, 22 bp, Artificial Sequence
  Synthetic Construct
agaagaagtccccgtcaaacct

SEQ ID NO: 5960 - DNA, 27 bp, Artificial Sequence
  Synthetic Construct
gactcagacagcgaagtaaattgttca

SEQ ID NO: 5961 - DNA, 28 bp, Artificial Sequence
  Synthetic Construct
agtctaatcggtctgaagtgaaagtaaa

SEQ ID NO: 5962 - DNA, 24 bp, Artificial Sequence
  Synthetic Construct
ttctcaaaaccccaaatcctgagt

SEQ ID NO: 5963 - DNA, 25 bp, Artificial Sequence
  Synthetic Construct
cagaagttactgctggtcctttcag

SEQ ID NO: 5964 - DNA, 24 bp, Artificial Sequence
  Synthetic Construct
ccttagggaaagccatgcaagaag

SEQ ID NO: 5965 - DNA, 25 bp, Artificial Sequence
  Synthetic Construct
gttgctatccatgcagaaactgttg

SEQ ID NO: 5966 - DNA, 27 bp, Artificial Sequence
  Synthetic Construct
ccaaacttttcctacttaggtgcaatt

SEQ ID NO: 5967 - DNA, 23 bp, Artificial Sequence
  Synthetic Construct
ggtttggcatccttcagctcata

SEQ ID NO: 5968 - DNA, 29 bp, Artificial Sequence
  Synthetic Construct
cctttttggactgctggcttatattaaat

SEQ ID NO: 5969 - DNA, 23 bp, Artificial Sequence
  Synthetic Construct
caagccctgcattttgttactga

SEQ ID NO: 5970 - DNA, 22 bp, Artificial Sequence
  Synthetic Construct
ttggagcacaccagtttaagct

SEQ ID NO: 5971 - DNA, 25 bp, Artificial Sequence
  Synthetic Construct
ggagtctggggaggtactaataaca

SEQ ID NO: 5972 - DNA, 22 bp, Artificial Sequence
  Synthetic Construct
ttgccagtgggaggatgaagta

SEQ ID NO: 5973 - DNA, 25 bp, Artificial Sequence
  Synthetic Construct
cctccatgcagattagacacttgtg

SEQ ID NO: 5974 - DNA, 20 bp, Artificial Sequence
  Synthetic Construct
ttacaggcgtcaggcattgt

SEQ ID NO: 5975 - DNA, 24 bp, Artificial Sequence
  Synthetic Construct
caggggatcagggaagtgagtaaa

SEQ ID NO: 5976 - DNA, 20 bp, Artificial Sequence
  Synthetic Construct
actggttggttggctggttt

SEQ ID NO: 5977 - DNA, 22 bp, Artificial Sequence
  Synthetic Construct
ggtgaaagtgttgggaggcttt

SEQ ID NO: 5978 - DNA, 27 bp, Artificial Sequence
  Synthetic Construct
caagactgttttagaaacgggattaca

SEQ ID NO: 5979 - DNA, 28 bp, Artificial Sequence
  Synthetic Construct
aaaagatctgttctatcagtaccaaggt

SEQ ID NO: 5980 - DNA, 29 bp, Artificial Sequence
  Synthetic Construct
tggtaatgaagggttatcttaacagttca

SEQ ID NO: 5981 - DNA, 27 bp, Artificial Sequence
  Synthetic Construct
ccctgacaatgtattcattctcaagca

SEQ ID NO: 5982 - DNA, 24 bp, Artificial Sequence
  Synthetic Construct
gcaggtaggctttgaggtgtgaat

SEQ ID NO: 5983 - DNA, 21 bp, Artificial Sequence
  Synthetic Construct
ggagtggggaggtgtgtgaat

SEQ ID NO: 5984 - DNA, 22 bp, Artificial Sequence
  Synthetic Construct
tgagctgtatgggtgcctagta

SEQ ID NO: 5985 - DNA, 19 bp, Artificial Sequence
  Synthetic Construct
ggctcgttctgcccacttg

SEQ ID NO: 5986 - DNA, 27 bp, Artificial Sequence
  Synthetic Construct
tctgttaaaaatctgcatgttggatca

SEQ ID NO: 5987 - DNA, 22 bp, Artificial Sequence
  Synthetic Construct
cccgatggtttcctttgctctt

SEQ ID NO: 5988 - DNA, 23 bp, Artificial Sequence
  Synthetic Construct
ctggcatgaatgtcactcaggtt

SEQ ID NO: 5989 - DNA, 27 bp, Artificial Sequence
  Synthetic Construct
gtgagaccatcaaaaagaaaggagtgt

SEQ ID NO: 5990 - DNA, 24 bp, Artificial Sequence
  Synthetic Construct
ctgcctattgttgccatcaacttg

SEQ ID NO: 5991 - DNA, 29 bp, Artificial Sequence
  Synthetic Construct
ggcaagaaatgacttccaatgacattgta

SEQ ID NO: 5992 - DNA, 26 bp, Artificial Sequence
  Synthetic Construct
tgcgagagtataggttacaggatttg

SEQ ID NO: 5993 - DNA, 24 bp, Artificial Sequence
  Synthetic Construct
tgttcggaggttgtctgagatcac

SEQ ID NO: 5994 - DNA, 25 bp, Artificial Sequence
  Synthetic Construct
gagcccgagttactggtttaatagt

SEQ ID NO: 5995 - DNA, 22 bp, Artificial Sequence
  Synthetic Construct
aggatgtctgttgggtccctta

SEQ ID NO: 5996 - DNA, 26 bp, Artificial Sequence
  Synthetic Construct
gggagtagcatacttcctttcaggat

SEQ ID NO: 5997 - DNA, 27 bp, Artificial Sequence
  Synthetic Construct
catggacaaaagcttgatggaagtatt

SEQ ID NO: 5998 - DNA, 25 bp, Artificial Sequence
  Synthetic Construct
gttcaggtaagtcaaatgggtctga

SEQ ID NO: 5999 - DNA, 23 bp, Artificial Sequence
  Synthetic Construct
gccttggcaggtgtgaatgtgat

SEQ ID NO: 6000 - DNA, 21 bp, Artificial Sequence
  Synthetic Construct
gttcttccaggccaccgttgt

SEQ ID NO: 6001 - DNA, 22 bp, Artificial Sequence
  Synthetic Construct
ctctgaacctccctgagacaga

SEQ ID NO: 6002 - DNA, 20 bp, Artificial Sequence
  Synthetic Construct
tgggaccaggaacaggcatt

SEQ ID NO: 6003 - DNA, 19 bp, Artificial Sequence
  Synthetic Construct
tgcctggccgaggggttca

SEQ ID NO: 6004 - DNA, 25 bp, Artificial Sequence
  Synthetic Construct
cagacccacaatgcagcaatttagg

SEQ ID NO: 6005 - DNA, 21 bp, Artificial Sequence
  Synthetic Construct
tcacccatcagcgtgtagtga

SEQ ID NO: 6006 - DNA, 21 bp, Artificial Sequence
  Synthetic Construct
agcactgtccaggccaaacat

SEQ ID NO: 6007 - DNA, 21 bp, Artificial Sequence
  Synthetic Construct
tgtgtggggagagcctgtctt

SEQ ID NO: 6008 - DNA, 24 bp, Artificial Sequence
  Synthetic Construct
cggaccttagagacaagctagaca

SEQ ID NO: 6009 - DNA, 24 bp, Artificial Sequence
  Synthetic Construct
cccatttgttctcagaaagcaagt

SEQ ID NO: 6010 - DNA, 21 bp, Artificial Sequence
  Synthetic Construct
ctggccttggatgtcttcagt

SEQ ID NO: 6011 - DNA, 21 bp, Artificial Sequence
  Synthetic Construct
tggagtcttcccagtctgtga

SEQ ID NO: 6012 - DNA, 24 bp, Artificial Sequence
  Synthetic Construct
gagttggaatggggtaggtacttc

SEQ ID NO: 6013 - DNA, 22 bp, Artificial Sequence
  Synthetic Construct
cctttcagttccagagcaagca

SEQ ID NO: 6014 - DNA, 22 bp, Artificial Sequence
  Synthetic Construct
gctgagcacacctgagaacata

SEQ ID NO: 6015 - DNA, 20 bp, Artificial Sequence
  Synthetic Construct
tgtgtgcaaagcaggagaca

SEQ ID NO: 6016 - DNA, 24 bp, Artificial Sequence
  Synthetic Construct
gactcagtacccagttcttttcca

SEQ ID NO: 6017 - DNA, 22 bp, Artificial Sequence
  Synthetic Construct
aggatgcctcggctaaagaaga

SEQ ID NO: 6018 - DNA, 24 bp, Artificial Sequence
  Synthetic Construct
tggtacccctaatgactgtcagaa

SEQ ID NO: 6019 - DNA, 23 bp, Artificial Sequence
  Synthetic Construct
gttcctctgtccagatcttgtgt

SEQ ID NO: 6020 - DNA, 26 bp, Artificial Sequence
  Synthetic Construct
caaggatagtggttcaacactagtga

SEQ ID NO: 6021 - DNA, 19 bp, Artificial Sequence
  Synthetic Construct
gggacaggtcaggcttcct

SEQ ID NO: 6022 - DNA, 26 bp, Artificial Sequence
  Synthetic Construct
atggaacaatgaaacgatgatgaaca

SEQ ID NO: 6023 - DNA, 19 bp, Artificial Sequence
  Synthetic Construct
acagtgcagccaccccatt

SEQ ID NO: 6024 - DNA, 25 bp, Artificial Sequence
  Synthetic Construct
cagaactgctggaaccactactttg

SEQ ID NO: 6025 - DNA, 19 bp, Artificial Sequence
  Synthetic Construct
aggaacagagcggcagaga

SEQ ID NO: 6026 - DNA, 24 bp, Artificial Sequence
  Synthetic Construct
acaacacagatctaccaccaacag

SEQ ID NO: 6027 - DNA, 25 bp, Artificial Sequence
  Synthetic Construct
gtggtgtatctgggcattgatttct

SEQ ID NO: 6028 - DNA, 25 bp, Artificial Sequence
  Synthetic Construct
gagatctcctttcagctcctaatgg

SEQ ID NO: 6029 - DNA, 24 bp, Artificial Sequence
  Synthetic Construct
ccagccaccagtagcaatattgtg

SEQ ID NO: 6030 - DNA, 22 bp, Artificial Sequence
  Synthetic Construct
tcaccagcagagatccttcact

SEQ ID NO: 6031 - DNA, 21 bp, Artificial Sequence
  Synthetic Construct
tgggtctgcttctgggaactg

SEQ ID NO: 6032 - DNA, 24 bp, Artificial Sequence
  Synthetic Construct
tcgtccctacatttgagggctcta

SEQ ID NO: 6033 - DNA, 22 bp, Artificial Sequence
  Synthetic Construct
tccagggctttgggtgttcaat

SEQ ID NO: 6034 - DNA, 22 bp, Artificial Sequence
  Synthetic Construct
atggctcacctcttctccaatg

SEQ ID NO: 6035 - DNA, 25 bp, Artificial Sequence
  Synthetic Construct
caggaattgattctcggattgcatt

SEQ ID NO: 6036 - DNA, 21 bp, Artificial Sequence
  Synthetic Construct
aggcccatcctctcactagac

SEQ ID NO: 6037 - DNA, 22 bp, Artificial Sequence
  Synthetic Construct
tgagaactggagtgtgcaagca

SEQ ID NO: 6038 - DNA, 23 bp, Artificial Sequence
  Synthetic Construct
ctggcccaggtaatgtccataaa

SEQ ID NO: 6039 - DNA, 26 bp, Artificial Sequence
  Synthetic Construct
gacacccctctcacttgtaatgatac

SEQ ID NO: 6040 - DNA, 20 bp, Artificial Sequence
  Synthetic Construct
cctttcagcccagcatctgt

SEQ ID NO: 6041 - DNA, 24 bp, Artificial Sequence
  Synthetic Construct
ggtcaggaacatgcatgagccata

SEQ ID NO: 6042 - DNA, 23 bp, Artificial Sequence
  Synthetic Construct
gggaaatggtgagactcagtgat

SEQ ID NO: 6043 - DNA, 26 bp, Artificial Sequence
  Synthetic Construct
ttatgctagattgcaaaacccaagag

SEQ ID NO: 6044 - DNA, 22 bp, Artificial Sequence
  Synthetic Construct
agcacctaggaggagagatgtg

SEQ ID NO: 6045 - DNA, 22 bp, Artificial Sequence
  Synthetic Construct
ccaaggacagagggtgaggtat

SEQ ID NO: 6046 - DNA, 23 bp, Artificial Sequence
  Synthetic Construct
agcatggacaacctgcatttttc

SEQ ID NO: 6047 - DNA, 24 bp, Artificial Sequence
  Synthetic Construct
gggaagaagacagcaatggtaagc

SEQ ID NO: 6048 - DNA, 25 bp, Artificial Sequence
  Synthetic Construct
tgtctaccctgccttagtattttgc

SEQ ID NO: 6049 - DNA, 23 bp, Artificial Sequence
  Synthetic Construct
gcactgagttcaatgccaattcc

SEQ ID NO: 6050 - DNA, 24 bp, Artificial Sequence
  Synthetic Construct
acctgtctaggggttaggctatct

SEQ ID NO: 6051 - DNA, 24 bp, Artificial Sequence
  Synthetic Construct
tcggctgttagcaactctgttagc

SEQ ID NO: 6052 - DNA, 25 bp, Artificial Sequence
  Synthetic Construct
gggctcagaacttaacttcacatct

SEQ ID NO: 6053 - DNA, 25 bp, Artificial Sequence
  Synthetic Construct
gctggatatctatggatggctgcat

SEQ ID NO: 6054 - DNA, 21 bp, Artificial Sequence
  Synthetic Construct
tcccttgggcatgactttctg

SEQ ID NO: 6055 - DNA, 24 bp, Artificial Sequence
  Synthetic Construct
gtgaacagtatcccaaagcagttc

SEQ ID NO: 6056 - DNA, 23 bp, Artificial Sequence
  Synthetic Construct
tgggtaggagttaggcagagagt

SEQ ID NO: 6057 - DNA, 21 bp, Artificial Sequence
  Synthetic Construct
gctggcttttgggactggtta

SEQ ID NO: 6058 - DNA, 22 bp, Artificial Sequence
  Synthetic Construct
aggaaggctgctgttccatgaa

SEQ ID NO: 6059 - DNA, 25 bp, Artificial Sequence
  Synthetic Construct
ggctatcatggtggctagatttcac

SEQ ID NO: 6060 - DNA, 20 bp, Artificial Sequence
  Synthetic Construct
tggatctgggatgggcaaca

SEQ ID NO: 6061 - DNA, 24 bp, Artificial Sequence
  Synthetic Construct
gtcctggagctgctatatgctaga

SEQ ID NO: 6062 - DNA, 23 bp, Artificial Sequence
  Synthetic Construct
gctgattctgccatatcctgtga

SEQ ID NO: 6063 - DNA, 28 bp, Artificial Sequence
  Synthetic Construct
cactgctttgaaggttagaaggaagtag

SEQ ID NO: 6064 - DNA, 20 bp, Artificial Sequence
  Synthetic Construct
accaactcatgccgccttca

SEQ ID NO: 6065 - DNA, 25 bp, Artificial Sequence
  Synthetic Construct
gacttgcttaggaattgctgtcttt

SEQ ID NO: 6066 - DNA, 25 bp, Artificial Sequence
  Synthetic Construct
caacagatgtttggtgtgattagca

SEQ ID NO: 6067 - DNA, 24 bp, Artificial Sequence
  Synthetic Construct
gagtttttgtcctacctccaggaa

SEQ ID NO: 6068 - DNA, 23 bp, Artificial Sequence
  Synthetic Construct
cagtcacacagagcgtaaatgga

SEQ ID NO: 6069 - DNA, 24 bp, Artificial Sequence
  Synthetic Construct
ctgctttcactcctcctattagca

SEQ ID NO: 6070 - DNA, 26 bp, Artificial Sequence
  Synthetic Construct
aggaccaggtaattttcttcaagtca

SEQ ID NO: 6071 - DNA, 22 bp, Artificial Sequence
  Synthetic Construct
gagctgagatcaggatggcatt

SEQ ID NO: 6072 - DNA, 25 bp, Artificial Sequence
  Synthetic Construct
cttggggaaactttgctctctctaa

SEQ ID NO: 6073 - DNA, 23 bp, Artificial Sequence
  Synthetic Construct
tggatggtgccctttcaaaaact

SEQ ID NO: 6074 - DNA, 26 bp, Artificial Sequence
  Synthetic Construct
gttgcattgaattaaggggagaacac

SEQ ID NO: 6075 - DNA, 26 bp, Artificial Sequence
  Synthetic Construct
tcacagggtattatgtatggaaagca

SEQ ID NO: 6076 - DNA, 24 bp, Artificial Sequence
  Synthetic Construct
agtggggttagggaaagaactact

SEQ ID NO: 6077 - DNA, 20 bp, Artificial Sequence
  Synthetic Construct
tcaacagtgcccggcaatat

SEQ ID NO: 6078 - DNA, 21 bp, Artificial Sequence
  Synthetic Construct
gtgctattgggatggcatgga

SEQ ID NO: 6079 - DNA, 28 bp, Artificial Sequence
  Synthetic Construct
gaagagagttttcccagttcagtttaag

SEQ ID NO: 6080 - DNA, 29 bp, Artificial Sequence
  Synthetic Construct
agtagagtgaaattgtgattctctctcat

SEQ ID NO: 6081 - DNA, 25 bp, Artificial Sequence
  Synthetic Construct
ctgagctccttctctggaattaacc

SEQ ID NO: 6082 - DNA, 21 bp, Artificial Sequence
  Synthetic Construct
tgagcccaccagtaagcaaaa

SEQ ID NO: 6083 - DNA, 27 bp, Artificial Sequence
  Synthetic Construct
atcaccctctttgaaagtaaactacct

SEQ ID NO: 6084 - DNA, 23 bp, Artificial Sequence
  Synthetic Construct
gaagggtactgcatgtacaggaa

SEQ ID NO: 6085 - DNA, 25 bp, Artificial Sequence
  Synthetic Construct
gcctctgcctagtgtgtcaataatc

SEQ ID NO: 6086 - DNA, 25 bp, Artificial Sequence
  Synthetic Construct
gcagccatctgaacttttgattcag

SEQ ID NO: 6087 - DNA, 24 bp, Artificial Sequence
  Synthetic Construct
ctggagactgcctaagactaccaa

SEQ ID NO: 6088 - DNA, 22 bp, Artificial Sequence
  Synthetic Construct
gcggccattaggaagtgatgaa

SEQ ID NO: 6089 - DNA, 20 bp, Artificial Sequence
  Synthetic Construct
acctccaaggtcccagcatt

SEQ ID NO: 6090 - DNA, 23 bp, Artificial Sequence
  Synthetic Construct
gactgaaaccagcctcattgtct

SEQ ID NO: 6091 - DNA, 24 bp, Artificial Sequence
  Synthetic Construct
tccttggacagaggctggtatagg

SEQ ID NO: 6092 - DNA, 24 bp, Artificial Sequence
  Synthetic Construct
cccctctctggttcatgtagacaa

SEQ ID NO: 6093 - DNA, 22 bp, Artificial Sequence
  Synthetic Construct
acagtggccaaagcttcctact

SEQ ID NO: 6094 - DNA, 20 bp, Artificial Sequence
  Synthetic Construct
tgcagtagccaccagtcaca

SEQ ID NO: 6095 - DNA, 23 bp, Artificial Sequence
  Synthetic Construct
gcccagttttcactcacaatgaa

SEQ ID NO: 6096 - DNA, 22 bp, Artificial Sequence
  Synthetic Construct
agggcttcaggtgaaggttaca

SEQ ID NO: 6097 - DNA, 29 bp, Artificial Sequence
  Synthetic Construct
ggaatggctgtaaaagtaagaggaaaacc

SEQ ID NO: 6098 - DNA, 22 bp, Artificial Sequence
  Synthetic Construct
tcctgctaagagtgggaatcca

SEQ ID NO: 6099 - DNA, 28 bp, Artificial Sequence
  Synthetic Construct
atatgtgaaatcctgtgctgtaagtttt

SEQ ID NO: 6100 - DNA, 21 bp, Artificial Sequence
  Synthetic Construct
agggctgccatttctggttgt

SEQ ID NO: 6101 - DNA, 22 bp, Artificial Sequence
  Synthetic Construct
ggctgacactgtgtcacatgaa

SEQ ID NO: 6102 - DNA, 25 bp, Artificial Sequence
  Synthetic Construct
ggcatccttcaatccagtcaacaac

SEQ ID NO: 6103 - DNA, 25 bp, Artificial Sequence
  Synthetic Construct
ggactcagtgagaattggacaaacg

SEQ ID NO: 6104 - DNA, 24 bp, Artificial Sequence
  Synthetic Construct
ggactatgtcctgtaccagatgtg

SEQ ID NO: 6105 - DNA, 25 bp, Artificial Sequence
  Synthetic Construct
ccacattttccatctgctcctggaa

SEQ ID NO: 6106 - DNA, 23 bp, Artificial Sequence
  Synthetic Construct
actcaaggccatagaccctttca

SEQ ID NO: 6107 - DNA, 25 bp, Artificial Sequence
  Synthetic Construct
tgtggaaataagggagggattaagg

SEQ ID NO: 6108 - DNA, 22 bp, Artificial Sequence
  Synthetic Construct
tcagatggactgccaaggtcaa

SEQ ID NO: 6109 - DNA, 21 bp, Artificial Sequence
  Synthetic Construct
gcctcatctcatgggcaagac

SEQ ID NO: 6110 - DNA, 25 bp, Artificial Sequence
  Synthetic Construct
ctaaacctaggactcaacagtcgtt

SEQ ID NO: 6111 - DNA, 24 bp, Artificial Sequence
  Synthetic Construct
gttgtatcagtggagggaaagtct

SEQ ID NO: 6112 - DNA, 27 bp, Artificial Sequence
  Synthetic Construct
tctttgctatttgggctagttattcca

SEQ ID NO: 6113 - DNA, 26 bp, Artificial Sequence
  Synthetic Construct
aactaagagacttggctttcaaatcg

SEQ ID NO: 6114 - DNA, 21 bp, Artificial Sequence
  Synthetic Construct
tccaggagtcagggagtcaca

SEQ ID NO: 6115 - DNA, 27 bp, Artificial Sequence
  Synthetic Construct
tgggtaactacacctactactttcaag

SEQ ID NO: 6116 - DNA, 24 bp, Artificial Sequence
  Synthetic Construct
gtataaggcatgcttagccattgc

SEQ ID NO: 6117 - DNA, 23 bp, Artificial Sequence
  Synthetic Construct
acagaaattggaggaagcaggaa

SEQ ID NO: 6118 - DNA, 25 bp, Artificial Sequence
  Synthetic Construct
gcagacctatgtcttgcaaagcttt

SEQ ID NO: 6119 - DNA, 22 bp, Artificial Sequence
  Synthetic Construct
ttctggctcctgctaagttgga

SEQ ID NO: 6120 - DNA, 26 bp, Artificial Sequence
  Synthetic Construct
ggttgtcaaaagtcagggatgataag

SEQ ID NO: 6121 - DNA, 24 bp, Artificial Sequence
  Synthetic Construct
cttgctgtttctaaggtcgtgaag

SEQ ID NO: 6122 - DNA, 22 bp, Artificial Sequence
  Synthetic Construct
ggaacacaatggaggtgaggtt

SEQ ID NO: 6123 - DNA, 25 bp, Artificial Sequence
  Synthetic Construct
ctcccgaatggatcaaagcttactg

SEQ ID NO: 6124 - DNA, 28 bp, Artificial Sequence
  Synthetic Construct
gggaaaaacatttctctgtgctcatttc

SEQ ID NO: 6125 - DNA, 22 bp, Artificial Sequence
  Synthetic Construct
cctccatttcaggccatagctt

SEQ ID NO: 6126 - DNA, 25 bp, Artificial Sequence
  Synthetic Construct
caatttctgcaaaatctgggtccaa

SEQ ID NO: 6127 - DNA, 23 bp, Artificial Sequence
  Synthetic Construct
tgggaagaattcactcccaacct

SEQ ID NO: 6128 - DNA, 24 bp, Artificial Sequence
  Synthetic Construct
ggctttcttcatagcccaagtaca

SEQ ID NO: 6129 - DNA, 26 bp, Artificial Sequence
  Synthetic Construct
gcagagagcctggaattaacaagact

SEQ ID NO: 6130 - DNA, 26 bp, Artificial Sequence
  Synthetic Construct
cagcgttatgactcatgcctgaatta

SEQ ID NO: 6131 - DNA, 28 bp, Artificial Sequence
  Synthetic Construct
tggtctgggttttatagttttgtattgc

SEQ ID NO: 6132 - DNA, 21 bp, Artificial Sequence
  Synthetic Construct
tgcatctgcagccttcattcc

SEQ ID NO: 6133 - DNA, 20 bp, Artificial Sequence
  Synthetic Construct
atggccagctgttgggttga

SEQ ID NO: 6134 - DNA, 21 bp, Artificial Sequence
  Synthetic Construct
tcaactgggcgcatagttcaa

SEQ ID NO: 6135 - DNA, 22 bp, Artificial Sequence
  Synthetic Construct
gtggtcagcaagacaagaccat

SEQ ID NO: 6136 - DNA, 22 bp, Artificial Sequence
  Synthetic Construct
gacatgctcactgagtgccatt

SEQ ID NO: 6137 - DNA, 21 bp, Artificial Sequence
  Synthetic Construct
aacaggtttccggcagagttt

SEQ ID NO: 6138 - DNA, 24 bp, Artificial Sequence
  Synthetic Construct
ctccaggaatcagtgatggatgaa

SEQ ID NO: 6139 - DNA, 27 bp, Artificial Sequence
  Synthetic Construct
cccaaggaagatagtcagactcttctc

SEQ ID NO: 6140 - DNA, 22 bp, Artificial Sequence
  Synthetic Construct
tccaaggaaacgtcaccaggaa

SEQ ID NO: 6141 - DNA, 21 bp, Artificial Sequence
  Synthetic Construct
atgtggaggaagggcaaaacc

SEQ ID NO: 6142 - DNA, 26 bp, Artificial Sequence
  Synthetic Construct
ggaggactgataacaaatgccatttt

SEQ ID NO: 6143 - DNA, 23 bp, Artificial Sequence
  Synthetic Construct
gcaggttttagctgcatggtctt

SEQ ID NO: 6144 - DNA, 23 bp, Artificial Sequence
  Synthetic Construct
gtggctgctgttttcatggaaga

SEQ ID NO: 6145 - DNA, 28 bp, Artificial Sequence
  Synthetic Construct
agcaggaaaatgataatttgtaggcaaa

SEQ ID NO: 6146 - DNA, 26 bp, Artificial Sequence
  Synthetic Construct
ccaaaaaaaggtcatggtcagtttgt

SEQ ID NO: 6147 - DNA, 24 bp, Artificial Sequence
  Synthetic Construct
ggctcacagaaacagatggtttgg

SEQ ID NO: 6148 - DNA, 25 bp, Artificial Sequence
  Synthetic Construct
agccttgataaaacgtcatctccat

SEQ ID NO: 6149 - DNA, 24 bp, Artificial Sequence
  Synthetic Construct
ggtcacctaaacacagccaatctc

SEQ ID NO: 6150 - DNA, 26 bp, Artificial Sequence
  Synthetic Construct
ctgaattggtaaacacaatggatgca

SEQ ID NO: 6151 - DNA, 29 bp, Artificial Sequence
  Synthetic Construct
tgtgtttatggttaaacaggaaagtagga

SEQ ID NO: 6152 - DNA, 24 bp, Artificial Sequence
  Synthetic Construct
tgcttttggacctcattcttttcc

SEQ ID NO: 6153 - DNA, 30 bp, Artificial Sequence
  Synthetic Construct
cttccattgtagagtggtagtctaattttc

SEQ ID NO: 6154 - DNA, 26 bp, Artificial Sequence
  Synthetic Construct
cagaagtttctctgccatagtcattg

SEQ ID NO: 6155 - DNA, 27 bp, Artificial Sequence
  Synthetic Construct
gccacaccctaaaattctaataatgca

SEQ ID NO: 6156 - DNA, 22 bp, Artificial Sequence
  Synthetic Construct
tctggtgagtgctgctctctat

SEQ ID NO: 6157 - DNA, 27 bp, Artificial Sequence
  Synthetic Construct
ctgagtctgtgttcaggaatgaactag

SEQ ID NO: 6158 - DNA, 21 bp, Artificial Sequence
  Synthetic Construct
agccacttccaaggtgagcta

SEQ ID NO: 6159 - DNA, 24 bp, Artificial Sequence
  Synthetic Construct
caccaagcagatagcactaagcaa

SEQ ID NO: 6160 - DNA, 20 bp, Artificial Sequence
  Synthetic Construct
ccattgctgccaccattgct

SEQ ID NO: 6161 - DNA, 27 bp, Artificial Sequence
  Synthetic Construct
gtcttccaactacctgaatctgaaagc

SEQ ID NO: 6162 - DNA, 22 bp, Artificial Sequence
  Synthetic Construct
ctatgcccagttctgccttagg

SEQ ID NO: 6163 - DNA, 23 bp, Artificial Sequence
  Synthetic Construct
catgccccttctttaaggtgctt

SEQ ID NO: 6164 - DNA, 27 bp, Artificial Sequence
  Synthetic Construct
ggagaaagcaacaaatgaattctcctt

SEQ ID NO: 6165 - DNA, 27 bp, Artificial Sequence
  Synthetic Construct
gttcagtaatggaaaatggttgtcagt

SEQ ID NO: 6166 - DNA, 29 bp, Artificial Sequence
  Synthetic Construct
caccctataaaaatcaatcagggtattcc

SEQ ID NO: 6167 - DNA, 25 bp, Artificial Sequence
  Synthetic Construct
catggtgccctatactagctttcac

SEQ ID NO: 6168 - DNA, 24 bp, Artificial Sequence
  Synthetic Construct
cccaaaaagagggaatcagaccat

SEQ ID NO: 6169 - DNA, 26 bp, Artificial Sequence
  Synthetic Construct
ggtaatgagaatctcagctgggactt

SEQ ID NO: 6170 - DNA, 29 bp, Artificial Sequence
  Synthetic Construct
catacaatttatcattgtcacaccaccta

SEQ ID NO: 6171 - DNA, 24 bp, Artificial Sequence
  Synthetic Construct
agaagcccctggtaaaggaagaag

SEQ ID NO: 6172 - DNA, 22 bp, Artificial Sequence
  Synthetic Construct
gctctaagtcaagggaggcttt

SEQ ID NO: 6173 - DNA, 24 bp, Artificial Sequence
  Synthetic Construct
gcaggcatgaattcatagcttcca

SEQ ID NO: 6174 - DNA, 22 bp, Artificial Sequence
  Synthetic Construct
agggccctcttcctggttgata

SEQ ID NO: 6175 - DNA, 27 bp, Artificial Sequence
  Synthetic Construct
gtgggtaaatgaggttttgaaaactct

SEQ ID NO: 6176 - DNA, 25 bp, Artificial Sequence
  Synthetic Construct
aagcaaagtagttaaggccaagaac

SEQ ID NO: 6177 - DNA, 24 bp, Artificial Sequence
  Synthetic Construct
gaagtgctggtctgttgttttgtt

SEQ ID NO: 6178 - DNA, 28 bp, Artificial Sequence
  Synthetic Construct
aggttacaagagaagacttacaccttag

SEQ ID NO: 6179 - DNA, 25 bp, Artificial Sequence
  Synthetic Construct
cagggggaaactttgaagagacttc

SEQ ID NO: 6180 - DNA, 22 bp, Artificial Sequence
  Synthetic Construct
tgacagcaccagtgacagaaat

SEQ ID NO: 6181 - DNA, 28 bp, Artificial Sequence
  Synthetic Construct
tcaaaatcctactcatatgtcagttgga

SEQ ID NO: 6182 - DNA, 29 bp, Artificial Sequence
  Synthetic Construct
gggctacaaatcaaggttaattccacttc

SEQ ID NO: 6183 - DNA, 27 bp, Artificial Sequence
  Synthetic Construct
cctattttcacagcaccttttgatgac

SEQ ID NO: 6184 - DNA, 26 bp, Artificial Sequence
  Synthetic Construct
ctctcccatgactaggattgtaaagg

SEQ ID NO: 6185 - DNA, 24 bp, Artificial Sequence
  Synthetic Construct
gcatctcagaagttaccactccat

SEQ ID NO: 6186 - DNA, 22 bp, Artificial Sequence
  Synthetic Construct
gcccaggaagtcaaaccactta

SEQ ID NO: 6187 - DNA, 26 bp, Artificial Sequence
  Synthetic Construct
gacaagttttgagtttaccactgcta

SEQ ID NO: 6188 - DNA, 22 bp, Artificial Sequence
  Synthetic Construct
ggggtcatgaagcattgccttt

SEQ ID NO: 6189 - DNA, 26 bp, Artificial Sequence
  Synthetic Construct
tcgtgattatgtgagtcagcaatttg

SEQ ID NO: 6190 - DNA, 28 bp, Artificial Sequence
  Synthetic Construct
ggagtctccatttcaaaccacatttcag

SEQ ID NO: 6191 - DNA, 28 bp, Artificial Sequence
  Synthetic Construct
ctcaatgaaaatgagggggtatttttgt

SEQ ID NO: 6192 - DNA, 25 bp, Artificial Sequence
  Synthetic Construct
gtgaaatatgctgcctccaaaatct

SEQ ID NO: 6193 - DNA, 26 bp, Artificial Sequence
  Synthetic Construct
ctttaccagttgtcaagtgaaacgta

SEQ ID NO: 6194 - DNA, 28 bp, Artificial Sequence
  Synthetic Construct
ggtcctgaggaaatgctatatatggaat

SEQ ID NO: 6195 - DNA, 23 bp, Artificial Sequence
  Synthetic Construct
cacacttgccctatctgatgtca

SEQ ID NO: 6196 - DNA, 21 bp, Artificial Sequence
  Synthetic Construct
ccactcccacaggaccctaaa

SEQ ID NO: 6197 - DNA, 27 bp, Artificial Sequence
  Synthetic Construct
cgtctatggaattcgagggagatcata

SEQ ID NO: 6198 - DNA, 20 bp, Artificial Sequence
  Synthetic Construct
cggctgttgatcctgacgta

SEQ ID NO: 6199 - DNA, 22 bp, Artificial Sequence
  Synthetic Construct
tggggatcatggggattatgga

SEQ ID NO: 6200 - DNA, 27 bp, Artificial Sequence
  Synthetic Construct
ctactcgctctaaattggattgattcc

SEQ ID NO: 6201 - DNA, 20 bp, Artificial Sequence
  Synthetic Construct
gccacacccaccagtgttct

SEQ ID NO: 6202 - DNA, 29 bp, Artificial Sequence
  Synthetic Construct
cactgtctggaattatttatacccatcct

SEQ ID NO: 6203 - DNA, 24 bp, Artificial Sequence
  Synthetic Construct
gggtctcatctttgcaagcagata

SEQ ID NO: 6204 - DNA, 22 bp, Artificial Sequence
  Synthetic Construct
cctgaagccgtatgacaagaca

SEQ ID NO: 6205 - DNA, 22 bp, Artificial Sequence
  Synthetic Construct
tcctctggcccatctcttctag

SEQ ID NO: 6206 - DNA, 24 bp, Artificial Sequence
  Synthetic Construct
gccctctctacagtaagtgagttc

SEQ ID NO: 6207 - DNA, 27 bp, Artificial Sequence
  Synthetic Construct
gggatgaactgtgatgttggagatagc

SEQ ID NO: 6208 - DNA, 24 bp, Artificial Sequence
  Synthetic Construct
actccatcactgttacctgttgtg

SEQ ID NO: 6209 - DNA, 26 bp, Artificial Sequence
  Synthetic Construct
ctgagttcagtgtaaacttccccatt

SEQ ID NO: 6210 - DNA, 28 bp, Artificial Sequence
  Synthetic Construct
aacatccatttcctccagatttatgaac

SEQ ID NO: 6211 - DNA, 28 bp, Artificial Sequence
  Synthetic Construct
ctcatgcaagagttttcttaaagcctta

SEQ ID NO: 6212 - DNA, 27 bp, Artificial Sequence
  Synthetic Construct
gtcagtgggtctctgaaacttttagtg

SEQ ID NO: 6213 - DNA, 26 bp, Artificial Sequence
  Synthetic Construct
actgactgaaaattggcttgaaaagg

SEQ ID NO: 6214 - DNA, 28 bp, Artificial Sequence
  Synthetic Construct
gcttcttgcttataccattgcagtaagc

SEQ ID NO: 6215 - DNA, 26 bp, Artificial Sequence
  Synthetic Construct
caacaaaactgtaatactggcactgt

SEQ ID NO: 6216 - DNA, 23 bp, Artificial Sequence
  Synthetic Construct
tggtaaggccatgttttccttga

SEQ ID NO: 6217 - DNA, 25 bp, Artificial Sequence
  Synthetic Construct
ccctcacttcaatgaatccaagaca

SEQ ID NO: 6218 - DNA, 24 bp, Artificial Sequence
  Synthetic Construct
tcctcagaaatgtgccaaaactct

SEQ ID NO: 6219 - DNA, 25 bp, Artificial Sequence
  Synthetic Construct
acagctatttcactgccacaatttg

SEQ ID NO: 6220 - DNA, 24 bp, Artificial Sequence
  Synthetic Construct
cagtctggaagtccgtgttaattg

SEQ ID NO: 6221 - DNA, 24 bp, Artificial Sequence
  Synthetic Construct
cacttttttggtgccagagagaag

SEQ ID NO: 6222 - DNA, 24 bp, Artificial Sequence
  Synthetic Construct
ttatgggggaggagaaagtgattg

SEQ ID NO: 6223 - DNA, 22 bp, Artificial Sequence
  Synthetic Construct
acccatgccttgtgtgtgcata

SEQ ID NO: 6224 - DNA, 22 bp, Artificial Sequence
  Synthetic Construct
cctgcttgcttggtgatgtgtt

SEQ ID NO: 6225 - DNA, 25 bp, Artificial Sequence
  Synthetic Construct
gctgagtcctgtcaattacccagta

SEQ ID NO: 6226 - DNA, 20 bp, Artificial Sequence
  Synthetic Construct
gggcgattccagcactctct

SEQ ID NO: 6227 - DNA, 24 bp, Artificial Sequence
  Synthetic Construct
cattcaataagggccacctctttg

SEQ ID NO: 6228 - DNA, 28 bp, Artificial Sequence
  Synthetic Construct
ctgtaaccgcatagtatagtttcaagct

SEQ ID NO: 6229 - DNA, 22 bp, Artificial Sequence
  Synthetic Construct
tgtgtcaggtctccttgtgtct

SEQ ID NO: 6230 - DNA, 27 bp, Artificial Sequence
  Synthetic Construct
ccaaggttaaatgactcacctgaagtc

SEQ ID NO: 6231 - DNA, 27 bp, Artificial Sequence
  Synthetic Construct
cctgcctctatggttgtaactttaaag

SEQ ID NO: 6232 - DNA, 26 bp, Artificial Sequence
  Synthetic Construct
gagggagggtaagttactacaagtca

SEQ ID NO: 6233 - DNA, 30 bp, Artificial Sequence
  Synthetic Construct
cccaaaatttctttgttaccaattggcaaa

SEQ ID NO: 6234 - DNA, 28 bp, Artificial Sequence
  Synthetic Construct
ctcctgattcctatgcaaagaatttgag

SEQ ID NO: 6235 - DNA, 24 bp, Artificial Sequence
  Synthetic Construct
ccctccaggcctcataaaaactag

SEQ ID NO: 6236 - DNA, 27 bp, Artificial Sequence
  Synthetic Construct
gggcaatacttccaaggttatcccata

SEQ ID NO: 6237 - DNA, 22 bp, Artificial Sequence
  Synthetic Construct
cttgccactgtgagttcaagtg

SEQ ID NO: 6238 - DNA, 30 bp, Artificial Sequence
  Synthetic Construct
acaaactaaataaacgacccattctgttat

SEQ ID NO: 6239 - DNA, 22 bp, Artificial Sequence
  Synthetic Construct
tggagacaagtggcacgtaaaa

SEQ ID NO: 6240 - DNA, 30 bp, Artificial Sequence
  Synthetic Construct
gtgtccctctaaatacaactattgcttacc

SEQ ID NO: 6241 - DNA, 22 bp, Artificial Sequence
  Synthetic Construct
gtcgccgaagtactgagatgaa

SEQ ID NO: 6242 - DNA, 21 bp, Artificial Sequence
  Synthetic Construct
aaagctgcctgggagggaaaa

SEQ ID NO: 6243 - DNA, 23 bp, Artificial Sequence
  Synthetic Construct
ctcctagcaaacctgtgaggaaa

SEQ ID NO: 6244 - DNA, 25 bp, Artificial Sequence
  Synthetic Construct
ggcattgctaagagttgtaactgtt

SEQ ID NO: 6245 - DNA, 26 bp, Artificial Sequence
  Synthetic Construct
aacatctgtcagactgtaatcaccat

SEQ ID NO: 6246 - DNA, 22 bp, Artificial Sequence
  Synthetic Construct
tcctgctccactctcactctgt

SEQ ID NO: 6247 - DNA, 29 bp, Artificial Sequence
  Synthetic Construct
ggttgggtagaatactttagctttgattc

SEQ ID NO: 6248 - DNA, 26 bp, Artificial Sequence
  Synthetic Construct
ggtcaacactcagaattgaccctgat

SEQ ID NO: 6249 - DNA, 27 bp, Artificial Sequence
  Synthetic Construct
gtgatagataaccctcttcctcattgt

SEQ ID NO: 6250 - DNA, 23 bp, Artificial Sequence
  Synthetic Construct
actggatgtcctcccatgctaaa

SEQ ID NO: 6251 - DNA, 29 bp, Artificial Sequence
  Synthetic Construct
agaactttattcccagtaggatacacaaa

SEQ ID NO: 6252 - DNA, 28 bp, Artificial Sequence
  Synthetic Construct
aagctgtaataaaactctgccagtaatg

SEQ ID NO: 6253 - DNA, 26 bp, Artificial Sequence
  Synthetic Construct
gcctttaaagcaggtgtgtaccaatc

SEQ ID NO: 6254 - DNA, 29 bp, Artificial Sequence
  Synthetic Construct
cctgtagatagaccctaaccattgtaacc

SEQ ID NO: 6255 - DNA, 21 bp, Artificial Sequence
  Synthetic Construct
ctaagcgataaggcggcaaac

SEQ ID NO: 6256 - DNA, 28 bp, Artificial Sequence
  Synthetic Construct
gcgatgtgcttttcagatagatggtatc

SEQ ID NO: 6257 - DNA, 26 bp, Artificial Sequence
  Synthetic Construct
ccatggaactaagacagagaccaact

SEQ ID NO: 6258 - DNA, 22 bp, Artificial Sequence
  Synthetic Construct
gtccctaacctctgcaatttgc

SEQ ID NO: 6259 - DNA, 28 bp, Artificial Sequence
  Synthetic Construct
aatacttatgcaagcttttcatgaaacg

SEQ ID NO: 6260 - DNA, 20 bp, Artificial Sequence
  Synthetic Construct
agaaaggctgcctgcagatg

SEQ ID NO: 6261 - DNA, 26 bp, Artificial Sequence
  Synthetic Construct
ggctttgagttaacctttgaagtctt

SEQ ID NO: 6262 - DNA, 27 bp, Artificial Sequence
  Synthetic Construct
ggaaagtttgaccacaaattgacaatc

SEQ ID NO: 6263 - DNA, 26 bp, Artificial Sequence
  Synthetic Construct
ggctgattaccctgggtaaaggtatc

SEQ ID NO: 6264 - DNA, 28 bp, Artificial Sequence
  Synthetic Construct
gcttgaatagtgaaagcaatcctaatcc

SEQ ID NO: 6265 - DNA, 26 bp, Artificial Sequence
  Synthetic Construct
ctgtgttgtgtttcttttggttgaca

SEQ ID NO: 6266 - DNA, 23 bp, Artificial Sequence
  Synthetic Construct
ggcagaagagtaatggactgcat

SEQ ID NO: 6267 - DNA, 25 bp, Artificial Sequence
  Synthetic Construct
ctcagttcacacaaaggatcttcca

SEQ ID NO: 6268 - DNA, 29 bp, Artificial Sequence
  Synthetic Construct
gtgattaccacaccagttaaagaaagaac

SEQ ID NO: 6269 - DNA, 22 bp, Artificial Sequence
  Synthetic Construct
aactgagctgatggcagttagg

SEQ ID NO: 6270 - DNA, 27 bp, Artificial Sequence
  Synthetic Construct
ctattggcaggatctttctgtttgtag

SEQ ID NO: 6271 - DNA, 26 bp, Artificial Sequence
  Synthetic Construct
ttaatctgtcttacactctgctgaca

SEQ ID NO: 6272 - DNA, 21 bp, Artificial Sequence
  Synthetic Construct
ggaggccctccattctttgtt

SEQ ID NO: 6273 - DNA, 30 bp, Artificial Sequence
  Synthetic Construct
cacaataatagcttcttacttgtgcatttc

SEQ ID NO: 6274 - DNA, 21 bp, Artificial Sequence
  Synthetic Construct
agccttccagatccccttgtt

SEQ ID NO: 6275 - DNA, 30 bp, Artificial Sequence
  Synthetic Construct
ccagttgactaccatcacagatacaagatg

SEQ ID NO: 6276 - DNA, 26 bp, Artificial Sequence
  Synthetic Construct
gcatataactgtggtgggtaattgtg

SEQ ID NO: 6277 - DNA, 28 bp, Artificial Sequence
  Synthetic Construct
ccactagaatacaaatccacttctgaca

SEQ ID NO: 6278 - DNA, 22 bp, Artificial Sequence
  Synthetic Construct
agggtgacatgcttcacagatc

SEQ ID NO: 6279 - DNA, 28 bp, Artificial Sequence
  Synthetic Construct
aggttagtagtcaaggcctatgttttac

SEQ ID NO: 6280 - DNA, 22 bp, Artificial Sequence
  Synthetic Construct
gcaacctatagcagcctggatt

SEQ ID NO: 6281 - DNA, 21 bp, Artificial Sequence
  Synthetic Construct
aaaggccccaaaccctttgct

SEQ ID NO: 6282 - DNA, 28 bp, Artificial Sequence
  Synthetic Construct
ccctcattctatggtattgattccacaa

SEQ ID NO: 6283 - DNA, 24 bp, Artificial Sequence
  Synthetic Construct
ggggatcacaaaactgtcattctg

SEQ ID NO: 6284 - DNA, 29 bp, Artificial Sequence
  Synthetic Construct
gcattattcggatactacaaccagacgaa

SEQ ID NO: 6285 - DNA, 26 bp, Artificial Sequence
  Synthetic Construct
tgaaagacaatttgccggtatgttac

SEQ ID NO: 6286 - DNA, 26 bp, Artificial Sequence
  Synthetic Construct
cctgaggtccccatgaagagctataa

SEQ ID NO: 6287 - DNA, 22 bp, Artificial Sequence
  Synthetic Construct
tcgggaatgctgaggaaaagag

SEQ ID NO: 6288 - DNA, 21 bp, Artificial Sequence
  Synthetic Construct
gagccctctccgtttgtcaca

SEQ ID NO: 6289 - DNA, 22 bp, Artificial Sequence
  Synthetic Construct
gctggacaaactactgcctctt

SEQ ID NO: 6290 - DNA, 22 bp, Artificial Sequence
  Synthetic Construct
cagcttccctcttttgctctgt

SEQ ID NO: 6291 - DNA, 23 bp, Artificial Sequence
  Synthetic Construct
gaactcaaatggcctgtgaagtc

SEQ ID NO: 6292 - DNA, 22 bp, Artificial Sequence
  Synthetic Construct
caacggatggagatgcaaccat

SEQ ID NO: 6293 - DNA, 20 bp, Artificial Sequence
  Synthetic Construct
atctggggcccatcctttgg

SEQ ID NO: 6294 - DNA, 22 bp, Artificial Sequence
  Synthetic Construct
gcctggagaagaggtagatgtg

SEQ ID NO: 6295 - DNA, 25 bp, Artificial Sequence
  Synthetic Construct
cgatctccttgtttcacctctttcc

SEQ ID NO: 6296 - DNA, 20 bp, Artificial Sequence
  Synthetic Construct
agccccatgtctgtgatggt

SEQ ID NO: 6297 - DNA, 18 bp, Artificial Sequence
  Synthetic Construct
ctcgccagcatggtgaca

SEQ ID NO: 6298 - DNA, 20 bp, Artificial Sequence
  Synthetic Construct
tccactgggcccatctctct

SEQ ID NO: 6299 - DNA, 22 bp, Artificial Sequence
  Synthetic Construct
ggtggacaaggtggaaaagtct

SEQ ID NO: 6300 - DNA, 30 bp, Artificial Sequence
  Synthetic Construct
ctagtcttaagagtataaggtagggtgaga

SEQ ID NO: 6301 - DNA, 22 bp, Artificial Sequence
  Synthetic Construct
tttgcccttcccagacaagaca

SEQ ID NO: 6302 - DNA, 20 bp, Artificial Sequence
  Synthetic Construct
ccaccgagctcctcctgtct

SEQ ID NO: 6303 - DNA, 20 bp, Artificial Sequence
  Synthetic Construct
tgcagggaaggactgttgtc

SEQ ID NO: 6304 - DNA, 22 bp, Artificial Sequence
  Synthetic Construct
tcacccaccattcatgcaagag

SEQ ID NO: 6305 - DNA, 23 bp, Artificial Sequence
  Synthetic Construct
gggaatacagtgcaaagcaagga

SEQ ID NO: 6306 - DNA, 24 bp, Artificial Sequence
  Synthetic Construct
gcgcagtagagaagaggcttttag

SEQ ID NO: 6307 - DNA, 25 bp, Artificial Sequence
  Synthetic Construct
caagctaattctgcagcaagtatga

SEQ ID NO: 6308 - DNA, 26 bp, Artificial Sequence
  Synthetic Construct
actcttagttaacacagccatggtat

SEQ ID NO: 6309 - DNA, 21 bp, Artificial Sequence
  Synthetic Construct
attgtggaggcctgaaatgct

SEQ ID NO: 6310 - DNA, 26 bp, Artificial Sequence
  Synthetic Construct
gggctgtttccataatcatcctacct

SEQ ID NO: 6311 - DNA, 23 bp, Artificial Sequence
  Synthetic Construct
tcacaaccagttttcaccaacca

SEQ ID NO: 6312 - DNA, 23 bp, Artificial Sequence
  Synthetic Construct
gagctgagtaaagccatgtgtca

SEQ ID NO: 6313 - DNA, 25 bp, Artificial Sequence
  Synthetic Construct
gtcacccatcccacctatttacttg

SEQ ID NO: 6314 - DNA, 27 bp, Artificial Sequence
  Synthetic Construct
aaggaaatagacccatttagcttcagt

SEQ ID NO: 6315 - DNA, 25 bp, Artificial Sequence
  Synthetic Construct
ggaagttctggctctgtacctgaaa

SEQ ID NO: 6316 - DNA, 20 bp, Artificial Sequence
  Synthetic Construct
tccgtgtgctcagcttgact

SEQ ID NO: 6317 - DNA, 27 bp, Artificial Sequence
  Synthetic Construct
gttttagtcctccttatagcccattgg

SEQ ID NO: 6318 - DNA, 22 bp, Artificial Sequence
  Synthetic Construct
tttggtcaccagcagtggaagt

SEQ ID NO: 6319 - DNA, 23 bp, Artificial Sequence
  Synthetic Construct
gccagtggtggattcaaaaagca

SEQ ID NO: 6320 - DNA, 23 bp, Artificial Sequence
  Synthetic Construct
gctgctggcccttatgcctgaag

SEQ ID NO: 6321 - DNA, 23 bp, Artificial Sequence
  Synthetic Construct
agtctctcaaagcctgacgtttc

SEQ ID NO: 6322 - DNA, 24 bp, Artificial Sequence
  Synthetic Construct
gtggaataagatggaagccacact

SEQ ID NO: 6323 - DNA, 28 bp, Artificial Sequence
  Synthetic Construct
aatattactagccacactgctattcctt

SEQ ID NO: 6324 - DNA, 19 bp, Artificial Sequence
  Synthetic Construct
cgaggacccaccacagtct

SEQ ID NO: 6325 - DNA, 28 bp, Artificial Sequence
  Synthetic Construct
gagtgggataaataaaggctgtaaagag

SEQ ID NO: 6326 - DNA, 22 bp, Artificial Sequence
  Synthetic Construct
tccaatcccacctctgacaatg

SEQ ID NO: 6327 - DNA, 24 bp, Artificial Sequence
  Synthetic Construct
cctgcttagtggcctatgtgatca

SEQ ID NO: 6328 - DNA, 20 bp, Artificial Sequence
  Synthetic Construct
ttgtccccccaacccattca

SEQ ID NO: 6329 - DNA, 22 bp, Artificial Sequence
  Synthetic Construct
ggcaacactccgcttcactatt

SEQ ID NO: 6330 - DNA, 28 bp, Artificial Sequence
  Synthetic Construct
ggtagtaagattaagagctctgattgca

SEQ ID NO: 6331 - DNA, 23 bp, Artificial Sequence
  Synthetic Construct
ccaggaaaagacacccccataca

SEQ ID NO: 6332 - DNA, 25 bp, Artificial Sequence
  Synthetic Construct
gaatggttggtatctaggcatcact

SEQ ID NO: 6333 - DNA, 22 bp, Artificial Sequence
  Synthetic Construct
gagtgccaacagctcagctaat

SEQ ID NO: 6334 - DNA, 27 bp, Artificial Sequence
  Synthetic Construct
gcatcaaactcaactcaaatggaatgt

SEQ ID NO: 6335 - DNA, 21 bp, Artificial Sequence
  Synthetic Construct
tccacatcccctttccacctt

SEQ ID NO: 6336 - DNA, 22 bp, Artificial Sequence
  Synthetic Construct
aggcacccacctctagacagta

SEQ ID NO: 6337 - DNA, 24 bp, Artificial Sequence
  Synthetic Construct
gagtgatggtcaggcagttcatat

SEQ ID NO: 6338 - DNA, 21 bp, Artificial Sequence
  Synthetic Construct
tgcttcctgggcctgttttgt

SEQ ID NO: 6339 - DNA, 20 bp, Artificial Sequence
  Synthetic Construct
tcggcagggagggaagcttt

SEQ ID NO: 6340 - DNA, 20 bp, Artificial Sequence
  Synthetic Construct
ccagggtgcactctcttcct

SEQ ID NO: 6341 - DNA, 21 bp, Artificial Sequence
  Synthetic Construct
agcccctgctgagcttatcca

SEQ ID NO: 6342 - DNA, 27 bp, Artificial Sequence
  Synthetic Construct
cacacctgttatcacagtcttcctagt

SEQ ID NO: 6343 - DNA, 23 bp, Artificial Sequence
  Synthetic Construct
aagtagcctagatttgcctgctt

SEQ ID NO: 6344 - DNA, 23 bp, Artificial Sequence
  Synthetic Construct
atttcctcgaaccactcgctaaa

SEQ ID NO: 6345 - DNA, 22 bp, Artificial Sequence
  Synthetic Construct
caaagccctccttgacttgctt

SEQ ID NO: 6346 - DNA, 21 bp, Artificial Sequence
  Synthetic Construct
ttggctgacccctggtgtagt

SEQ ID NO: 6347 - DNA, 22 bp, Artificial Sequence
  Synthetic Construct
tgcccttagtctagcacagctt

SEQ ID NO: 6348 - DNA, 21 bp, Artificial Sequence
  Synthetic Construct
cccatcaggaaggctgagatg

SEQ ID NO: 6349 - DNA, 26 bp, Artificial Sequence
  Synthetic Construct
gctacttcccctgcatatctattagg

SEQ ID NO: 6350 - DNA, 28 bp, Artificial Sequence
  Synthetic Construct
ggaaattaggtaagcatttcctgaatgg

SEQ ID NO: 6351 - DNA, 27 bp, Artificial Sequence
  Synthetic Construct
ccaaggaacaattttctgtcagtgaga

SEQ ID NO: 6352 - DNA, 26 bp, Artificial Sequence
  Synthetic Construct
gtgatcatcaactggattgcacaaag

SEQ ID NO: 6353 - DNA, 22 bp, Artificial Sequence
  Synthetic Construct
caggcatgctctccaaattctg

SEQ ID NO: 6354 - DNA, 23 bp, Artificial Sequence
  Synthetic Construct
tgggagtctttgccagtggacta

SEQ ID NO: 6355 - DNA, 27 bp, Artificial Sequence
  Synthetic Construct
ctgggggaatagctatatctagttggt

SEQ ID NO: 6356 - DNA, 21 bp, Artificial Sequence
  Synthetic Construct
agatgggcctctcctgtcttc

SEQ ID NO: 6357 - DNA, 20 bp, Artificial Sequence
  Synthetic Construct
gagcccccattgctgtgaat

SEQ ID NO: 6358 - DNA, 21 bp, Artificial Sequence
  Synthetic Construct
agactctggggctctccactt

SEQ ID NO: 6359 - DNA, 20 bp, Artificial Sequence
  Synthetic Construct
cgatggcaggtgcttcagaa

SEQ ID NO: 6360 - DNA, 24 bp, Artificial Sequence
  Synthetic Construct
gactggcaagactgttcacttctg

SEQ ID NO: 6361 - DNA, 20 bp, Artificial Sequence
  Synthetic Construct
ctctccctccctgactgaca

SEQ ID NO: 6362 - DNA, 22 bp, Artificial Sequence
  Synthetic Construct
ggtagcttggggtagcaatgga

SEQ ID NO: 6363 - DNA, 24 bp, Artificial Sequence
  Synthetic Construct
tcctctcaccccctctgataaaag

SEQ ID NO: 6364 - DNA, 25 bp, Artificial Sequence
  Synthetic Construct
gtggtagatttccacgggtcatttg

SEQ ID NO: 6365 - DNA, 20 bp, Artificial Sequence
  Synthetic Construct
agccagcagaagcctccaaa

SEQ ID NO: 6366 - DNA, 22 bp, Artificial Sequence
  Synthetic Construct
tctgaccctcggcaaaaatctg

SEQ ID NO: 6367 - DNA, 25 bp, Artificial Sequence
  Synthetic Construct
cactgaagcaggtaagtgtgaacag

SEQ ID NO: 6368 - DNA, 21 bp, Artificial Sequence
  Synthetic Construct
ccccagcataatgagggtgtt

SEQ ID NO: 6369 - DNA, 18 bp, Artificial Sequence
  Synthetic Construct
agccccgggacagacact

SEQ ID NO: 6370 - DNA, 27 bp, Artificial Sequence
  Synthetic Construct
gaacagtttatgggaatagacgatgtc

SEQ ID NO: 6371 - DNA, 29 bp, Artificial Sequence
  Synthetic Construct
gaaccggaaatatgtaggattatgattgc

SEQ ID NO: 6372 - DNA, 23 bp, Artificial Sequence
  Synthetic Construct
agccgagaatctcagaggatcca

SEQ ID NO: 6373 - DNA, 24 bp, Artificial Sequence
  Synthetic Construct
ctggtcaacgtagtgaggtacaga

SEQ ID NO: 6374 - DNA, 24 bp, Artificial Sequence
  Synthetic Construct
gctagaattcacaggacacagaga

SEQ ID NO: 6375 - DNA, 23 bp, Artificial Sequence
  Synthetic Construct
tctcctccctaaccccctctcaa

SEQ ID NO: 6376 - DNA, 22 bp, Artificial Sequence
  Synthetic Construct
ggagtccaagctccactactca

SEQ ID NO: 6377 - DNA, 25 bp, Artificial Sequence
  Synthetic Construct
ccaccagcaattctcgatgataagg

SEQ ID NO: 6378 - DNA, 21 bp, Artificial Sequence
  Synthetic Construct
tcaggcttccactgcatcttc

SEQ ID NO: 6379 - DNA, 18 bp, Artificial Sequence
  Synthetic Construct
tggctcgcagggtcaaag

SEQ ID NO: 6380 - DNA, 21 bp, Artificial Sequence
  Synthetic Construct
cagaggaagggggcttctctt

SEQ ID NO: 6381 - DNA, 20 bp, Artificial Sequence
  Synthetic Construct
ccagcctcgtggagttttgt

SEQ ID NO: 6382 - DNA, 19 bp, Artificial Sequence
  Synthetic Construct
aggtgggaggcaggaagaa

SEQ ID NO: 6383 - DNA, 25 bp, Artificial Sequence
  Synthetic Construct
agagactcagagagaaactgttcca

SEQ ID NO: 6384 - DNA, 20 bp, Artificial Sequence
  Synthetic Construct
agccggttgttcctctctga

SEQ ID NO: 6385 - DNA, 20 bp, Artificial Sequence
  Synthetic Construct
agcagctcctccaaccttga

SEQ ID NO: 6386 - DNA, 22 bp, Artificial Sequence
  Synthetic Construct
ccaaggctttgtgtccccaaaa

SEQ ID NO: 6387 - DNA, 24 bp, Artificial Sequence
  Synthetic Construct
acctagctatccttccagcatttc

SEQ ID NO: 6388 - DNA, 25 bp, Artificial Sequence
  Synthetic Construct
catcttgtgaaatgccagcattacc

SEQ ID NO: 6389 - DNA, 24 bp, Artificial Sequence
  Synthetic Construct
aagggatgaaagcaatgcattgag

SEQ ID NO: 6390 - DNA, 23 bp, Artificial Sequence
  Synthetic Construct
ggctgtcagtgttcaatctgagt

SEQ ID NO: 6391 - DNA, 23 bp, Artificial Sequence
  Synthetic Construct
cccagaaacacagagtcattgca

SEQ ID NO: 6392 - DNA, 24 bp, Artificial Sequence
  Synthetic Construct
ccatgttacccaagctggaatcct

SEQ ID NO: 6393 - DNA, 18 bp, Artificial Sequence
  Synthetic Construct
ccgtgcccggccattaga

SEQ ID NO: 6394 - DNA, 24 bp, Artificial Sequence
  Synthetic Construct
tggactactacatgtccagaagga

SEQ ID NO: 6395 - DNA, 26 bp, Artificial Sequence
  Synthetic Construct
gccatttaggtaaacacctgggttgt

SEQ ID NO: 6396 - DNA, 25 bp, Artificial Sequence
  Synthetic Construct
ctcaatagtgagggtgggatctaac

SEQ ID NO: 6397 - DNA, 19 bp, Artificial Sequence
  Synthetic Construct
accgtggtggcagcttgat

SEQ ID NO: 6398 - DNA, 25 bp, Artificial Sequence
  Synthetic Construct
caactcctgcttgtttttcctttgg

SEQ ID NO: 6399 - DNA, 24 bp, Artificial Sequence
  Synthetic Construct
gagaaaacatccagtgcagaggaa

SEQ ID NO: 6400 - DNA, 20 bp, Artificial Sequence
  Synthetic Construct
tgccaggaagggagtggatt

SEQ ID NO: 6401 - DNA, 24 bp, Artificial Sequence
  Synthetic Construct
cgtagccccagtggtagcaattaa

SEQ ID NO: 6402 - DNA, 20 bp, Artificial Sequence
  Synthetic Construct
accccaccctctcacaatgt

SEQ ID NO: 6403 - DNA, 22 bp, Artificial Sequence
  Synthetic Construct
gccacctagggaaacaagaaca

SEQ ID NO: 6404 - DNA, 24 bp, Artificial Sequence
  Synthetic Construct
gggagagaaaactgggttctgagt

SEQ ID NO: 6405 - DNA, 18 bp, Artificial Sequence
  Synthetic Construct
cagaagccctgcctgcat

SEQ ID NO: 6406 - DNA, 22 bp, Artificial Sequence
  Synthetic Construct
gagttccagttctggccctttt

SEQ ID NO: 6407 - DNA, 21 bp, Artificial Sequence
  Synthetic Construct
ggacacaagcttgctgaagga

SEQ ID NO: 6408 - DNA, 20 bp, Artificial Sequence
  Synthetic Construct
tgtgttccagagcagttgca

SEQ ID NO: 6409 - DNA, 21 bp, Artificial Sequence
  Synthetic Construct
ggccatagtctcatgcagtgt

SEQ ID NO: 6410 - DNA, 19 bp, Artificial Sequence
  Synthetic Construct
agcagtcacggaaggcaaa

SEQ ID NO: 6411 - DNA, 23 bp, Artificial Sequence
  Synthetic Construct
gctgagttttgagtgcgatatgc

SEQ ID NO: 6412 - DNA, 25 bp, Artificial Sequence
  Synthetic Construct
gcccatagtacactctcactttctg

SEQ ID NO: 6413 - DNA, 24 bp, Artificial Sequence
  Synthetic Construct
cagacgggaagatgggttttgatg

SEQ ID NO: 6414 - DNA, 24 bp, Artificial Sequence
  Synthetic Construct
gggaaaggagaatgttcccagtga

SEQ ID NO: 6415 - DNA, 22 bp, Artificial Sequence
  Synthetic Construct
ctggccataagacacagaagct

SEQ ID NO: 6416 - DNA, 24 bp, Artificial Sequence
  Synthetic Construct
ggaggggatcagtagtgcagataa

SEQ ID NO: 6417 - DNA, 22 bp, Artificial Sequence
  Synthetic Construct
gcgacagagtgagactgagaca

SEQ ID NO: 6418 - DNA, 24 bp, Artificial Sequence
  Synthetic Construct
catcaatggcaaatagcagttgca

SEQ ID NO: 6419 - DNA, 24 bp, Artificial Sequence
  Synthetic Construct
gggaatttaaggagcccgagtgat

SEQ ID NO: 6420 - DNA, 20 bp, Artificial Sequence
  Synthetic Construct
tggaaacccagccaaagtgt

SEQ ID NO: 6421 - DNA, 22 bp, Artificial Sequence
  Synthetic Construct
cagcttccttcaccatgacctt

SEQ ID NO: 6422 - DNA, 23 bp, Artificial Sequence
  Synthetic Construct
gcctatgccaatttgatgccaaa

SEQ ID NO: 6423 - DNA, 27 bp, Artificial Sequence
  Synthetic Construct
ggcaaaggaggatgacaaataggtatt

SEQ ID NO: 6424 - DNA, 19 bp, Artificial Sequence
  Synthetic Construct
agagctgctggcctatgct

SEQ ID NO: 6425 - DNA, 25 bp, Artificial Sequence
  Synthetic Construct
agtggcagaagtgtggatatattgt

SEQ ID NO: 6426 - DNA, 21 bp, Artificial Sequence
  Synthetic Construct
gccttggatggctgagtactg

SEQ ID NO: 6427 - DNA, 24 bp, Artificial Sequence
  Synthetic Construct
gctcagggcttatgagttgtctgt

SEQ ID NO: 6428 - DNA, 26 bp, Artificial Sequence
  Synthetic Construct
ggaggccagaacattttagaggtttg

SEQ ID NO: 6429 - DNA, 20 bp, Artificial Sequence
  Synthetic Construct
gctgggcaggaaggtaccat

SEQ ID NO: 6430 - DNA, 23 bp, Artificial Sequence
  Synthetic Construct
gaggactgaatgaatcggaacca

SEQ ID NO: 6431 - DNA, 19 bp, Artificial Sequence
  Synthetic Construct
cctgctggtgcctgtactg

SEQ ID NO: 6432 - DNA, 20 bp, Artificial Sequence
  Synthetic Construct
gggcctgtggttccagtgat

SEQ ID NO: 6433 - DNA, 20 bp, Artificial Sequence
  Synthetic Construct
tgtttgcaggctgcttggtt

SEQ ID NO: 6434 - DNA, 22 bp, Artificial Sequence
  Synthetic Construct
ggcttcccaaggtcacatctaa

SEQ ID NO: 6435 - DNA, 21 bp, Artificial Sequence
  Synthetic Construct
ctgcctgtgccaatcatcaag

SEQ ID NO: 6436 - DNA, 26 bp, Artificial Sequence
  Synthetic Construct
cactctagtgaaccaagagtgaaggt

SEQ ID NO: 6437 - DNA, 20 bp, Artificial Sequence
  Synthetic Construct
tgagcatccactcccacact

SEQ ID NO: 6438 - DNA, 18 bp, Artificial Sequence
  Synthetic Construct
acgcagctctggggtaca

SEQ ID NO: 6439 - DNA, 27 bp, Artificial Sequence
  Synthetic Construct
cagtgcctgataaagtaagcagtatgg

SEQ ID NO: 6440 - DNA, 20 bp, Artificial Sequence
  Synthetic Construct
atgttgcggtcaccttctgt

SEQ ID NO: 6441 - DNA, 21 bp, Artificial Sequence
  Synthetic Construct
acgggccaagatgctttcagt

SEQ ID NO: 6442 - DNA, 22 bp, Artificial Sequence
  Synthetic Construct
aacttccagcctccactaggaa

SEQ ID NO: 6443 - DNA, 20 bp, Artificial Sequence
  Synthetic Construct
agggcagcgcatgtaagatg

SEQ ID NO: 6444 - DNA, 20 bp, Artificial Sequence
  Synthetic Construct
caccccttcgtgaagcatga

SEQ ID NO: 6445 - DNA, 28 bp, Artificial Sequence
  Synthetic Construct
cccatcatcatataaatctaggcagtct

SEQ ID NO: 6446 - DNA, 23 bp, Artificial Sequence
  Synthetic Construct
catcgatccagagaaccccatag

SEQ ID NO: 6447 - DNA, 22 bp, Artificial Sequence
  Synthetic Construct
cacgtgtttgtcagctccagaa

SEQ ID NO: 6448 - DNA, 26 bp, Artificial Sequence
  Synthetic Construct
caacttcatagtagggagggattctg

SEQ ID NO: 6449 - DNA, 25 bp, Artificial Sequence
  Synthetic Construct
aattctacgagacaacaacccatct

SEQ ID NO: 6450 - DNA, 22 bp, Artificial Sequence
  Synthetic Construct
ctgcagcgaaactggtatccaa

SEQ ID NO: 6451 - DNA, 29 bp, Artificial Sequence
  Synthetic Construct
caccatacttacatgtcatatgccattgt

SEQ ID NO: 6452 - DNA, 28 bp, Artificial Sequence
  Synthetic Construct
gcctctgaattaattcctggcataactc

SEQ ID NO: 6453 - DNA, 22 bp, Artificial Sequence
  Synthetic Construct
tggtatgtcactggtggctttt

SEQ ID NO: 6454 - DNA, 25 bp, Artificial Sequence
  Synthetic Construct
gagtgatgacaacttgctgtttacc

SEQ ID NO: 6455 - DNA, 24 bp, Artificial Sequence
  Synthetic Construct
gccagaggactcgttctctttgtt

SEQ ID NO: 6456 - DNA, 20 bp, Artificial Sequence
  Synthetic Construct
tggaaagaggggtgccaaac

SEQ ID NO: 6457 - DNA, 22 bp, Artificial Sequence
  Synthetic Construct
gccaatgagatcctgcagactt

SEQ ID NO: 6458 - DNA, 27 bp, Artificial Sequence
  Synthetic Construct
gcagtcaatagatatcccgctgttagg

SEQ ID NO: 6459 - DNA, 20 bp, Artificial Sequence
  Synthetic Construct
cactccacctgcacctgaag

SEQ ID NO: 6460 - DNA, 25 bp, Artificial Sequence
  Synthetic Construct
cttccaattgtacagaggggaaaca

SEQ ID NO: 6461 - DNA, 20 bp, Artificial Sequence
  Synthetic Construct
cacgggcaggacagatcaaa

SEQ ID NO: 6462 - DNA, 27 bp, Artificial Sequence
  Synthetic Construct
gacttctgctaaacttgacttgactca

SEQ ID NO: 6463 - DNA, 21 bp, Artificial Sequence
  Synthetic Construct
tcctgggccagttcaatgcat

SEQ ID NO: 6464 - DNA, 21 bp, Artificial Sequence
  Synthetic Construct
gctcccaagccatcactatcc

SEQ ID NO: 6465 - DNA, 22 bp, Artificial Sequence
  Synthetic Construct
gtgtgtcaggtaggcattgcat

SEQ ID NO: 6466 - DNA, 26 bp, Artificial Sequence
  Synthetic Construct
ggtgtatcttgcaaaatcgaccatca

SEQ ID NO: 6467 - DNA, 20 bp, Artificial Sequence
  Synthetic Construct
gtggagggcctaggcaaaat

SEQ ID NO: 6468 - DNA, 26 bp, Artificial Sequence
  Synthetic Construct
ctgaggagtcaggcatagatctacac

SEQ ID NO: 6469 - DNA, 29 bp, Artificial Sequence
  Synthetic Construct
ggatgcaatgagaaagaactaatggtttg

SEQ ID NO: 6470 - DNA, 22 bp, Artificial Sequence
  Synthetic Construct
tgcagtagtggttggagtcaac

SEQ ID NO: 6471 - DNA, 23 bp, Artificial Sequence
  Synthetic Construct
caaagatgcctcccttctcaaga

SEQ ID NO: 6472 - DNA, 27 bp, Artificial Sequence
  Synthetic Construct
ggacatattttgagggtggaacaaacc

SEQ ID NO: 6473 - DNA, 22 bp, Artificial Sequence
  Synthetic Construct
tccaaagtgctgtgctcttcct

SEQ ID NO: 6474 - DNA, 22 bp, Artificial Sequence
  Synthetic Construct
cccattcactcccctcttctga

SEQ ID NO: 6475 - DNA, 23 bp, Artificial Sequence
  Synthetic Construct
caacacagagtaggggttcagtt

SEQ ID NO: 6476 - DNA, 22 bp, Artificial Sequence
  Synthetic Construct
acagcttctgcagggaggttta

SEQ ID NO: 6477 - DNA, 27 bp, Artificial Sequence
  Synthetic Construct
gaggagctaacaattctctagttcaca

SEQ ID NO: 6478 - DNA, 20 bp, Artificial Sequence
  Synthetic Construct
tgtcacggctccatcacagt

SEQ ID NO: 6479 - DNA, 28 bp, Artificial Sequence
  Synthetic Construct
cacactctgcaagctaataaatattcct

SEQ ID NO: 6480 - DNA, 20 bp, Artificial Sequence
  Synthetic Construct
agagccctggagcagacaga

SEQ ID NO: 6481 - DNA, 22 bp, Artificial Sequence
  Synthetic Construct
ggtgggcagagagggtcattta

SEQ ID NO: 6482 - DNA, 26 bp, Artificial Sequence
  Synthetic Construct
cagaaacttgcaatgagttgatctgt

SEQ ID NO: 6483 - DNA, 23 bp, Artificial Sequence
  Synthetic Construct
gagatcgtactgagcctgacaaa

SEQ ID NO: 6484 - DNA, 21 bp, Artificial Sequence
  Synthetic Construct
gcctatgacccaggaccatgt

SEQ ID NO: 6485 - DNA, 23 bp, Artificial Sequence
  Synthetic Construct
acagaactgaggcatggtctttt

SEQ ID NO: 6486 - DNA, 20 bp, Artificial Sequence
  Synthetic Construct
tgacaggtggccttcactca

SEQ ID NO: 6487 - DNA, 27 bp, Artificial Sequence
  Synthetic Construct
aaaactcagctatctttgttcccaaaa

SEQ ID NO: 6488 - DNA, 22 bp, Artificial Sequence
  Synthetic Construct
ctgcttccagttgcttccaagt

SEQ ID NO: 6489 - DNA, 23 bp, Artificial Sequence
  Synthetic Construct
caagaggaaagtgcagtcactga

SEQ ID NO: 6490 - DNA, 22 bp, Artificial Sequence
  Synthetic Construct
tggaacagggtagacagttggt

SEQ ID NO: 6491 - DNA, 22 bp, Artificial Sequence
  Synthetic Construct
ggtcaggaaattgggagtggtt

SEQ ID NO: 6492 - DNA, 30 bp, Artificial Sequence
  Synthetic Construct
ggtgtttgcattaatggaagataggaaacc

SEQ ID NO: 6493 - DNA, 24 bp, Artificial Sequence
  Synthetic Construct
tgatggcagcatattcttcctgtt

SEQ ID NO: 6494 - DNA, 23 bp, Artificial Sequence
  Synthetic Construct
acacctcaaattccacaggacaa

SEQ ID NO: 6495 - DNA, 28 bp, Artificial Sequence
  Synthetic Construct
ccactaaatagtcttcgaaaaccagaag

SEQ ID NO: 6496 - DNA, 20 bp, Artificial Sequence
  Synthetic Construct
tcttgtggcagaagcatcgt

SEQ ID NO: 6497 - DNA, 24 bp, Artificial Sequence
  Synthetic Construct
ggtcacaccagactggaattcagt

SEQ ID NO: 6498 - DNA, 21 bp, Artificial Sequence
  Synthetic Construct
aggttttagcctggcctggta

SEQ ID NO: 6499 - DNA, 22 bp, Artificial Sequence
  Synthetic Construct
agcttacctggggaaggatgct

SEQ ID NO: 6500 - DNA, 21 bp, Artificial Sequence
  Synthetic Construct
tgaggaatgggcatggaagtc

SEQ ID NO: 6501 - DNA, 23 bp, Artificial Sequence
  Synthetic Construct
agcagaggagggaagagtgtgtt

SEQ ID NO: 6502 - DNA, 25 bp, Artificial Sequence
  Synthetic Construct
cacacacacctcatagttccatcct

SEQ ID NO: 6503 - DNA, 23 bp, Artificial Sequence
  Synthetic Construct
gaatgctgtgcatctctgtacac

SEQ ID NO: 6504 - DNA, 20 bp, Artificial Sequence
  Synthetic Construct
aacacccaggctgagaagca

SEQ ID NO: 6505 - DNA, 25 bp, Artificial Sequence
  Synthetic Construct
ctaccctctcttagccctagtaagt

SEQ ID NO: 6506 - DNA, 24 bp, Artificial Sequence
  Synthetic Construct
ccccgattcagagagggaacagat

SEQ ID NO: 6507 - DNA, 25 bp, Artificial Sequence
  Synthetic Construct
ggactgttggccttattttctcact

SEQ ID NO: 6508 - DNA, 24 bp, Artificial Sequence
  Synthetic Construct
gccaattagcttcgagcatttcac

SEQ ID NO: 6509 - DNA, 21 bp, Artificial Sequence
  Synthetic Construct
gcagcaggggttcatgactga

SEQ ID NO: 6510 - DNA, 22 bp, Artificial Sequence
  Synthetic Construct
gggatcagccacactgtacaat

SEQ ID NO: 6511 - DNA, 20 bp, Artificial Sequence
  Synthetic Construct
cacaggagctgcccctcttg

SEQ ID NO: 6512 - DNA, 23 bp, Artificial Sequence
  Synthetic Construct
agggaggcagagctacagagatt

SEQ ID NO: 6513 - DNA, 24 bp, Artificial Sequence
  Synthetic Construct
cctctcgactactctcagctttgt

SEQ ID NO: 6514 - DNA, 19 bp, Artificial Sequence
  Synthetic Construct
ctccccaggaacccacaga

SEQ ID NO: 6515 - DNA, 24 bp, Artificial Sequence
  Synthetic Construct
ggcttgtcatcgaagtggaaatgg

SEQ ID NO: 6516 - DNA, 26 bp, Artificial Sequence
  Synthetic Construct
ggaacaactgaggagactacttggat

SEQ ID NO: 6517 - DNA, 23 bp, Artificial Sequence
  Synthetic Construct
cagagtgctacgtctttggaaga

SEQ ID NO: 6518 - DNA, 25 bp, Artificial Sequence
  Synthetic Construct
ccactgaaagatgtcaggctaaact

SEQ ID NO: 6519 - DNA, 24 bp, Artificial Sequence
  Synthetic Construct
tctgcctccatctgttagcttacc

SEQ ID NO: 6520 - DNA, 26 bp, Artificial Sequence
  Synthetic Construct
gcctccgatgagcttatcatagcatt

SEQ ID NO: 6521 - DNA, 21 bp, Artificial Sequence
  Synthetic Construct
tgcacctcctcctgcttcaat

SEQ ID NO: 6522 - DNA, 19 bp, Artificial Sequence
  Synthetic Construct
tcaccacggccacctgtct

SEQ ID NO: 6523 - DNA, 24 bp, Artificial Sequence
  Synthetic Construct
gacatggccctttgatcactcaaa

SEQ ID NO: 6524 - DNA, 21 bp, Artificial Sequence
  Synthetic Construct
tggctgggagcttagaaacag

SEQ ID NO: 6525 - DNA, 24 bp, Artificial Sequence
  Synthetic Construct
ggtgagtctgaggcaaaacttcat

SEQ ID NO: 6526 - DNA, 23 bp, Artificial Sequence
  Synthetic Construct
cactgagtatgtgccttggtcaa

SEQ ID NO: 6527 - DNA, 23 bp, Artificial Sequence
  Synthetic Construct
cccaggtttgtggtagggtagaa

SEQ ID NO: 6528 - DNA, 27 bp, Artificial Sequence
  Synthetic Construct
ggtgagctttagggaggaaagatagag

SEQ ID NO: 6529 - DNA, 23 bp, Artificial Sequence
  Synthetic Construct
tcagatgccaaatgtagcaccat

SEQ ID NO: 6530 - DNA, 20 bp, Artificial Sequence
  Synthetic Construct
gcagccatgccatcgttagg

SEQ ID NO: 6531 - DNA, 22 bp, Artificial Sequence
  Synthetic Construct
gtaacagaccctcctcccagat

SEQ ID NO: 6532 - DNA, 21 bp, Artificial Sequence
  Synthetic Construct
tgtgcattggcccttactgat

SEQ ID NO: 6533 - DNA, 21 bp, Artificial Sequence
  Synthetic Construct
aagcagccctgattcccatga

SEQ ID NO: 6534 - DNA, 22 bp, Artificial Sequence
  Synthetic Construct
gcctctggtaggagaagccaaa

SEQ ID NO: 6535 - DNA, 26 bp, Artificial Sequence
  Synthetic Construct
gggatttctctgtggctaagcttctg

SEQ ID NO: 6536 - DNA, 23 bp, Artificial Sequence
  Synthetic Construct
cttcccaagcaacccgggactat

SEQ ID NO: 6537 - DNA, 22 bp, Artificial Sequence
  Synthetic Construct
atgctctggctactgctattgg

SEQ ID NO: 6538 - DNA, 22 bp, Artificial Sequence
  Synthetic Construct
aggacaggccaggggtagataa

SEQ ID NO: 6539 - DNA, 22 bp, Artificial Sequence
  Synthetic Construct
acagaatgctgctctccatcca

SEQ ID NO: 6540 - DNA, 23 bp, Artificial Sequence
  Synthetic Construct
gttttggttgtgcaagggtagga

SEQ ID NO: 6541 - DNA, 23 bp, Artificial Sequence
  Synthetic Construct
cctagctccaggatacctcaaca

SEQ ID NO: 6542 - DNA, 21 bp, Artificial Sequence
  Synthetic Construct
gctgtctgtgggagagagaga

SEQ ID NO: 6543 - DNA, 23 bp, Artificial Sequence
  Synthetic Construct
caaatgattttggccccacttct

SEQ ID NO: 6544 - DNA, 25 bp, Artificial Sequence
  Synthetic Construct
ggccaatgactaaagtgtgggaaac

SEQ ID NO: 6545 - DNA, 26 bp, Artificial Sequence
  Synthetic Construct
ggagttagagtgagaacaggaagcaa

SEQ ID NO: 6546 - DNA, 25 bp, Artificial Sequence
  Synthetic Construct
gcagtgaggtataatggcaccatta

SEQ ID NO: 6547 - DNA, 22 bp, Artificial Sequence
  Synthetic Construct
tgagccaagacgagaaccaaac

SEQ ID NO: 6548 - DNA, 21 bp, Artificial Sequence
  Synthetic Construct
cctgccccctgagttcctagt

SEQ ID NO: 6549 - DNA, 26 bp, Artificial Sequence
  Synthetic Construct
ggctctgaggaatcgtgactatgttg

SEQ ID NO: 6550 - DNA, 24 bp, Artificial Sequence
  Synthetic Construct
agaaggctgtacctcctactctag

SEQ ID NO: 6551 - DNA, 27 bp, Artificial Sequence
  Synthetic Construct
gggacagttcttccgactcttacattc

SEQ ID NO: 6552 - DNA, 27 bp, Artificial Sequence
  Synthetic Construct
agttaactacaaacactgagcagtttg

SEQ ID NO: 6553 - DNA, 25 bp, Artificial Sequence
  Synthetic Construct
ccaggattactgcatatcccaagtg

SEQ ID NO: 6554 - DNA, 19 bp, Artificial Sequence
  Synthetic Construct
tgctgtcagtccccaaagc

SEQ ID NO: 6555 - DNA, 22 bp, Artificial Sequence
  Synthetic Construct
gaattctgctggggaggagaaa

SEQ ID NO: 6556 - DNA, 25 bp, Artificial Sequence
  Synthetic Construct
gggagagttgtactgtttccaggtt

SEQ ID NO: 6557 - DNA, 21 bp, Artificial Sequence
  Synthetic Construct
tcatggcctcagcacagtgaa

SEQ ID NO: 6558 - DNA, 25 bp, Artificial Sequence
  Synthetic Construct
agagacaagttgacaagttggatca

SEQ ID NO: 6559 - DNA, 24 bp, Artificial Sequence
  Synthetic Construct
tccacaacgtctcagtctgagtct

SEQ ID NO: 6560 - DNA, 20 bp, Artificial Sequence
  Synthetic Construct
gtggccagtttgcaacatgt

SEQ ID NO: 6561 - DNA, 22 bp, Artificial Sequence
  Synthetic Construct
ccatggccatcctctactgaga

SEQ ID NO: 6562 - DNA, 22 bp, Artificial Sequence
  Synthetic Construct
gccacttagtgaagccttttgc

SEQ ID NO: 6563 - DNA, 25 bp, Artificial Sequence
  Synthetic Construct
agtgacttgtctacttgccttttca

SEQ ID NO: 6564 - DNA, 22 bp, Artificial Sequence
  Synthetic Construct
gatggggaaacaagcacagact

SEQ ID NO: 6565 - DNA, 22 bp, Artificial Sequence
  Synthetic Construct
cgtggccttagaggatcacaga

SEQ ID NO: 6566 - DNA, 19 bp, Artificial Sequence
  Synthetic Construct
ccagggtccactcccatct

SEQ ID NO: 6567 - DNA, 24 bp, Artificial Sequence
  Synthetic Construct
gagcaactggcagagtatgacaag

SEQ ID NO: 6568 - DNA, 24 bp, Artificial Sequence
  Synthetic Construct
gcaagatgaaagatgtggcattgt

SEQ ID NO: 6569 - DNA, 24 bp, Artificial Sequence
  Synthetic Construct
gtcctaaagcactgcaagtagttc

SEQ ID NO: 6570 - DNA, 23 bp, Artificial Sequence
  Synthetic Construct
gggatacagtttggggaacagtt

SEQ ID NO: 6571 - DNA, 20 bp, Artificial Sequence
  Synthetic Construct
gcctgaaagaccgagctcaa

SEQ ID NO: 6572 - DNA, 21 bp, Artificial Sequence
  Synthetic Construct
ccggccttgtccccaatttta

SEQ ID NO: 6573 - DNA, 21 bp, Artificial Sequence
  Synthetic Construct
tgcagtcttcagtcccttcgt

SEQ ID NO: 6574 - DNA, 22 bp, Artificial Sequence
  Synthetic Construct
gcacagggtgacaatcacttct

SEQ ID NO: 6575 - DNA, 24 bp, Artificial Sequence
  Synthetic Construct
accttcctcttcccaagtctcgtt

SEQ ID NO: 6576 - DNA, 22 bp, Artificial Sequence
  Synthetic Construct
tttgggggaagttttggtggaa

SEQ ID NO: 6577 - DNA, 22 bp, Artificial Sequence
  Synthetic Construct
gctgagcagggacatcttttga

SEQ ID NO: 6578 - DNA, 22 bp, Artificial Sequence
  Synthetic Construct
gccccctctgaggcttatttcc

SEQ ID NO: 6579 - DNA, 24 bp, Artificial Sequence
  Synthetic Construct
gagggattgtggatctgcttgatg

SEQ ID NO: 6580 - DNA, 21 bp, Artificial Sequence
  Synthetic Construct
cgaggggtgatgaaggattgg

SEQ ID NO: 6581 - DNA, 28 bp, Artificial Sequence
  Synthetic Construct
ccttgtcctacaattagaggcaaaattg

SEQ ID NO: 6582 - DNA, 24 bp, Artificial Sequence
  Synthetic Construct
ggtccttcaacatgaggagctttc

SEQ ID NO: 6583 - DNA, 22 bp, Artificial Sequence
  Synthetic Construct
aaggggtccaggtgacataacg

SEQ ID NO: 6584 - DNA, 21 bp, Artificial Sequence
  Synthetic Construct
tccatctcaggggcagatcca

SEQ ID NO: 6585 - DNA, 20 bp, Artificial Sequence
  Synthetic Construct
tgcccgggagcaaaatcagt

SEQ ID NO: 6586 - DNA, 24 bp, Artificial Sequence
  Synthetic Construct
tcaggggagtatgatggagagcta

SEQ ID NO: 6587 - DNA, 27 bp, Artificial Sequence
  Synthetic Construct
gctaaaaccaataactacggtcaagtc

SEQ ID NO: 6588 - DNA, 21 bp, Artificial Sequence
  Synthetic Construct
agatggggccactgtattgct

SEQ ID NO: 6589 - DNA, 25 bp, Artificial Sequence
  Synthetic Construct
gagtgaatacattgagggccttgac

SEQ ID NO: 6590 - DNA, 24 bp, Artificial Sequence
  Synthetic Construct
cgctaagcatgatgccaggttttg

SEQ ID NO: 6591 - DNA, 20 bp, Artificial Sequence
  Synthetic Construct
catcagacagcctcgtgcat

SEQ ID NO: 6592 - DNA, 25 bp, Artificial Sequence
  Synthetic Construct
ccaagcagcttagctatagcattcc

SEQ ID NO: 6593 - DNA, 25 bp, Artificial Sequence
  Synthetic Construct
gtagcttccatccagttaacctcaa

SEQ ID NO: 6594 - DNA, 27 bp, Artificial Sequence
  Synthetic Construct
gaggaaatacaactggaatctggttga

SEQ ID NO: 6595 - DNA, 24 bp, Artificial Sequence
  Synthetic Construct
aggctccagttttgaggtgacaag

SEQ ID NO: 6596 - DNA, 27 bp, Artificial Sequence
  Synthetic Construct
ggtgagaagagagaagtaatggttcac

SEQ ID NO: 6597 - DNA, 24 bp, Artificial Sequence
  Synthetic Construct
ctgactagggtactgtctcctgat

SEQ ID NO: 6598 - DNA, 24 bp, Artificial Sequence
  Synthetic Construct
accaatcttgacctggggaaactg

SEQ ID NO: 6599 - DNA, 21 bp, Artificial Sequence
  Synthetic Construct
atggccagtaagggggctact

SEQ ID NO: 6600 - DNA, 23 bp, Artificial Sequence
  Synthetic Construct
accttctgcagagtcctggatgt

SEQ ID NO: 6601 - DNA, 24 bp, Artificial Sequence
  Synthetic Construct
agttggggaggtagatgtgtttcc

SEQ ID NO: 6602 - DNA, 24 bp, Artificial Sequence
  Synthetic Construct
ccatttacaccagggatcgagaca

SEQ ID NO: 6603 - DNA, 22 bp, Artificial Sequence
  Synthetic Construct
agtccgtccaggttcaaaagtg

SEQ ID NO: 6604 - DNA, 25 bp, Artificial Sequence
  Synthetic Construct
tctagtccttctgtttggagtttgg

SEQ ID NO: 6605 - DNA, 24 bp, Artificial Sequence
  Synthetic Construct
agacatcagttccttgaagctgaa

SEQ ID NO: 6606 - DNA, 23 bp, Artificial Sequence
  Synthetic Construct
tgcagatgtctaggctccactca

SEQ ID NO: 6607 - DNA, 27 bp, Artificial Sequence
  Synthetic Construct
aaagtattgtagccatggagagatcaa

SEQ ID NO: 6608 - DNA, 20 bp, Artificial Sequence
  Synthetic Construct
atgggttctgggctgacaga

SEQ ID NO: 6609 - DNA, 22 bp, Artificial Sequence
  Synthetic Construct
gccttggcctcaatatgagctt

SEQ ID NO: 6610 - DNA, 21 bp, Artificial Sequence
  Synthetic Construct
agcaggtgaggactgaggatt

SEQ ID NO: 6611 - DNA, 21 bp, Artificial Sequence
  Synthetic Construct
gtggagaaggtaggcctgact

SEQ ID NO: 6612 - DNA, 23 bp, Artificial Sequence
  Synthetic Construct
gccatcccatctgagatgctaga

SEQ ID NO: 6613 - DNA, 29 bp, Artificial Sequence
  Synthetic Construct
cacagtagatactaactggtcttactgtt

SEQ ID NO: 6614 - DNA, 22 bp, Artificial Sequence
  Synthetic Construct
ttctgggacgccagcagaactt

SEQ ID NO: 6615 - DNA, 26 bp, Artificial Sequence
  Synthetic Construct
gaaaaatcaatccctccttccatgag

SEQ ID NO: 6616 - DNA, 26 bp, Artificial Sequence
  Synthetic Construct
cgtcacatcgtttatgctaacagtct

SEQ ID NO: 6617 - DNA, 23 bp, Artificial Sequence
  Synthetic Construct
aacttcgtgggatccctcttctg

SEQ ID NO: 6618 - DNA, 26 bp, Artificial Sequence
  Synthetic Construct
tgacaatttttggcactagagacact

SEQ ID NO: 6619 - DNA, 22 bp, Artificial Sequence
  Synthetic Construct
tcattcctggacccagctttct

SEQ ID NO: 6620 - DNA, 26 bp, Artificial Sequence
  Synthetic Construct
ggtacttcctgaacatcactctgtac

SEQ ID NO: 6621 - DNA, 22 bp, Artificial Sequence
  Synthetic Construct
gtgggctttggtgtgtaattgg

SEQ ID NO: 6622 - DNA, 19 bp, Artificial Sequence
  Synthetic Construct
ccagcgtggctccgagcaa

SEQ ID NO: 6623 - DNA, 24 bp, Artificial Sequence
  Synthetic Construct
ggaaatctcagtagggcattttgc

SEQ ID NO: 6624 - DNA, 22 bp, Artificial Sequence
  Synthetic Construct
acactatgtctcctgcctggaa

SEQ ID NO: 6625 - DNA, 26 bp, Artificial Sequence
  Synthetic Construct
cctacctactacacttctgtgcagtt

SEQ ID NO: 6626 - DNA, 21 bp, Artificial Sequence
  Synthetic Construct
agggacccattggtgaacagt

SEQ ID NO: 6627 - DNA, 22 bp, Artificial Sequence
  Synthetic Construct
tcctgtgcccaaaagacctaga

SEQ ID NO: 6628 - DNA, 22 bp, Artificial Sequence
  Synthetic Construct
ggtcacagccataacacagaca

SEQ ID NO: 6629 - DNA, 24 bp, Artificial Sequence
  Synthetic Construct
aggttcctgggagctgaatataca

SEQ ID NO: 6630 - DNA, 21 bp, Artificial Sequence
  Synthetic Construct
atgggggttatggtggcaaga

SEQ ID NO: 6631 - DNA, 23 bp, Artificial Sequence
  Synthetic Construct
tggatgtgttttgtgtccaccaa

SEQ ID NO: 6632 - DNA, 18 bp, Artificial Sequence
  Synthetic Construct
agcatggaggccgatgtg

SEQ ID NO: 6633 - DNA, 26 bp, Artificial Sequence
  Synthetic Construct
ccttcctgtcagatttacctgattgc

SEQ ID NO: 6634 - DNA, 24 bp, Artificial Sequence
  Synthetic Construct
aaaagcctgccctatagtcagtac

SEQ ID NO: 6635 - DNA, 25 bp, Artificial Sequence
  Synthetic Construct
agatatagactggctgctgtctaga

SEQ ID NO: 6636 - DNA, 24 bp, Artificial Sequence
  Synthetic Construct
gcctccacagcagtgattctcaaa

SEQ ID NO: 6637 - DNA, 26 bp, Artificial Sequence
  Synthetic Construct
cccactacccatctcattgcttaagc

SEQ ID NO: 6638 - DNA, 24 bp, Artificial Sequence
  Synthetic Construct
ggcaacggagtgattcagttctct

SEQ ID NO: 6639 - DNA, 27 bp, Artificial Sequence
  Synthetic Construct
gttttactcttacgtactgctgattgc

SEQ ID NO: 6640 - DNA, 22 bp, Artificial Sequence
  Synthetic Construct
agcagcaccacactgtagtagt

SEQ ID NO: 6641 - DNA, 22 bp, Artificial Sequence
  Synthetic Construct
gagagcctacgacaacattcca

SEQ ID NO: 6642 - DNA, 25 bp, Artificial Sequence
  Synthetic Construct
gctgataaaccggatacagctttcc

SEQ ID NO: 6643 - DNA, 24 bp, Artificial Sequence
  Synthetic Construct
cctggctctcctgtgtagcaaata

SEQ ID NO: 6644 - DNA, 20 bp, Artificial Sequence
  Synthetic Construct
tgccatcactgtggtgcatt

SEQ ID NO: 6645 - DNA, 21 bp, Artificial Sequence
  Synthetic Construct
tccgtgagtcagctaccatgt

SEQ ID NO: 6646 - DNA, 20 bp, Artificial Sequence
  Synthetic Construct
accccacgaccatgagtcaa

SEQ ID NO: 6647 - DNA, 18 bp, Artificial Sequence
  Synthetic Construct
aggggctgcgagcagttg

SEQ ID NO: 6648 - DNA, 22 bp, Artificial Sequence
  Synthetic Construct
tgaccaggtacccttgttcagt

SEQ ID NO: 6649 - DNA, 23 bp, Artificial Sequence
  Synthetic Construct
gacttggtaatcccactcccaaa

SEQ ID NO: 6650 - DNA, 22 bp, Artificial Sequence
  Synthetic Construct
agattggagttgccatcaagca

SEQ ID NO: 6651 - DNA, 24 bp, Artificial Sequence
  Synthetic Construct
tgtgttaccatggaatctcttgca

SEQ ID NO: 6652 - DNA, 28 bp, Artificial Sequence
  Synthetic Construct
gaatgaaacaagaaggtctaggcttttc

SEQ ID NO: 6653 - DNA, 20 bp, Artificial Sequence
  Synthetic Construct
tggccaggtcctcacagcat

SEQ ID NO: 6654 - DNA, 22 bp, Artificial Sequence
  Synthetic Construct
gatggcagctgagattctgtca

SEQ ID NO: 6655 - DNA, 21 bp, Artificial Sequence
  Synthetic Construct
aagtccgcacagagctttgga

SEQ ID NO: 6656 - DNA, 22 bp, Artificial Sequence
  Synthetic Construct
tcagagggcctgatctcaatgt

SEQ ID NO: 6657 - DNA, 24 bp, Artificial Sequence
  Synthetic Construct
gacccacagactgatacacttgtg

SEQ ID NO: 6658 - DNA, 18 bp, Artificial Sequence
  Synthetic Construct
ccaggacctggccatcct

SEQ ID NO: 6659 - DNA, 27 bp, Artificial Sequence
  Synthetic Construct
gggaaaaggaatgcttgatggaagttc

SEQ ID NO: 6660 - DNA, 21 bp, Artificial Sequence
  Synthetic Construct
ttgcgggaccagcatccaaat

SEQ ID NO: 6661 - DNA, 24 bp, Artificial Sequence
  Synthetic Construct
cacctccctggttgttggaaaatc

SEQ ID NO: 6662 - DNA, 20 bp, Artificial Sequence
  Synthetic Construct
tcaccagggtagggcaatgt

SEQ ID NO: 6663 - DNA, 25 bp, Artificial Sequence
  Synthetic Construct
ctgaagagatgacctaaagctcaca

SEQ ID NO: 6664 - DNA, 22 bp, Artificial Sequence
  Synthetic Construct
ggcagaatttagcaccggagta

SEQ ID NO: 6665 - DNA, 24 bp, Artificial Sequence
  Synthetic Construct
gaagaaatttggatggctcagctt

SEQ ID NO: 6666 - DNA, 22 bp, Artificial Sequence
  Synthetic Construct
ttggccgaccagagtatgaatc

SEQ ID NO: 6667 - DNA, 21 bp, Artificial Sequence
  Synthetic Construct
aggtggaggccatctgctttt

SEQ ID NO: 6668 - DNA, 25 bp, Artificial Sequence
  Synthetic Construct
cgttcagattgggagcaagaaagac

SEQ ID NO: 6669 - DNA, 25 bp, Artificial Sequence
  Synthetic Construct
gttgttggttgggttggtttattgg

SEQ ID NO: 6670 - DNA, 21 bp, Artificial Sequence
  Synthetic Construct
cagcctcctcacctttcactt

SEQ ID NO: 6671 - DNA, 28 bp, Artificial Sequence
  Synthetic Construct
gaactcacactgtaacacttttagtcaa

SEQ ID NO: 6672 - DNA, 22 bp, Artificial Sequence
  Synthetic Construct
gatatgggctgcaggaaacctt

SEQ ID NO: 6673 - DNA, 20 bp, Artificial Sequence
  Synthetic Construct
tcccccaacctctccttcca

SEQ ID NO: 6674 - DNA, 22 bp, Artificial Sequence
  Synthetic Construct
ttgggcttgagtgtggatagct

SEQ ID NO: 6675 - DNA, 20 bp, Artificial Sequence
  Synthetic Construct
cctcgctgtggcttatgaca

SEQ ID NO: 6676 - DNA, 22 bp, Artificial Sequence
  Synthetic Construct
gcacaggaaaaaggtggtttcc

SEQ ID NO: 6677 - DNA, 20 bp, Artificial Sequence
  Synthetic Construct
ggggctagggcaaaggaaaa

SEQ ID NO: 6678 - DNA, 19 bp, Artificial Sequence
  Synthetic Construct
gtggcctgaggtcatgctt

SEQ ID NO: 6679 - DNA, 25 bp, Artificial Sequence
  Synthetic Construct
tcactccactttacaggcacatatt

SEQ ID NO: 6680 - DNA, 24 bp, Artificial Sequence
  Synthetic Construct
gacctgtggattggctcaatttcc

SEQ ID NO: 6681 - DNA, 22 bp, Artificial Sequence
  Synthetic Construct
ccattgccacctgattctttgc

SEQ ID NO: 6682 - DNA, 22 bp, Artificial Sequence
  Synthetic Construct
ctcatcctgactgcctttgcta

SEQ ID NO: 6683 - DNA, 19 bp, Artificial Sequence
  Synthetic Construct
agtgctgtggcctcattgc

SEQ ID NO: 6684 - DNA, 26 bp, Artificial Sequence
  Synthetic Construct
catcagttcaaagcctagactctctt

SEQ ID NO: 6685 - DNA, 19 bp, Artificial Sequence
  Synthetic Construct
ccttctggcctggcccaaa

SEQ ID NO: 6686 - DNA, 24 bp, Artificial Sequence
  Synthetic Construct
tgttcccactttctttcccttctg

SEQ ID NO: 6687 - DNA, 24 bp, Artificial Sequence
  Synthetic Construct
ggaaaggagaatagcagtgaagga

SEQ ID NO: 6688 - DNA, 22 bp, Artificial Sequence
  Synthetic Construct
cctggaacaataggcccatgat

SEQ ID NO: 6689 - DNA, 22 bp, Artificial Sequence
  Synthetic Construct
aaggtagctggggcaagagtaa

SEQ ID NO: 6690 - DNA, 21 bp, Artificial Sequence
  Synthetic Construct
cagcaaagccagcagtagtca

SEQ ID NO: 6691 - DNA, 21 bp, Artificial Sequence
  Synthetic Construct
gactgtgtgcccattcactgt

SEQ ID NO: 6692 - DNA, 27 bp, Artificial Sequence
  Synthetic Construct
gttggtagaccttagagatcaatgagt

SEQ ID NO: 6693 - DNA, 26 bp, Artificial Sequence
  Synthetic Construct
ccctatcttccactgcctgttaactc

SEQ ID NO: 6694 - DNA, 22 bp, Artificial Sequence
  Synthetic Construct
gctgcttttgctcccctttgat

SEQ ID NO: 6695 - DNA, 30 bp, Artificial Sequence
  Synthetic Construct
aaatacatgtgttagataggcttctttcag

SEQ ID NO: 6696 - DNA, 21 bp, Artificial Sequence
  Synthetic Construct
gcaactgtgcccaatcatgct

SEQ ID NO: 6697 - DNA, 23 bp, Artificial Sequence
  Synthetic Construct
ggcttccttgtttttccctccaa

SEQ ID NO: 6698 - DNA, 19 bp, Artificial Sequence
  Synthetic Construct
aggccgcaccctcccacat

SEQ ID NO: 6699 - DNA, 24 bp, Artificial Sequence
  Synthetic Construct
ggttgccattgtgtccatttttga

SEQ ID NO: 6700 - DNA, 22 bp, Artificial Sequence
  Synthetic Construct
ctgctcagaagctgcctgattt

SEQ ID NO: 6701 - DNA, 21 bp, Artificial Sequence
  Synthetic Construct
ttgctccacaggacagaacag

SEQ ID NO: 6702 - DNA, 24 bp, Artificial Sequence
  Synthetic Construct
tgtcttctggacaggatggtcttc

SEQ ID NO: 6703 - DNA, 22 bp, Artificial Sequence
  Synthetic Construct
ttcccaggatgaccttgtgtga

SEQ ID NO: 6704 - DNA, 24 bp, Artificial Sequence
  Synthetic Construct
agtcttctttgggtggactttctg

SEQ ID NO: 6705 - DNA, 28 bp, Artificial Sequence
  Synthetic Construct
gtaaaatgattcaaaaggggttctgagt

SEQ ID NO: 6706 - DNA, 22 bp, Artificial Sequence
  Synthetic Construct
ctccagtgggggtgggtgtcat

SEQ ID NO: 6707 - DNA, 26 bp, Artificial Sequence
  Synthetic Construct
ctttagagcaaattccttcccattcc

SEQ ID NO: 6708 - DNA, 24 bp, Artificial Sequence
  Synthetic Construct
gcaggttaaatccctggtctcaag

SEQ ID NO: 6709 - DNA, 20 bp, Artificial Sequence
  Synthetic Construct
agcttgtgctcctcccaact

SEQ ID NO: 6710 - DNA, 22 bp, Artificial Sequence
  Synthetic Construct
gctccattctctctgcagacaa

SEQ ID NO: 6711 - DNA, 27 bp, Artificial Sequence
  Synthetic Construct
gctcttcaaatacgatctcctgtaagc

SEQ ID NO: 6712 - DNA, 24 bp, Artificial Sequence
  Synthetic Construct
acgcagctggagatgagagatagt

SEQ ID NO: 6713 - DNA, 22 bp, Artificial Sequence
  Synthetic Construct
gacttgttccctgtgtgaagca

SEQ ID NO: 6714 - DNA, 22 bp, Artificial Sequence
  Synthetic Construct
aatggcacagttgtccagagaa

SEQ ID NO: 6715 - DNA, 20 bp, Artificial Sequence
  Synthetic Construct
ctgcacctggaggactctga

SEQ ID NO: 6716 - DNA, 22 bp, Artificial Sequence
  Synthetic Construct
gtccacaagttcaagccaacag

SEQ ID NO: 6717 - DNA, 24 bp, Artificial Sequence
  Synthetic Construct
attcacatgacaccttgtgatcct

SEQ ID NO: 6718 - DNA, 20 bp, Artificial Sequence
  Synthetic Construct
aggaacagaggcccagagaa

SEQ ID NO: 6719 - DNA, 24 bp, Artificial Sequence
  Synthetic Construct
ttcaacctggcatagcctcatgag

SEQ ID NO: 6720 - DNA, 22 bp, Artificial Sequence
  Synthetic Construct
aagagccgtcaaagggatgatc

SEQ ID NO: 6721 - DNA, 19 bp, Artificial Sequence
  Synthetic Construct
gctaccacctgcccaaagt

SEQ ID NO: 6722 - DNA, 22 bp, Artificial Sequence
  Synthetic Construct
ccaggtgttgctagcagtactc

SEQ ID NO: 6723 - DNA, 26 bp, Artificial Sequence
  Synthetic Construct
acagtgacagttaagaggtctttgtc

SEQ ID NO: 6724 - DNA, 22 bp, Artificial Sequence
  Synthetic Construct
agggtggggatcaaaggaagtt

SEQ ID NO: 6725 - DNA, 21 bp, Artificial Sequence
  Synthetic Construct
tgggacagggatccacaggta

SEQ ID NO: 6726 - DNA, 20 bp, Artificial Sequence
  Synthetic Construct
ctgtgaaaccctgccacaca

SEQ ID NO: 6727 - DNA, 20 bp, Artificial Sequence
  Synthetic Construct
tggtgtcctgggagccattt

SEQ ID NO: 6728 - DNA, 23 bp, Artificial Sequence
  Synthetic Construct
gagggaccacttgacagtattgt

SEQ ID NO: 6729 - DNA, 28 bp, Artificial Sequence
  Synthetic Construct
tcaataagatttttaagcaacccaccat

SEQ ID NO: 6730 - DNA, 24 bp, Artificial Sequence
  Synthetic Construct
aatgagctgtgatttgctgtgttt

SEQ ID NO: 6731 - DNA, 22 bp, Artificial Sequence
  Synthetic Construct
ccattcgtgaaggtggagttgt

SEQ ID NO: 6732 - DNA, 22 bp, Artificial Sequence
  Synthetic Construct
tgagacgaggtctggttctgtt

SEQ ID NO: 6733 - DNA, 22 bp, Artificial Sequence
  Synthetic Construct
gcctgtccagcaatggcctaga

SEQ ID NO: 6734 - DNA, 26 bp, Artificial Sequence
  Synthetic Construct
ggcctatcagtcaggttgtttaagtg

SEQ ID NO: 6735 - DNA, 21 bp, Artificial Sequence
  Synthetic Construct
ttggccttctgcagcaaggat

SEQ ID NO: 6736 - DNA, 22 bp, Artificial Sequence
  Synthetic Construct
gattttacaggcaccccagctt

SEQ ID NO: 6737 - DNA, 22 bp, Artificial Sequence
  Synthetic Construct
tgaggaggagttgagggaatga

SEQ ID NO: 6738 - DNA, 21 bp, Artificial Sequence
  Synthetic Construct
agcctctgggaccaggacaaa

SEQ ID NO: 6739 - DNA, 21 bp, Artificial Sequence
  Synthetic Construct
agcatggaggctctgggatga

SEQ ID NO: 6740 - DNA, 23 bp, Artificial Sequence
  Synthetic Construct
gcagcttcctcaaacgtaacatg

SEQ ID NO: 6741 - DNA, 21 bp, Artificial Sequence
  Synthetic Construct
agctcacagatctgggtctgt

SEQ ID NO: 6742 - DNA, 23 bp, Artificial Sequence
  Synthetic Construct
cctgtgggaggagaggtcaccat

SEQ ID NO: 6743 - DNA, 22 bp, Artificial Sequence
  Synthetic Construct
ggcagcgtttgtgaatgtacag

SEQ ID NO: 6744 - DNA, 21 bp, Artificial Sequence
  Synthetic Construct
attcacagcttggcacagagt

SEQ ID NO: 6745 - DNA, 24 bp, Artificial Sequence
  Synthetic Construct
ccaaaacaggcagaccatgtcctt

SEQ ID NO: 6746 - DNA, 20 bp, Artificial Sequence
  Synthetic Construct
aagggcaggggaaggaaagg

SEQ ID NO: 6747 - DNA, 24 bp, Artificial Sequence
  Synthetic Construct
tgccaatgggaggatagggatact

SEQ ID NO: 6748 - DNA, 22 bp, Artificial Sequence
  Synthetic Construct
gctgtctccagaattccatggt

SEQ ID NO: 6749 - DNA, 19 bp, Artificial Sequence
  Synthetic Construct
gggaaccccaggcatgtga

SEQ ID NO: 6750 - DNA, 19 bp, Artificial Sequence
  Synthetic Construct
cccatgtgtgcccatttgc

SEQ ID NO: 6751 - DNA, 19 bp, Artificial Sequence
  Synthetic Construct
tgcccctgccatccgtcat

SEQ ID NO: 6752 - DNA, 23 bp, Artificial Sequence
  Synthetic Construct
cccataaagagatggtgccagtt

SEQ ID NO: 6753 - DNA, 22 bp, Artificial Sequence
  Synthetic Construct
cggaggaaaccacaaggtcctt

SEQ ID NO: 6754 - DNA, 23 bp, Artificial Sequence
  Synthetic Construct
gcttcgtgcttttacctgactgt

SEQ ID NO: 6755 - DNA, 21 bp, Artificial Sequence
  Synthetic Construct
attcctgcctcctggtaacgt

SEQ ID NO: 6756 - DNA, 25 bp, Artificial Sequence
  Synthetic Construct
ccagtaaaagcagctctgacttgga

SEQ ID NO: 6757 - DNA, 25 bp, Artificial Sequence
  Synthetic Construct
gccggatacagtgagattcgtaatc

SEQ ID NO: 6758 - DNA, 26 bp, Artificial Sequence
  Synthetic Construct
ctcactgttctctgtcactcactttt

SEQ ID NO: 6759 - DNA, 24 bp, Artificial Sequence
  Synthetic Construct
gcactggaggagtctacataacca

SEQ ID NO: 6760 - DNA, 20 bp, Artificial Sequence
  Synthetic Construct
tccagtggcaatggcagact

SEQ ID NO: 6761 - DNA, 23 bp, Artificial Sequence
  Synthetic Construct
tttctagctggttggttggaact

SEQ ID NO: 6762 - DNA, 24 bp, Artificial Sequence
  Synthetic Construct
tgcatgtcctagaagagggtacag

SEQ ID NO: 6763 - DNA, 26 bp, Artificial Sequence
  Synthetic Construct
cctagtctcctcactgggaaatagga

SEQ ID NO: 6764 - DNA, 22 bp, Artificial Sequence
  Synthetic Construct
actgcccatagctcacaatctc

SEQ ID NO: 6765 - DNA, 30 bp, Artificial Sequence
  Synthetic Construct
ccttgatactgaataagttctgatccactt

SEQ ID NO: 6766 - DNA, 28 bp, Artificial Sequence
  Synthetic Construct
ccaaaatgttacccatagtaaagacgtt

SEQ ID NO: 6767 - DNA, 24 bp, Artificial Sequence
  Synthetic Construct
gtgagtggtccaaagtgacttgat

SEQ ID NO: 6768 - DNA, 21 bp, Artificial Sequence
  Synthetic Construct
aagcaaggctggatcctgtct

SEQ ID NO: 6769 - DNA, 21 bp, Artificial Sequence
  Synthetic Construct
ctcccagggttggcattacag

SEQ ID NO: 6770 - DNA, 20 bp, Artificial Sequence
  Synthetic Construct
tgggtagtggtggtgaggaa

SEQ ID NO: 6771 - DNA, 24 bp, Artificial Sequence
  Synthetic Construct
tgggtagccctagacctttacttc

SEQ ID NO: 6772 - DNA, 24 bp, Artificial Sequence
  Synthetic Construct
aggattgcaatgactcccatatgg

SEQ ID NO: 6773 - DNA, 24 bp, Artificial Sequence
  Synthetic Construct
tggaaacagccagggatggtacat

SEQ ID NO: 6774 - DNA, 19 bp, Artificial Sequence
  Synthetic Construct
tctggcaaggggacagtgt

SEQ ID NO: 6775 - DNA, 22 bp, Artificial Sequence
  Synthetic Construct
tgcctagtgctctgtggtgtct

SEQ ID NO: 6776 - DNA, 24 bp, Artificial Sequence
  Synthetic Construct
agtgctacaagagtcattgttgct

SEQ ID NO: 6777 - DNA, 22 bp, Artificial Sequence
  Synthetic Construct
cttgaaatgaccccccattcct

SEQ ID NO: 6778 - DNA, 18 bp, Artificial Sequence
  Synthetic Construct
ggggttgtggccgtgctt

SEQ ID NO: 6779 - DNA, 25 bp, Artificial Sequence
  Synthetic Construct
cccaaactcctttgcaactaaatgg

SEQ ID NO: 6780 - DNA, 21 bp, Artificial Sequence
  Synthetic Construct
ccatggcaatgacctggaagt

SEQ ID NO: 6781 - DNA, 21 bp, Artificial Sequence
  Synthetic Construct
tggagagcagggggacacaat

SEQ ID NO: 6782 - DNA, 22 bp, Artificial Sequence
  Synthetic Construct
gcaaagggaggcacagttcatt

SEQ ID NO: 6783 - DNA, 26 bp, Artificial Sequence
  Synthetic Construct
gtaccagttttcattaatgggaagca

SEQ ID NO: 6784 - DNA, 25 bp, Artificial Sequence
  Synthetic Construct
gcactgctggattcatcatcaagga

SEQ ID NO: 6785 - DNA, 20 bp, Artificial Sequence
  Synthetic Construct
ggagatgggacctgcttgct

SEQ ID NO: 6786 - DNA, 21 bp, Artificial Sequence
  Synthetic Construct
acacagagagcagaggggttt

SEQ ID NO: 6787 - DNA, 23 bp, Artificial Sequence
  Synthetic Construct
caatagccgccttcttgaaacac

SEQ ID NO: 6788 - DNA, 22 bp, Artificial Sequence
  Synthetic Construct
ttcctatgatgcccccatgtgt

SEQ ID NO: 6789 - DNA, 18 bp, Artificial Sequence
  Synthetic Construct
caactggccagcctgtca

SEQ ID NO: 6790 - DNA, 23 bp, Artificial Sequence
  Synthetic Construct
tggaatttctccctggggtatgc

SEQ ID NO: 6791 - DNA, 18 bp, Artificial Sequence
  Synthetic Construct
gccactgctgctgctaca

SEQ ID NO: 6792 - DNA, 25 bp, Artificial Sequence
  Synthetic Construct
accttttttcctccatgcagctaat

SEQ ID NO: 6793 - DNA, 21 bp, Artificial Sequence
  Synthetic Construct
tctccagtcgaggccaaaact

SEQ ID NO: 6794 - DNA, 24 bp, Artificial Sequence
  Synthetic Construct
gggagctactgttacaggtgttag

SEQ ID NO: 6795 - DNA, 26 bp, Artificial Sequence
  Synthetic Construct
ccacagaaaataccactgctctgaac

SEQ ID NO: 6796 - DNA, 25 bp, Artificial Sequence
  Synthetic Construct
gctggaaaggtaatggtgtcaccta

SEQ ID NO: 6797 - DNA, 25 bp, Artificial Sequence
  Synthetic Construct
cacaaatctccagtatcctgttgct

SEQ ID NO: 6798 - DNA, 25 bp, Artificial Sequence
  Synthetic Construct
gcccaaatgattgacacagctttct

SEQ ID NO: 6799 - DNA, 22 bp, Artificial Sequence
  Synthetic Construct
acccagatcctccttcgagtga

SEQ ID NO: 6800 - DNA, 25 bp, Artificial Sequence
  Synthetic Construct
cagagaacattcactgccttactct

SEQ ID NO: 6801 - DNA, 25 bp, Artificial Sequence
  Synthetic Construct
ccataaccccggttgtaagtaaaca

SEQ ID NO: 6802 - DNA, 21 bp, Artificial Sequence
  Synthetic Construct
atgggtccagtgggtaaaggt

SEQ ID NO: 6803 - DNA, 28 bp, Artificial Sequence
  Synthetic Construct
caagcacaaatcagaaatatgtggtttg

SEQ ID NO: 6804 - DNA, 21 bp, Artificial Sequence
  Synthetic Construct
gtgactgtgggagccttttca

SEQ ID NO: 6805 - DNA, 21 bp, Artificial Sequence
  Synthetic Construct
agggtgaagccagggatcagt

SEQ ID NO: 6806 - DNA, 25 bp, Artificial Sequence
  Synthetic Construct
cgcttcttcccttactgcatttagg

SEQ ID NO: 6807 - DNA, 23 bp, Artificial Sequence
  Synthetic Construct
ggactaaaggggttcctgagaca

SEQ ID NO: 6808 - DNA, 21 bp, Artificial Sequence
  Synthetic Construct
aggtgcctacaggacatttgg

SEQ ID NO: 6809 - DNA, 25 bp, Artificial Sequence
  Synthetic Construct
ccagcagagcataccatacaataga

SEQ ID NO: 6810 - DNA, 22 bp, Artificial Sequence
  Synthetic Construct
tctctctccaccctgtctgttt

SEQ ID NO: 6811 - DNA, 26 bp, Artificial Sequence
  Synthetic Construct
aatccccaaagcctacttagaaactt

SEQ ID NO: 6812 - DNA, 20 bp, Artificial Sequence
  Synthetic Construct
cccccttgtctacccttcca

SEQ ID NO: 6813 - DNA, 25 bp, Artificial Sequence
  Synthetic Construct
gcagagagctctcgggtgtaaatta

SEQ ID NO: 6814 - DNA, 24 bp, Artificial Sequence
  Synthetic Construct
ctttctacccatgactgtgagcat

SEQ ID NO: 6815 - DNA, 22 bp, Artificial Sequence
  Synthetic Construct
tgcagcaggactctcaccttga

SEQ ID NO: 6816 - DNA, 24 bp, Artificial Sequence
  Synthetic Construct
cgttgctacactgacatgcactac

SEQ ID NO: 6817 - DNA, 22 bp, Artificial Sequence
  Synthetic Construct
aagtggcaaatgagcaggaaac

SEQ ID NO: 6818 - DNA, 24 bp, Artificial Sequence
  Synthetic Construct
cagcctggatttctagcagctatc

SEQ ID NO: 6819 - DNA, 23 bp, Artificial Sequence
  Synthetic Construct
ggtggacatttgtgggttttcag

SEQ ID NO: 6820 - DNA, 25 bp, Artificial Sequence
  Synthetic Construct
cccagcctaatacaaagcccatgtt

SEQ ID NO: 6821 - DNA, 20 bp, Artificial Sequence
  Synthetic Construct
gtcagcaccgggaagatgag

SEQ ID NO: 6822 - DNA, 27 bp, Artificial Sequence
  Synthetic Construct
ggttccctgacaatgaaatgagggata

SEQ ID NO: 6823 - DNA, 21 bp, Artificial Sequence
  Synthetic Construct
aactcaggcagtctgggaatg

SEQ ID NO: 6824 - DNA, 22 bp, Artificial Sequence
  Synthetic Construct
ctggaagaatgcacagctttgg

SEQ ID NO: 6825 - DNA, 24 bp, Artificial Sequence
  Synthetic Construct
ggtgggagggtaaatccaaactgt

SEQ ID NO: 6826 - DNA, 24 bp, Artificial Sequence
  Synthetic Construct
ctccagtctcctctgaaacacact

SEQ ID NO: 6827 - DNA, 22 bp, Artificial Sequence
  Synthetic Construct
ctgctactgcaaggggtgataa

SEQ ID NO: 6828 - DNA, 22 bp, Artificial Sequence
  Synthetic Construct
agcagccggtttggattgtact

SEQ ID NO: 6829 - DNA, 22 bp, Artificial Sequence
  Synthetic Construct
aatgaagccagtgttgctacct

SEQ ID NO: 6830 - DNA, 24 bp, Artificial Sequence
  Synthetic Construct
cttcagaaccatttccctctctga

SEQ ID NO: 6831 - DNA, 22 bp, Artificial Sequence
  Synthetic Construct
tcagctatgagtcggcccttct

SEQ ID NO: 6832 - DNA, 23 bp, Artificial Sequence
  Synthetic Construct
gctgagtaggagctttctgtctt

SEQ ID NO: 6833 - DNA, 24 bp, Artificial Sequence
  Synthetic Construct
cactccagaaccctgatgatacag

SEQ ID NO: 6834 - DNA, 23 bp, Artificial Sequence
  Synthetic Construct
accctgactgcatttcccagaag

SEQ ID NO: 6835 - DNA, 26 bp, Artificial Sequence
  Synthetic Construct
actcttaactctgaacgtgatggtaa

SEQ ID NO: 6836 - DNA, 21 bp, Artificial Sequence
  Synthetic Construct
tgctgtcacgccatccttagg

SEQ ID NO: 6837 - DNA, 25 bp, Artificial Sequence
  Synthetic Construct
caggacaggtctagattgcattagg

SEQ ID NO: 6838 - DNA, 22 bp, Artificial Sequence
  Synthetic Construct
acagacatgaccagggacttca

SEQ ID NO: 6839 - DNA, 20 bp, Artificial Sequence
  Synthetic Construct
agccattcagccccttttgt

SEQ ID NO: 6840 - DNA, 22 bp, Artificial Sequence
  Synthetic Construct
tctaggggctcttccaatccat

SEQ ID NO: 6841 - DNA, 21 bp, Artificial Sequence
  Synthetic Construct
gaaatggaggcccagagaaca

SEQ ID NO: 6842 - DNA, 24 bp, Artificial Sequence
  Synthetic Construct
gggaagagagaagcacttggtcaa

SEQ ID NO: 6843 - DNA, 26 bp, Artificial Sequence
  Synthetic Construct
actcactaagttacccctaccaaaga

SEQ ID NO: 6844 - DNA, 26 bp, Artificial Sequence
  Synthetic Construct
gtgtaagagaggatgttggcactatc

SEQ ID NO: 6845 - DNA, 24 bp, Artificial Sequence
  Synthetic Construct
cctcactcctgatctggtgaatgt

SEQ ID NO: 6846 - DNA, 24 bp, Artificial Sequence
  Synthetic Construct
cccccaagttgtagcactctagtt

SEQ ID NO: 6847 - DNA, 22 bp, Artificial Sequence
  Synthetic Construct
gcccaggaaaagaatggcatga

SEQ ID NO: 6848 - DNA, 22 bp, Artificial Sequence
  Synthetic Construct
gggtctgggtggagaaaattca

SEQ ID NO: 6849 - DNA, 22 bp, Artificial Sequence
  Synthetic Construct
acctcccagtagtgcttcagaa

SEQ ID NO: 6850 - DNA, 19 bp, Artificial Sequence
  Synthetic Construct
agcccctgactggtggtta

SEQ ID NO: 6851 - DNA, 21 bp, Artificial Sequence
  Synthetic Construct
ccaacctgctctcctgattcc

SEQ ID NO: 6852 - DNA, 19 bp, Artificial Sequence
  Synthetic Construct
aggctcccgtctctgtcat

SEQ ID NO: 6853 - DNA, 21 bp, Artificial Sequence
  Synthetic Construct
gctggcctgctctcattgact

SEQ ID NO: 6854 - DNA, 24 bp, Artificial Sequence
  Synthetic Construct
agggtctgatttttcccagtatcc

SEQ ID NO: 6855 - DNA, 25 bp, Artificial Sequence
  Synthetic Construct
ctgtaatgggtgtagatgtcagaca

SEQ ID NO: 6856 - DNA, 29 bp, Artificial Sequence
  Synthetic Construct
gcattattttcctagtggcttttgttcct

SEQ ID NO: 6857 - DNA, 22 bp, Artificial Sequence
  Synthetic Construct
gtctttcctagggactgcacaa

SEQ ID NO: 6858 - DNA, 19 bp, Artificial Sequence
  Synthetic Construct
agccctggtggtgcctgta

SEQ ID NO: 6859 - DNA, 27 bp, Artificial Sequence
  Synthetic Construct
tgacctactttacacataacagtccaa

SEQ ID NO: 6860 - DNA, 28 bp, Artificial Sequence
  Synthetic Construct
cactaaaccctccaattagacagacttc

SEQ ID NO: 6861 - DNA, 20 bp, Artificial Sequence
  Synthetic Construct
acagaccacctgctctgagt

SEQ ID NO: 6862 - DNA, 23 bp, Artificial Sequence
  Synthetic Construct
ctccacagactgagagagctagt

SEQ ID NO: 6863 - DNA, 23 bp, Artificial Sequence
  Synthetic Construct
agacgtggtaagtcccaggaagt

SEQ ID NO: 6864 - DNA, 18 bp, Artificial Sequence
  Synthetic Construct
ggggcttcaggggggttt

SEQ ID NO: 6865 - DNA, 22 bp, Artificial Sequence
  Synthetic Construct
acttgggcaaaatgcagtgatc

SEQ ID NO: 6866 - DNA, 27 bp, Artificial Sequence
  Synthetic Construct
ctcattggtcaatctgaaatgggatac

SEQ ID NO: 6867 - DNA, 20 bp, Artificial Sequence
  Synthetic Construct
acacgtgtgtcctgctttgt

SEQ ID NO: 6868 - DNA, 21 bp, Artificial Sequence
  Synthetic Construct
ggcagatcctctccacctaga

SEQ ID NO: 6869 - DNA, 19 bp, Artificial Sequence
  Synthetic Construct
tccctgccaacagcctcat

SEQ ID NO: 6870 - DNA, 24 bp, Artificial Sequence
  Synthetic Construct
actcaaagcatagcctcctcattt

SEQ ID NO: 6871 - DNA, 23 bp, Artificial Sequence
  Synthetic Construct
gaggaaggcaaagttctgttgct

SEQ ID NO: 6872 - DNA, 22 bp, Artificial Sequence
  Synthetic Construct
gctttgtcctccacctcctaag

SEQ ID NO: 6873 - DNA, 24 bp, Artificial Sequence
  Synthetic Construct
cccagatagctctccatcttctga

SEQ ID NO: 6874 - DNA, 21 bp, Artificial Sequence
  Synthetic Construct
agtcgccatcctttcttgctt

SEQ ID NO: 6875 - DNA, 20 bp, Artificial Sequence
  Synthetic Construct
tggctggagtgactgggatt

SEQ ID NO: 6876 - DNA, 22 bp, Artificial Sequence
  Synthetic Construct
agcacatggggatgacatgtct

SEQ ID NO: 6877 - DNA, 24 bp, Artificial Sequence
  Synthetic Construct
tgaatcaaatcttctggcgtagga

SEQ ID NO: 6878 - DNA, 22 bp, Artificial Sequence
  Synthetic Construct
tctttcaccaaggggccaatca

SEQ ID NO: 6879 - DNA, 21 bp, Artificial Sequence
  Synthetic Construct
tgccctgtgcaaaggaaacca

SEQ ID NO: 6880 - DNA, 20 bp, Artificial Sequence
  Synthetic Construct
agggctctgatgcagcaaag

SEQ ID NO: 6881 - DNA, 26 bp, Artificial Sequence
  Synthetic Construct
gccaatcacatgtggggagtattacc

SEQ ID NO: 6882 - DNA, 24 bp, Artificial Sequence
  Synthetic Construct
ccaagttagctctagggcttagga

SEQ ID NO: 6883 - DNA, 22 bp, Artificial Sequence
  Synthetic Construct
caggatgctggcagaaatatgc

SEQ ID NO: 6884 - DNA, 24 bp, Artificial Sequence
  Synthetic Construct
agaagggttcaaggtccataaagg

SEQ ID NO: 6885 - DNA, 19 bp, Artificial Sequence
  Synthetic Construct
gtgcacacccacccataca

SEQ ID NO: 6886 - DNA, 26 bp, Artificial Sequence
  Synthetic Construct
accactgtcctagatcaatgagtttc

SEQ ID NO: 6887 - DNA, 22 bp, Artificial Sequence
  Synthetic Construct
tgtcaaccaaggtgcattctgt

SEQ ID NO: 6888 - DNA, 25 bp, Artificial Sequence
  Synthetic Construct
gcttgtggtttacaacattgtggtt

SEQ ID NO: 6889 - DNA, 26 bp, Artificial Sequence
  Synthetic Construct
gtcaatatgcatgaccaggacctaga

SEQ ID NO: 6890 - DNA, 22 bp, Artificial Sequence
  Synthetic Construct
ctgcaagccaccctctactaag

SEQ ID NO: 6891 - DNA, 21 bp, Artificial Sequence
  Synthetic Construct
ccagccttcccttacctgtct

SEQ ID NO: 6892 - DNA, 24 bp, Artificial Sequence
  Synthetic Construct
caaatacaacccctagagccacat

SEQ ID NO: 6893 - DNA, 24 bp, Artificial Sequence
  Synthetic Construct
gccacgctgagtaattatgccatt

SEQ ID NO: 6894 - DNA, 18 bp, Artificial Sequence
  Synthetic Construct
agcctcgcacgccaacga

SEQ ID NO: 6895 - DNA, 22 bp, Artificial Sequence
  Synthetic Construct
tgagacctggaagacgagaaga

SEQ ID NO: 6896 - DNA, 23 bp, Artificial Sequence
  Synthetic Construct
gcaatttgggaattgggctccat

SEQ ID NO: 6897 - DNA, 27 bp, Artificial Sequence
  Synthetic Construct
acatagtcactcatttgacaagtgttc

SEQ ID NO: 6898 - DNA, 21 bp, Artificial Sequence
  Synthetic Construct
gctgggcaacaggactgtagt

SEQ ID NO: 6899 - DNA, 21 bp, Artificial Sequence
  Synthetic Construct
tgactgctaccaaggctgaga

SEQ ID NO: 6900 - DNA, 24 bp, Artificial Sequence
  Synthetic Construct
tgcaacccttgggtcagaatatcc

SEQ ID NO: 6901 - DNA, 19 bp, Artificial Sequence
  Synthetic Construct
cccctgcttcccactgagt

SEQ ID NO: 6902 - DNA, 24 bp, Artificial Sequence
  Synthetic Construct
gaagttaagagagggggcttcatt

SEQ ID NO: 6903 - DNA, 23 bp, Artificial Sequence
  Synthetic Construct
gatgaaggaagcgatgaggtgtt

SEQ ID NO: 6904 - DNA, 22 bp, Artificial Sequence
  Synthetic Construct
aggacagtggcaagctcagatt

SEQ ID NO: 6905 - DNA, 22 bp, Artificial Sequence
  Synthetic Construct
acggataatggatcgcctgctt

SEQ ID NO: 6906 - DNA, 24 bp, Artificial Sequence
  Synthetic Construct
gggttggttcagcattccattagg

SEQ ID NO: 6907 - DNA, 23 bp, Artificial Sequence
  Synthetic Construct
gccttttgttctgggccaataag

SEQ ID NO: 6908 - DNA, 24 bp, Artificial Sequence
  Synthetic Construct
ggatgtgatagctggatcctgaag

SEQ ID NO: 6909 - DNA, 26 bp, Artificial Sequence
  Synthetic Construct
ctcataaagtaagacacaccgtacca

SEQ ID NO: 6910 - DNA, 20 bp, Artificial Sequence
  Synthetic Construct
accacacttgagcccttgag

SEQ ID NO: 6911 - DNA, 27 bp, Artificial Sequence
  Synthetic Construct
agacctagaagtgatctagtggaatga

SEQ ID NO: 6912 - DNA, 25 bp, Artificial Sequence
  Synthetic Construct
gtgttatgtgtcaagccttctgttc

SEQ ID NO: 6913 - DNA, 23 bp, Artificial Sequence
  Synthetic Construct
ggttgccaaaatgtcagccttaa

SEQ ID NO: 6914 - DNA, 22 bp, Artificial Sequence
  Synthetic Construct
gctgttttgtctgtcgctgaac

SEQ ID NO: 6915 - DNA, 22 bp, Artificial Sequence
  Synthetic Construct
acctctgggaaatgggtcttca

SEQ ID NO: 6916 - DNA, 25 bp, Artificial Sequence
  Synthetic Construct
ctactaagtgctcagaccatttgga

SEQ ID NO: 6917 - DNA, 20 bp, Artificial Sequence
  Synthetic Construct
cctcctccctccggaatcct

SEQ ID NO: 6918 - DNA, 24 bp, Artificial Sequence
  Synthetic Construct
agagaacactctgagagcttgatg

SEQ ID NO: 6919 - DNA, 23 bp, Artificial Sequence
  Synthetic Construct
cagagaacattctgccactctct

SEQ ID NO: 6920 - DNA, 22 bp, Artificial Sequence
  Synthetic Construct
acagtagcctgttcctcttcca

SEQ ID NO: 6921 - DNA, 23 bp, Artificial Sequence
  Synthetic Construct
ggcctgtagttccagcttattgg

SEQ ID NO: 6922 - DNA, 22 bp, Artificial Sequence
  Synthetic Construct
cccctggctgactatttgaact

SEQ ID NO: 6923 - DNA, 24 bp, Artificial Sequence
  Synthetic Construct
gactttatgttgggggaggaagaa

SEQ ID NO: 6924 - DNA, 20 bp, Artificial Sequence
  Synthetic Construct
ttgcccctcctggtgagttt

SEQ ID NO: 6925 - DNA, 26 bp, Artificial Sequence
  Synthetic Construct
agatggaggtctgaaacataaacagt

SEQ ID NO: 6926 - DNA, 25 bp, Artificial Sequence
  Synthetic Construct
gcccatgatttcttccatggggaaa

SEQ ID NO: 6927 - DNA, 22 bp, Artificial Sequence
  Synthetic Construct
tcctgaacacacctggcctgta

SEQ ID NO: 6928 - DNA, 19 bp, Artificial Sequence
  Synthetic Construct
ccagctgccacagaactga

SEQ ID NO: 6929 - DNA, 20 bp, Artificial Sequence
  Synthetic Construct
acgagcctgcctttttcagt

SEQ ID NO: 6930 - DNA, 20 bp, Artificial Sequence
  Synthetic Construct
tgacattgggcaaggcatca

SEQ ID NO: 6931 - DNA, 27 bp, Artificial Sequence
  Synthetic Construct
gctgtataaagttgatctcagcttgtg

SEQ ID NO: 6932 - DNA, 20 bp, Artificial Sequence
  Synthetic Construct
aggtgctgttcctgcttctg

SEQ ID NO: 6933 - DNA, 20 bp, Artificial Sequence
  Synthetic Construct
acctgcccctaaagcctcat

SEQ ID NO: 6934 - DNA, 23 bp, Artificial Sequence
  Synthetic Construct
tgccagaggtggagatacatcca

SEQ ID NO: 6935 - DNA, 25 bp, Artificial Sequence
  Synthetic Construct
caatactgactttctgtcccactgt

SEQ ID NO: 6936 - DNA, 23 bp, Artificial Sequence
  Synthetic Construct
cttcagaggagcaagtcacttgt

SEQ ID NO: 6937 - DNA, 22 bp, Artificial Sequence
  Synthetic Construct
ccacaccaccctgaagtcatct

SEQ ID NO: 6938 - DNA, 22 bp, Artificial Sequence
  Synthetic Construct
cccactctgctccattgacaag

SEQ ID NO: 6939 - DNA, 27 bp, Artificial Sequence
  Synthetic Construct
gctctcactaaagtaccaacaactgat

SEQ ID NO: 6940 - DNA, 26 bp, Artificial Sequence
  Synthetic Construct
agtcaactttacatagctgctagaca

SEQ ID NO: 6941 - DNA, 22 bp, Artificial Sequence
  Synthetic Construct
gcattgacctgatggcagaagt

SEQ ID NO: 6942 - DNA, 24 bp, Artificial Sequence
  Synthetic Construct
tgggggcttgaaagaggtactatc

SEQ ID NO: 6943 - DNA, 27 bp, Artificial Sequence
  Synthetic Construct
ccccttcttagcttgatcatctgcttt

SEQ ID NO: 6944 - DNA, 22 bp, Artificial Sequence
  Synthetic Construct
cctcaggctgtcttgctaggat

SEQ ID NO: 6945 - DNA, 26 bp, Artificial Sequence
  Synthetic Construct
gatagggtttctccaaggattcttga

SEQ ID NO: 6946 - DNA, 22 bp, Artificial Sequence
  Synthetic Construct
tgagaggcattgggagatagca

SEQ ID NO: 6947 - DNA, 25 bp, Artificial Sequence
  Synthetic Construct
caaaagaattcccagcagcaaagaa

SEQ ID NO: 6948 - DNA, 27 bp, Artificial Sequence
  Synthetic Construct
gcgacacaaaatttttcaagtgtgtgt

SEQ ID NO: 6949 - DNA, 28 bp, Artificial Sequence
  Synthetic Construct
gcttgaagtaatgaaatttgtgcttgga

SEQ ID NO: 6950 - DNA, 23 bp, Artificial Sequence
  Synthetic Construct
actcaaccacaactgcctttagt

SEQ ID NO: 6951 - DNA, 20 bp, Artificial Sequence
  Synthetic Construct
ttgccagcccagcatctatg

SEQ ID NO: 6952 - DNA, 24 bp, Artificial Sequence
  Synthetic Construct
ggctggctttgtaatgaccatagt

SEQ ID NO: 6953 - DNA, 25 bp, Artificial Sequence
  Synthetic Construct
aaggcagaggtagagtaaagaactg

SEQ ID NO: 6954 - DNA, 25 bp, Artificial Sequence
  Synthetic Construct
ccactaaactgaggtttggcacaga

SEQ ID NO: 6955 - DNA, 24 bp, Artificial Sequence
  Synthetic Construct
gtgaaatgtagccttttgcccttt

SEQ ID NO: 6956 - DNA, 23 bp, Artificial Sequence
  Synthetic Construct
aatcctacctgcaaaaccaagga

SEQ ID NO: 6957 - DNA, 24 bp, Artificial Sequence
  Synthetic Construct
ccaactaatcagccttttgcacat

SEQ ID NO: 6958 - DNA, 21 bp, Artificial Sequence
  Synthetic Construct
ggtgaggcttagaacgttgga

SEQ ID NO: 6959 - DNA, 22 bp, Artificial Sequence
  Synthetic Construct
catggtcctggtgactctttgg

SEQ ID NO: 6960 - DNA, 23 bp, Artificial Sequence
  Synthetic Construct
aggaatggtgaagtacccaatgg

SEQ ID NO: 6961 - DNA, 25 bp, Artificial Sequence
  Synthetic Construct
ccttcctttcttgggattgcttgtc

SEQ ID NO: 6962 - DNA, 22 bp, Artificial Sequence
  Synthetic Construct
agagtccatccaggcagagaga

SEQ ID NO: 6963 - DNA, 24 bp, Artificial Sequence
  Synthetic Construct
ctcagtgcaagacaactctaaagc

SEQ ID NO: 6964 - DNA, 26 bp, Artificial Sequence
  Synthetic Construct
ccctggatctatttcccacaaaactc

SEQ ID NO: 6965 - DNA, 21 bp, Artificial Sequence
  Synthetic Construct
tgcctcgcccaacaattccaa

SEQ ID NO: 6966 - DNA, 26 bp, Artificial Sequence
  Synthetic Construct
ccgtgtttaggtattcttccttccat

SEQ ID NO: 6967 - DNA, 22 bp, Artificial Sequence
  Synthetic Construct
aagcaaacctggaggaccatac

SEQ ID NO: 6968 - DNA, 22 bp, Artificial Sequence
  Synthetic Construct
ctgctgctgggaattctacaca

SEQ ID NO: 6969 - DNA, 18 bp, Artificial Sequence
  Synthetic Construct
tcctgggcgctctgtgat

SEQ ID NO: 6970 - DNA, 25 bp, Artificial Sequence
  Synthetic Construct
cttttgatctaaactcggcccatac

SEQ ID NO: 6971 - DNA, 29 bp, Artificial Sequence
  Synthetic Construct
cctctgcactaaatcaaatgtgtcttgtc

SEQ ID NO: 6972 - DNA, 23 bp, Artificial Sequence
  Synthetic Construct
agccaggactgtagaaccaggat

SEQ ID NO: 6973 - DNA, 21 bp, Artificial Sequence
  Synthetic Construct
tgctcttctttctgccccaaa

SEQ ID NO: 6974 - DNA, 21 bp, Artificial Sequence
  Synthetic Construct
tgcaggtgccttggatgtctt

SEQ ID NO: 6975 - DNA, 18 bp, Artificial Sequence
  Synthetic Construct
tgccaccctcccaatggt

SEQ ID NO: 6976 - DNA, 23 bp, Artificial Sequence
  Synthetic Construct
agcatctctctcaaggacctgaa

SEQ ID NO: 6977 - DNA, 22 bp, Artificial Sequence
  Synthetic Construct
ggtgtggctgcaactatagaca

SEQ ID NO: 6978 - DNA, 22 bp, Artificial Sequence
  Synthetic Construct
cagaacaaccgacctccatctt

SEQ ID NO: 6979 - DNA, 20 bp, Artificial Sequence
  Synthetic Construct
agccagccaggtgagacaga

SEQ ID NO: 6980 - DNA, 22 bp, Artificial Sequence
  Synthetic Construct
gccagagcttggggtaatcact

SEQ ID NO: 6981 - DNA, 19 bp, Artificial Sequence
  Synthetic Construct
agccagctgcagttccaaa

SEQ ID NO: 6982 - DNA, 23 bp, Artificial Sequence
  Synthetic Construct
ggagacccaaactgttgcaattc

SEQ ID NO: 6983 - DNA, 21 bp, Artificial Sequence
  Synthetic Construct
acagccagtcgaatggaagca

SEQ ID NO: 6984 - DNA, 24 bp, Artificial Sequence
  Synthetic Construct
tgggctttagggactctactctct

SEQ ID NO: 6985 - DNA, 25 bp, Artificial Sequence
  Synthetic Construct
tcctaccccataggatcaagatggt

SEQ ID NO: 6986 - DNA, 23 bp, Artificial Sequence
  Synthetic Construct
ctcactgaacaatgggggagaaa

SEQ ID NO: 6987 - DNA, 22 bp, Artificial Sequence
  Synthetic Construct
tctggagttcagcctagacagt

SEQ ID NO: 6988 - DNA, 22 bp, Artificial Sequence
  Synthetic Construct
tctaacaccggcaggtcactct

SEQ ID NO: 6989 - DNA, 20 bp, Artificial Sequence
  Synthetic Construct
agtggggctgtcaggaaaac

SEQ ID NO: 6990 - DNA, 19 bp, Artificial Sequence
  Synthetic Construct
gccccaggtgtcagaagca

SEQ ID NO: 6991 - DNA, 23 bp, Artificial Sequence
  Synthetic Construct
tctgcagaatatgggcactaagg

SEQ ID NO: 6992 - DNA, 22 bp, Artificial Sequence
  Synthetic Construct
accttgcccaaagccatacatc

SEQ ID NO: 6993 - DNA, 21 bp, Artificial Sequence
  Synthetic Construct
aagcccagaaagccttcttgt

SEQ ID NO: 6994 - DNA, 26 bp, Artificial Sequence
  Synthetic Construct
gacctcaaatagtcttggtcattgtg

SEQ ID NO: 6995 - DNA, 21 bp, Artificial Sequence
  Synthetic Construct
cccctgggagaggtcttgaac

SEQ ID NO: 6996 - DNA, 23 bp, Artificial Sequence
  Synthetic Construct
ctgtcctcactacaacccagttt

SEQ ID NO: 6997 - DNA, 26 bp, Artificial Sequence
  Synthetic Construct
gcctttgcctttgaactgtagccata

SEQ ID NO: 6998 - DNA, 21 bp, Artificial Sequence
  Synthetic Construct
gcctgagaaactcgtgatgca

SEQ ID NO: 6999 - DNA, 25 bp, Artificial Sequence
  Synthetic Construct
ccaagtatgccatagtctgttttgg

SEQ ID NO: 7000 - DNA, 23 bp, Artificial Sequence
  Synthetic Construct
caagggctgcaaaagtaactgtt

SEQ ID NO: 7001 - DNA, 21 bp, Artificial Sequence
  Synthetic Construct
aggcagatgctcagaggcatt

SEQ ID NO: 7002 - DNA, 25 bp, Artificial Sequence
  Synthetic Construct
ctgaatgaaacccaactctgacaca

SEQ ID NO: 7003 - DNA, 25 bp, Artificial Sequence
  Synthetic Construct
gaccacaaagtgctgtgtgttattc

SEQ ID NO: 7004 - DNA, 22 bp, Artificial Sequence
  Synthetic Construct
ttcctgcctttcctccagttgt

SEQ ID NO: 7005 - DNA, 23 bp, Artificial Sequence
  Synthetic Construct
gcaatgaagagactcccgtatga

SEQ ID NO: 7006 - DNA, 26 bp, Artificial Sequence
  Synthetic Construct
gaagtcactgtagctagaaagtgtga

SEQ ID NO: 7007 - DNA, 20 bp, Artificial Sequence
  Synthetic Construct
tgccctccctcctgagacaa

SEQ ID NO: 7008 - DNA, 26 bp, Artificial Sequence
  Synthetic Construct
cattaaaacagttggcttccctgtat

SEQ ID NO: 7009 - DNA, 22 bp, Artificial Sequence
  Synthetic Construct
acttcacaccgctctgcactaa

SEQ ID NO: 7010 - DNA, 22 bp, Artificial Sequence
  Synthetic Construct
tgagagagtggagggagtttgg

SEQ ID NO: 7011 - DNA, 28 bp, Artificial Sequence
  Synthetic Construct
ggtttgtaaatttctgaaggcagtggtt

SEQ ID NO: 7012 - DNA, 22 bp, Artificial Sequence
  Synthetic Construct
agattcctcccttgccatcact

SEQ ID NO: 7013 - DNA, 20 bp, Artificial Sequence
  Synthetic Construct
ggagcaactgatggcagcaa

SEQ ID NO: 7014 - DNA, 21 bp, Artificial Sequence
  Synthetic Construct
agtgctctgtgcccacaacta

SEQ ID NO: 7015 - DNA, 22 bp, Artificial Sequence
  Synthetic Construct
tgccaagtagggaggtgtgaga

SEQ ID NO: 7016 - DNA, 22 bp, Artificial Sequence
  Synthetic Construct
catcctgcctgcgtaactactt

SEQ ID NO: 7017 - DNA, 23 bp, Artificial Sequence
  Synthetic Construct
ctcaactcctcgtggcagtgact

SEQ ID NO: 7018 - DNA, 25 bp, Artificial Sequence
  Synthetic Construct
cccaggaattcatcacaaaactgtt

SEQ ID NO: 7019 - DNA, 18 bp, Artificial Sequence
  Synthetic Construct
tgcttccttgcgcacaca

SEQ ID NO: 7020 - DNA, 24 bp, Artificial Sequence
  Synthetic Construct
ctgtctcttggctgttcgtttcct

SEQ ID NO: 7021 - DNA, 25 bp, Artificial Sequence
  Synthetic Construct
cacggaaaagcaaaagctgataacg

SEQ ID NO: 7022 - DNA, 27 bp, Artificial Sequence
  Synthetic Construct
aaagcaaaactactcctccatttacac

SEQ ID NO: 7023 - DNA, 20 bp, Artificial Sequence
  Synthetic Construct
ttgccttcctcagcccttct

SEQ ID NO: 7024 - DNA, 25 bp, Artificial Sequence
  Synthetic Construct
ggtcctcttagaagtcacctttctg

SEQ ID NO: 7025 - DNA, 21 bp, Artificial Sequence
  Synthetic Construct
actgcagcatggctttccatt

SEQ ID NO: 7026 - DNA, 24 bp, Artificial Sequence
  Synthetic Construct
tgggaacactctggcatacattgc

SEQ ID NO: 7027 - DNA, 23 bp, Artificial Sequence
  Synthetic Construct
tttgaacagggcatagtgcagat

SEQ ID NO: 7028 - DNA, 25 bp, Artificial Sequence
  Synthetic Construct
gctacaagctctactccactcagat

SEQ ID NO: 7029 - DNA, 20 bp, Artificial Sequence
  Synthetic Construct
tgttaccccctggacattgc

SEQ ID NO: 7030 - DNA, 19 bp, Artificial Sequence
  Synthetic Construct
cccagcctccttccacact

SEQ ID NO: 7031 - DNA, 23 bp, Artificial Sequence
  Synthetic Construct
cataccctcttgtcccagcatac

SEQ ID NO: 7032 - DNA, 24 bp, Artificial Sequence
  Synthetic Construct
acctacaggttcttcccctacatg

SEQ ID NO: 7033 - DNA, 22 bp, Artificial Sequence
  Synthetic Construct
agctgggtgggaacttattctg

SEQ ID NO: 7034 - DNA, 21 bp, Artificial Sequence
  Synthetic Construct
cattgccctgcttgcaagtag

SEQ ID NO: 7035 - DNA, 26 bp, Artificial Sequence
  Synthetic Construct
aaggcttcaaagaagaactagaacct

SEQ ID NO: 7036 - DNA, 22 bp, Artificial Sequence
  Synthetic Construct
gcggtagggctgagaaaatcca

SEQ ID NO: 7037 - DNA, 24 bp, Artificial Sequence
  Synthetic Construct
acattacggcatcatagctttcct

SEQ ID NO: 7038 - DNA, 25 bp, Artificial Sequence
  Synthetic Construct
gcatacctcattcccctttttgaag

SEQ ID NO: 7039 - DNA, 22 bp, Artificial Sequence
  Synthetic Construct
atgtctggtctccctcctttct

SEQ ID NO: 7040 - DNA, 20 bp, Artificial Sequence
  Synthetic Construct
tctcctccagccacactgaa

SEQ ID NO: 7041 - DNA, 25 bp, Artificial Sequence
  Synthetic Construct
gagtctcgatccacaaaagctatcc

SEQ ID NO: 7042 - DNA, 27 bp, Artificial Sequence
  Synthetic Construct
ccataataggttttttggtgcctacag

SEQ ID NO: 7043 - DNA, 23 bp, Artificial Sequence
  Synthetic Construct
cgtaggtgacacacattcatcca

SEQ ID NO: 7044 - DNA, 25 bp, Artificial Sequence
  Synthetic Construct
gcacgcctcacactttactaatagg

SEQ ID NO: 7045 - DNA, 25 bp, Artificial Sequence
  Synthetic Construct
agggaagctgtgtcttagacttact

SEQ ID NO: 7046 - DNA, 23 bp, Artificial Sequence
  Synthetic Construct
tcctgatgacctgctgattgaag

SEQ ID NO: 7047 - DNA, 20 bp, Artificial Sequence
  Synthetic Construct
agtggttggcagcaggtaac

SEQ ID NO: 7048 - DNA, 26 bp, Artificial Sequence
  Synthetic Construct
actaccccaggaagattagaatgtgt

SEQ ID NO: 7049 - DNA, 22 bp, Artificial Sequence
  Synthetic Construct
agaaagcggcaatgctgagatg

SEQ ID NO: 7050 - DNA, 21 bp, Artificial Sequence
  Synthetic Construct
gctgcccgagaaaacttagct

SEQ ID NO: 7051 - DNA, 28 bp, Artificial Sequence
  Synthetic Construct
aacacaattctgaaatccatctatgcat

SEQ ID NO: 7052 - DNA, 26 bp, Artificial Sequence
  Synthetic Construct
tcaataaagtccccccttacctaact

SEQ ID NO: 7053 - DNA, 22 bp, Artificial Sequence
  Synthetic Construct
tccctgaacaggctgtgcataa

SEQ ID NO: 7054 - DNA, 22 bp, Artificial Sequence
  Synthetic Construct
gccttccatcactctaccacaa

SEQ ID NO: 7055 - DNA, 25 bp, Artificial Sequence
  Synthetic Construct
aagtcaaggcaattgatgaaacaca

SEQ ID NO: 7056 - DNA, 22 bp, Artificial Sequence
  Synthetic Construct
tgcaacatgcacactcttttgc

SEQ ID NO: 7057 - DNA, 22 bp, Artificial Sequence
  Synthetic Construct
gtaatgagggcctgctttagct

SEQ ID NO: 7058 - DNA, 24 bp, Artificial Sequence
  Synthetic Construct
tggatacaaaactcttggctggaa

SEQ ID NO: 7059 - DNA, 24 bp, Artificial Sequence
  Synthetic Construct
gaagcttaagtgccatccttgtct

SEQ ID NO: 7060 - DNA, 22 bp, Artificial Sequence
  Synthetic Construct
ggggcagaagatggaagacttc

SEQ ID NO: 7061 - DNA, 21 bp, Artificial Sequence
  Synthetic Construct
agcccagtgaagcaggaaatg

SEQ ID NO: 7062 - DNA, 27 bp, Artificial Sequence
  Synthetic Construct
gagtttgacaaataattggaggagctt

SEQ ID NO: 7063 - DNA, 27 bp, Artificial Sequence
  Synthetic Construct
aggcaaaggtttgtaggtatgtagatc

SEQ ID NO: 7064 - DNA, 24 bp, Artificial Sequence
  Synthetic Construct
ggactaaactccacgaagaacaca

SEQ ID NO: 7065 - DNA, 19 bp, Artificial Sequence
  Synthetic Construct
acgggactcccagcacaaa

SEQ ID NO: 7066 - DNA, 24 bp, Artificial Sequence
  Synthetic Construct
ccctagacatccacatgtgtgctt

SEQ ID NO: 7067 - DNA, 25 bp, Artificial Sequence
  Synthetic Construct
gtcccaattctgcaactaactctgt

SEQ ID NO: 7068 - DNA, 24 bp, Artificial Sequence
  Synthetic Construct
cctgtgcaaaactttggtctttgc

SEQ ID NO: 7069 - DNA, 26 bp, Artificial Sequence
  Synthetic Construct
gagactgtctccttcatacacattcc

SEQ ID NO: 7070 - DNA, 22 bp, Artificial Sequence
  Synthetic Construct
tgggcaggagttcctaatgaca

SEQ ID NO: 7071 - DNA, 20 bp, Artificial Sequence
  Synthetic Construct
caggggtcgagtggagatga

SEQ ID NO: 7072 - DNA, 26 bp, Artificial Sequence
  Synthetic Construct
gcatgaatcacgcttgttgtactaac

SEQ ID NO: 7073 - DNA, 25 bp, Artificial Sequence
  Synthetic Construct
ccttgatgtaaccaagtcctgagtt

SEQ ID NO: 7074 - DNA, 18 bp, Artificial Sequence
  Synthetic Construct
agtgccctggtgctagca

SEQ ID NO: 7075 - DNA, 25 bp, Artificial Sequence
  Synthetic Construct
cactgattgagttggactctttgga

SEQ ID NO: 7076 - DNA, 26 bp, Artificial Sequence
  Synthetic Construct
cacctgacaaggaatcgaagatgttc

SEQ ID NO: 7077 - DNA, 21 bp, Artificial Sequence
  Synthetic Construct
tgcccatagaccatgcaagtg

SEQ ID NO: 7078 - DNA, 21 bp, Artificial Sequence
  Synthetic Construct
tggagcttccacgtgatcctt

SEQ ID NO: 7079 - DNA, 23 bp, Artificial Sequence
  Synthetic Construct
tgctgaggacactgaaatatgca

SEQ ID NO: 7080 - DNA, 22 bp, Artificial Sequence
  Synthetic Construct
ggcctcagcgataaacacagaa

SEQ ID NO: 7081 - DNA, 19 bp, Artificial Sequence
  Synthetic Construct
gctgctggctgtgaatgca

SEQ ID NO: 7082 - DNA, 22 bp, Artificial Sequence
  Synthetic Construct
agccccagctgtctaaaatgtc

SEQ ID NO: 7083 - DNA, 20 bp, Artificial Sequence
  Synthetic Construct
aaagcacgagggggaaaggt

SEQ ID NO: 7084 - DNA, 20 bp, Artificial Sequence
  Synthetic Construct
ccagctgcaggtgacatagg

SEQ ID NO: 7085 - DNA, 28 bp, Artificial Sequence
  Synthetic Construct
gccattgtaagaactttggcttttactc

SEQ ID NO: 7086 - DNA, 22 bp, Artificial Sequence
  Synthetic Construct
aggtgtgactacgagaccaaga

SEQ ID NO: 7087 - DNA, 26 bp, Artificial Sequence
  Synthetic Construct
caagttggaccctatcataggaagga

SEQ ID NO: 7088 - DNA, 24 bp, Artificial Sequence
  Synthetic Construct
gggagtctgacacatggaacttct

SEQ ID NO: 7089 - DNA, 23 bp, Artificial Sequence
  Synthetic Construct
gtatgtgccttgggagctttagt

SEQ ID NO: 7090 - DNA, 25 bp, Artificial Sequence
  Synthetic Construct
ggacatgctcggtataccaatctag

SEQ ID NO: 7091 - DNA, 25 bp, Artificial Sequence
  Synthetic Construct
ctgctgttcaccaaattagccatga

SEQ ID NO: 7092 - DNA, 24 bp, Artificial Sequence
  Synthetic Construct
gtgtggtgcttctttgtgtaatgg

SEQ ID NO: 7093 - DNA, 20 bp, Artificial Sequence
  Synthetic Construct
agccactctgacctctgtga

SEQ ID NO: 7094 - DNA, 23 bp, Artificial Sequence
  Synthetic Construct
ggggggatgaaaacaaatttgct

SEQ ID NO: 7095 - DNA, 20 bp, Artificial Sequence
  Synthetic Construct
ccaaggtgggtgtgcatctt

SEQ ID NO: 7096 - DNA, 23 bp, Artificial Sequence
  Synthetic Construct
acggggaatgagctttacaatct

SEQ ID NO: 7097 - DNA, 23 bp, Artificial Sequence
  Synthetic Construct
actgcctcccgattcactattct

SEQ ID NO: 7098 - DNA, 25 bp, Artificial Sequence
  Synthetic Construct
gcaatatagaagggtgcaagtggaa

SEQ ID NO: 7099 - DNA, 22 bp, Artificial Sequence
  Synthetic Construct
ggccccattttatctcctgtgt

SEQ ID NO: 7100 - DNA, 26 bp, Artificial Sequence
  Synthetic Construct
ctctcaaagagattccaagtgagctt

SEQ ID NO: 7101 - DNA, 27 bp, Artificial Sequence
  Synthetic Construct
ccatctgtattggaaagtgtggttcac

SEQ ID NO: 7102 - DNA, 24 bp, Artificial Sequence
  Synthetic Construct
cgcagtttccacagcaatcctttg

SEQ ID NO: 7103 - DNA, 20 bp, Artificial Sequence
  Synthetic Construct
tgatccagggcgctgtcaca

SEQ ID NO: 7104 - DNA, 22 bp, Artificial Sequence
  Synthetic Construct
gggatcagtgctgtgatgtgta

SEQ ID NO: 7105 - DNA, 22 bp, Artificial Sequence
  Synthetic Construct
gcaaactccctctgtgttccaa

SEQ ID NO: 7106 - DNA, 25 bp, Artificial Sequence
  Synthetic Construct
gaatcaatttcatcaaggcctggaa

SEQ ID NO: 7107 - DNA, 24 bp, Artificial Sequence
  Synthetic Construct
caccttttccaagaagtgttgctt

SEQ ID NO: 7108 - DNA, 25 bp, Artificial Sequence
  Synthetic Construct
tgactgcttgttaccacaatatgca

SEQ ID NO: 7109 - DNA, 23 bp, Artificial Sequence
  Synthetic Construct
ggtgttggcacatactgtactca

SEQ ID NO: 7110 - DNA, 25 bp, Artificial Sequence
  Synthetic Construct
gagtctaatttagcgtggggtaact

SEQ ID NO: 7111 - DNA, 24 bp, Artificial Sequence
  Synthetic Construct
ctcattaggcagtcctcccataca

SEQ ID NO: 7112 - DNA, 22 bp, Artificial Sequence
  Synthetic Construct
aaagggggcctctgctctaata

SEQ ID NO: 7113 - DNA, 22 bp, Artificial Sequence
  Synthetic Construct
acaacctggcaaagaaggcatt

SEQ ID NO: 7114 - DNA, 22 bp, Artificial Sequence
  Synthetic Construct
gaggctggaggaaaatgtgagt

SEQ ID NO: 7115 - DNA, 24 bp, Artificial Sequence
  Synthetic Construct
aattgctagccacagtttgcttac

SEQ ID NO: 7116 - DNA, 24 bp, Artificial Sequence
  Synthetic Construct
agactagcctcattcctcccagat

SEQ ID NO: 7117 - DNA, 26 bp, Artificial Sequence
  Synthetic Construct
ggtgaagaagacttaggagtgacatg

SEQ ID NO: 7118 - DNA, 24 bp, Artificial Sequence
  Synthetic Construct
agctcacattctggcaatacatgt

SEQ ID NO: 7119 - DNA, 20 bp, Artificial Sequence
  Synthetic Construct
attgctgctcctggggacaa

SEQ ID NO: 7120 - DNA, 26 bp, Artificial Sequence
  Synthetic Construct
tttattgcccccttcactaaaacatg

SEQ ID NO: 7121 - DNA, 22 bp, Artificial Sequence
  Synthetic Construct
tgctccttcgaggggtctagag

SEQ ID NO: 7122 - DNA, 24 bp, Artificial Sequence
  Synthetic Construct
ctccagggagtgtgaatctgattc

SEQ ID NO: 7123 - DNA, 25 bp, Artificial Sequence
  Synthetic Construct
gctgtagcaagagccactaatatcc

SEQ ID NO: 7124 - DNA, 21 bp, Artificial Sequence
  Synthetic Construct
agggagaaggcactctgagtt

SEQ ID NO: 7125 - DNA, 22 bp, Artificial Sequence
  Synthetic Construct
aggtcctgttttgggagtgcaa

SEQ ID NO: 7126 - DNA, 27 bp, Artificial Sequence
  Synthetic Construct
tgaagtcctaaaattggttttcatgca

SEQ ID NO: 7127 - DNA, 24 bp, Artificial Sequence
  Synthetic Construct
cttcacagtggacccattcattca

SEQ ID NO: 7128 - DNA, 20 bp, Artificial Sequence
  Synthetic Construct
attcagggccaagggctgaa

SEQ ID NO: 7129 - DNA, 23 bp, Artificial Sequence
  Synthetic Construct
gctgtagtgagctgcatgattgt

SEQ ID NO: 7130 - DNA, 24 bp, Artificial Sequence
  Synthetic Construct
tgggggaaattgtcaaacttgtct

SEQ ID NO: 7131 - DNA, 19 bp, Artificial Sequence
  Synthetic Construct
gctgacatgcaggcccaat

SEQ ID NO: 7132 - DNA, 23 bp, Artificial Sequence
  Synthetic Construct
agaaacagaagccagggatcaag

SEQ ID NO: 7133 - DNA, 20 bp, Artificial Sequence
  Synthetic Construct
accaggcagttctccttgtg

SEQ ID NO: 7134 - DNA, 26 bp, Artificial Sequence
  Synthetic Construct
ccaaactcggttatatctcacaaacc

SEQ ID NO: 7135 - DNA, 28 bp, Artificial Sequence
  Synthetic Construct
cctttccaagatcttagcatctctcctt

SEQ ID NO: 7136 - DNA, 22 bp, Artificial Sequence
  Synthetic Construct
tccccagcattgtcgtatcaca

SEQ ID NO: 7137 - DNA, 24 bp, Artificial Sequence
  Synthetic Construct
gctacgataaccaaggcagtctga

SEQ ID NO: 7138 - DNA, 23 bp, Artificial Sequence
  Synthetic Construct
tgggggagagaaggataggagat

SEQ ID NO: 7139 - DNA, 23 bp, Artificial Sequence
  Synthetic Construct
ccagatggaaggaggctaaagga

SEQ ID NO: 7140 - DNA, 24 bp, Artificial Sequence
  Synthetic Construct
ccccgtgtaaacagtccattccaa

SEQ ID NO: 7141 - DNA, 22 bp, Artificial Sequence
  Synthetic Construct
ttgagaaacgtctgtggacaca

SEQ ID NO: 7142 - DNA, 28 bp, Artificial Sequence
  Synthetic Construct
ggacatttgggtttaaccagcctaattc

SEQ ID NO: 7143 - DNA, 21 bp, Artificial Sequence
  Synthetic Construct
tgtacccaggctcccatctca

SEQ ID NO: 7144 - DNA, 25 bp, Artificial Sequence
  Synthetic Construct
cctatgtactgttccttggatccaa

SEQ ID NO: 7145 - DNA, 22 bp, Artificial Sequence
  Synthetic Construct
agcctgcttgagactggatgga

SEQ ID NO: 7146 - DNA, 21 bp, Artificial Sequence
  Synthetic Construct
gggccaggcttttgggaaata

SEQ ID NO: 7147 - DNA, 22 bp, Artificial Sequence
  Synthetic Construct
ccctgtctcttggttgttcctt

SEQ ID NO: 7148 - DNA, 27 bp, Artificial Sequence
  Synthetic Construct
cccctgcttaactaactttgagtcaac

SEQ ID NO: 7149 - DNA, 26 bp, Artificial Sequence
  Synthetic Construct
tgactgtagtgaatggaatgagcatt

SEQ ID NO: 7150 - DNA, 19 bp, Artificial Sequence
  Synthetic Construct
aggggcgtctacgatcact

SEQ ID NO: 7151 - DNA, 18 bp, Artificial Sequence
  Synthetic Construct
gtgcacagccgggatgga

SEQ ID NO: 7152 - DNA, 25 bp, Artificial Sequence
  Synthetic Construct
cagagctctgattggccaagattgg

SEQ ID NO: 7153 - DNA, 22 bp, Artificial Sequence
  Synthetic Construct
catgcccagccactggttatta

SEQ ID NO: 7154 - DNA, 22 bp, Artificial Sequence
  Synthetic Construct
caagactccttcagcagtgaca

SEQ ID NO: 7155 - DNA, 27 bp, Artificial Sequence
  Synthetic Construct
gactcacctccttaagctaatcttacc

SEQ ID NO: 7156 - DNA, 20 bp, Artificial Sequence
  Synthetic Construct
tgccctggcactctctgctt

SEQ ID NO: 7157 - DNA, 24 bp, Artificial Sequence
  Synthetic Construct
tgagaagtagacccagcctgtaac

SEQ ID NO: 7158 - DNA, 24 bp, Artificial Sequence
  Synthetic Construct
cagtgggcaatagattcagcagat

SEQ ID NO: 7159 - DNA, 22 bp, Artificial Sequence
  Synthetic Construct
gtcaccacccattggattgttg

SEQ ID NO: 7160 - DNA, 26 bp, Artificial Sequence
  Synthetic Construct
ctgtaacatgctcttgggatgaagag

SEQ ID NO: 7161 - DNA, 25 bp, Artificial Sequence
  Synthetic Construct
ggtttggctacataacttgctttgg

SEQ ID NO: 7162 - DNA, 23 bp, Artificial Sequence
  Synthetic Construct
agcaagtctcatttcccctttgg

SEQ ID NO: 7163 - DNA, 23 bp, Artificial Sequence
  Synthetic Construct
tcactggacacctgttcatttgg

SEQ ID NO: 7164 - DNA, 24 bp, Artificial Sequence
  Synthetic Construct
aagttttggcagtcaccactttac

SEQ ID NO: 7165 - DNA, 23 bp, Artificial Sequence
  Synthetic Construct
gagactcctgggtcagagatgaa

SEQ ID NO: 7166 - DNA, 22 bp, Artificial Sequence
  Synthetic Construct
ctgaattcacgagcctgtgtca

SEQ ID NO: 7167 - DNA, 24 bp, Artificial Sequence
  Synthetic Construct
atgctacggagggaggtgtataca

SEQ ID NO: 7168 - DNA, 20 bp, Artificial Sequence
  Synthetic Construct
acccatggggcacacattca

SEQ ID NO: 7169 - DNA, 26 bp, Artificial Sequence
  Synthetic Construct
gtgacaatagagaaagcaccatcatc

SEQ ID NO: 7170 - DNA, 24 bp, Artificial Sequence
  Synthetic Construct
cctgaggctgtttcttccagacaa

SEQ ID NO: 7171 - DNA, 25 bp, Artificial Sequence
  Synthetic Construct
ggcttgcttcaataggtgagctact

SEQ ID NO: 7172 - DNA, 29 bp, Artificial Sequence
  Synthetic Construct
gcaaaaccacaatgacaaaaatcaggtat

SEQ ID NO: 7173 - DNA, 22 bp, Artificial Sequence
  Synthetic Construct
gcaagggggagctgtaattgtt

SEQ ID NO: 7174 - DNA, 25 bp, Artificial Sequence
  Synthetic Construct
gttcaaattcaacccccatctgaga

SEQ ID NO: 7175 - DNA, 30 bp, Artificial Sequence
  Synthetic Construct
ggggccaatatttaccagaattatgatggt

SEQ ID NO: 7176 - DNA, 22 bp, Artificial Sequence
  Synthetic Construct
gaggtgaggcagtgaaaccaat

SEQ ID NO: 7177 - DNA, 23 bp, Artificial Sequence
  Synthetic Construct
tcagtctggaacactccttgact

SEQ ID NO: 7178 - DNA, 20 bp, Artificial Sequence
  Synthetic Construct
ggtctggggctagcaattgc

SEQ ID NO: 7179 - DNA, 23 bp, Artificial Sequence
  Synthetic Construct
accctctatcctgggctgaatcc

SEQ ID NO: 7180 - DNA, 27 bp, Artificial Sequence
  Synthetic Construct
aattgagatcagtgttctcttcattcg

SEQ ID NO: 7181 - DNA, 20 bp, Artificial Sequence
  Synthetic Construct
ggagcgtccaggtcacagat

SEQ ID NO: 7182 - DNA, 22 bp, Artificial Sequence
  Synthetic Construct
agggtgacatgtcccaattgca

SEQ ID NO: 7183 - DNA, 25 bp, Artificial Sequence
  Synthetic Construct
gaataccaaccagacaacagacaca

SEQ ID NO: 7184 - DNA, 22 bp, Artificial Sequence
  Synthetic Construct
gaacatgcagcagtttggtgat

SEQ ID NO: 7185 - DNA, 28 bp, Artificial Sequence
  Synthetic Construct
ggtcattttttttccagtggaggatgtg

SEQ ID NO: 7186 - DNA, 24 bp, Artificial Sequence
  Synthetic Construct
ggtgcaccagtacttgatcatagg

SEQ ID NO: 7187 - DNA, 26 bp, Artificial Sequence
  Synthetic Construct
caaggccaatgtctagttaagaagca

SEQ ID NO: 7188 - DNA, 24 bp, Artificial Sequence
  Synthetic Construct
cagcctcattcaccctcatactct

SEQ ID NO: 7189 - DNA, 25 bp, Artificial Sequence
  Synthetic Construct
gtcgtttgcttgctgttttaactgt

SEQ ID NO: 7190 - DNA, 28 bp, Artificial Sequence
  Synthetic Construct
ggctaagctaacgatattccatctctca

SEQ ID NO: 7191 - DNA, 26 bp, Artificial Sequence
  Synthetic Construct
gctatcgatgttgtgaaaggttctgt

SEQ ID NO: 7192 - DNA, 24 bp, Artificial Sequence
  Synthetic Construct
gagggagacttggtaaacaatcca

SEQ ID NO: 7193 - DNA, 26 bp, Artificial Sequence
  Synthetic Construct
gagtctgggaaatgcacaattatggt

SEQ ID NO: 7194 - DNA, 22 bp, Artificial Sequence
  Synthetic Construct
aggctcaggtctcaaccacagt

SEQ ID NO: 7195 - DNA, 26 bp, Artificial Sequence
  Synthetic Construct
ccacatggcacttgatttttgacagt

SEQ ID NO: 7196 - DNA, 20 bp, Artificial Sequence
  Synthetic Construct
gcttcatgctgcacttgctt

SEQ ID NO: 7197 - DNA, 25 bp, Artificial Sequence
  Synthetic Construct
tggttcaacactatagcagaactgt

SEQ ID NO: 7198 - DNA, 23 bp, Artificial Sequence
  Synthetic Construct
gctcaataaccaagcagcacaga

SEQ ID NO: 7199 - DNA, 23 bp, Artificial Sequence
  Synthetic Construct
cattggcaaattggctcactttg

SEQ ID NO: 7200 - DNA, 22 bp, Artificial Sequence
  Synthetic Construct
ggaaggactcccagggaaaaca

SEQ ID NO: 7201 - DNA, 19 bp, Artificial Sequence
  Synthetic Construct
agacgtgtgagggctgtgt

SEQ ID NO: 7202 - DNA, 23 bp, Artificial Sequence
  Synthetic Construct
tcttgttgctcttgaaggcattg

SEQ ID NO: 7203 - DNA, 23 bp, Artificial Sequence
  Synthetic Construct
cagagaggcctgaattcaaacct

SEQ ID NO: 7204 - DNA, 19 bp, Artificial Sequence
  Synthetic Construct
ggcctcactgctggtttca

SEQ ID NO: 7205 - DNA, 21 bp, Artificial Sequence
  Synthetic Construct
tcagtccacagcactcaccat

SEQ ID NO: 7206 - DNA, 23 bp, Artificial Sequence
  Synthetic Construct
ggggagtaatgtgctcttacgtt

SEQ ID NO: 7207 - DNA, 25 bp, Artificial Sequence
  Synthetic Construct
ggagttggttcattctctcgaatgg

SEQ ID NO: 7208 - DNA, 22 bp, Artificial Sequence
  Synthetic Construct
caagatggctgaactgcaaacg

SEQ ID NO: 7209 - DNA, 22 bp, Artificial Sequence
  Synthetic Construct
gcccaaccttgtctgtatcact

SEQ ID NO: 7210 - DNA, 28 bp, Artificial Sequence
  Synthetic Construct
caaacaacttgatttctccaatccaaca

SEQ ID NO: 7211 - DNA, 25 bp, Artificial Sequence
  Synthetic Construct
gcctgaaagtgtacatgcctcttct

SEQ ID NO: 7212 - DNA, 21 bp, Artificial Sequence
  Synthetic Construct
cccacttggccttttctgaca

SEQ ID NO: 7213 - DNA, 24 bp, Artificial Sequence
  Synthetic Construct
cctataggaaacacatggcaagga

SEQ ID NO: 7214 - DNA, 22 bp, Artificial Sequence
  Synthetic Construct
aagtcacagtgcttgacaacct

SEQ ID NO: 7215 - DNA, 21 bp, Artificial Sequence
  Synthetic Construct
tgtggaaagctgccttttggt

SEQ ID NO: 7216 - DNA, 27 bp, Artificial Sequence
  Synthetic Construct
gctgtaatagtaagaggcaccttcttg

SEQ ID NO: 7217 - DNA, 25 bp, Artificial Sequence
  Synthetic Construct
gactgtcagaatgaataggctcctt

SEQ ID NO: 7218 - DNA, 24 bp, Artificial Sequence
  Synthetic Construct
gagagtgacctagggaaactgcta

SEQ ID NO: 7219 - DNA, 24 bp, Artificial Sequence
  Synthetic Construct
gggtaagctgaggcaagtttagga

SEQ ID NO: 7220 - DNA, 22 bp, Artificial Sequence
  Synthetic Construct
tgttcattccccccgtgtacta

SEQ ID NO: 7221 - DNA, 26 bp, Artificial Sequence
  Synthetic Construct
ggatcacaattgtaactcacctttgg

SEQ ID NO: 7222 - DNA, 20 bp, Artificial Sequence
  Synthetic Construct
gcagggagtagcagcaagtt

SEQ ID NO: 7223 - DNA, 24 bp, Artificial Sequence
  Synthetic Construct
gggatgctttagaactgtgcagat

SEQ ID NO: 7224 - DNA, 25 bp, Artificial Sequence
  Synthetic Construct
ggatggagagaagaaatgacccttt

SEQ ID NO: 7225 - DNA, 23 bp, Artificial Sequence
  Synthetic Construct
gcctggaagatgtgtgaattgca

SEQ ID NO: 7226 - DNA, 25 bp, Artificial Sequence
  Synthetic Construct
caccccactagtcactgatacaaag

SEQ ID NO: 7227 - DNA, 22 bp, Artificial Sequence
  Synthetic Construct
accctggagactacacatgtct

SEQ ID NO: 7228 - DNA, 18 bp, Artificial Sequence
  Synthetic Construct
gccttcccgctgcacatg

SEQ ID NO: 7229 - DNA, 18 bp, Artificial Sequence
  Synthetic Construct
caagccacgggggacatg

SEQ ID NO: 7230 - DNA, 22 bp, Artificial Sequence
  Synthetic Construct
accccttccatccgagaatcct

SEQ ID NO: 7231 - DNA, 27 bp, Artificial Sequence
  Synthetic Construct
attataccctgtttgaggtcaaatcct

SEQ ID NO: 7232 - DNA, 22 bp, Artificial Sequence
  Synthetic Construct
gtggaacttgggcagataccaa

SEQ ID NO: 7233 - DNA, 21 bp, Artificial Sequence
  Synthetic Construct
ctcttcctcgttcagccactt

SEQ ID NO: 7234 - DNA, 22 bp, Artificial Sequence
  Synthetic Construct
gggcctagaaacaacagcaatg

SEQ ID NO: 7235 - DNA, 26 bp, Artificial Sequence
  Synthetic Construct
cagaacctattttccaaatgggcatt

SEQ ID NO: 7236 - DNA, 23 bp, Artificial Sequence
  Synthetic Construct
ccacagtctaaggcaagacatgt

SEQ ID NO: 7237 - DNA, 27 bp, Artificial Sequence
  Synthetic Construct
gcaaaggtatggttagaaaagctacgt

SEQ ID NO: 7238 - DNA, 24 bp, Artificial Sequence
  Synthetic Construct
ggaggtgtcaattgggtgctaaga

SEQ ID NO: 7239 - DNA, 27 bp, Artificial Sequence
  Synthetic Construct
acatgtagaatgatcatccaggaccta

SEQ ID NO: 7240 - DNA, 26 bp, Artificial Sequence
  Synthetic Construct
cctttgtataccagttccttctgcat

SEQ ID NO: 7241 - DNA, 22 bp, Artificial Sequence
  Synthetic Construct
gcaaccatccaaggactctgat

SEQ ID NO: 7242 - DNA, 22 bp, Artificial Sequence
  Synthetic Construct
tccaccctgagctcttcctgtt

SEQ ID NO: 7243 - DNA, 24 bp, Artificial Sequence
  Synthetic Construct
gcatggccaagtcactccagaaaa

SEQ ID NO: 7244 - DNA, 24 bp, Artificial Sequence
  Synthetic Construct
tgttgccaaaagttgctcagtaag

SEQ ID NO: 7245 - DNA, 21 bp, Artificial Sequence
  Synthetic Construct
tcgtcctcctgagctcaagga

SEQ ID NO: 7246 - DNA, 26 bp, Artificial Sequence
  Synthetic Construct
agggatacacaacaccatttaaacct

SEQ ID NO: 7247 - DNA, 22 bp, Artificial Sequence
  Synthetic Construct
agcttccccaagggcatctgaa

SEQ ID NO: 7248 - DNA, 23 bp, Artificial Sequence
  Synthetic Construct
ccaaggccaagagcaacttatgg

SEQ ID NO: 7249 - DNA, 20 bp, Artificial Sequence
  Synthetic Construct
accagccttggggaaatgga

SEQ ID NO: 7250 - DNA, 22 bp, Artificial Sequence
  Synthetic Construct
ggtttccccaatacccagttca

SEQ ID NO: 7251 - DNA, 22 bp, Artificial Sequence
  Synthetic Construct
agaacctggccatctcttccat

SEQ ID NO: 7252 - DNA, 21 bp, Artificial Sequence
  Synthetic Construct
ccaggggttggcaaacttgtt

SEQ ID NO: 7253 - DNA, 25 bp, Artificial Sequence
  Synthetic Construct
ggaggtaaacaccatccctgattag

SEQ ID NO: 7254 - DNA, 25 bp, Artificial Sequence
  Synthetic Construct
ggtaaaagctcctctctctcgtaga

SEQ ID NO: 7255 - DNA, 19 bp, Artificial Sequence
  Synthetic Construct
agcctgggatgctccacta

SEQ ID NO: 7256 - DNA, 21 bp, Artificial Sequence
  Synthetic Construct
tgggaggtgcaaaggctttgt

SEQ ID NO: 7257 - DNA, 22 bp, Artificial Sequence
  Synthetic Construct
cgaatgccacacatgtcatggt

SEQ ID NO: 7258 - DNA, 21 bp, Artificial Sequence
  Synthetic Construct
actccatgccatccagactct

SEQ ID NO: 7259 - DNA, 22 bp, Artificial Sequence
  Synthetic Construct
tgagaaaggctggcatgactct

SEQ ID NO: 7260 - DNA, 26 bp, Artificial Sequence
  Synthetic Construct
cagcaactcaatttttattggccaaa

SEQ ID NO: 7261 - DNA, 26 bp, Artificial Sequence
  Synthetic Construct
gattggcctactgcataattccctat

SEQ ID NO: 7262 - DNA, 24 bp, Artificial Sequence
  Synthetic Construct
ggaactagccaggctggaatatca

SEQ ID NO: 7263 - DNA, 22 bp, Artificial Sequence
  Synthetic Construct
ggaatggggcttctcgttcatt

SEQ ID NO: 7264 - DNA, 25 bp, Artificial Sequence
  Synthetic Construct
ctaattcaccccaatgtcagaggaa

SEQ ID NO: 7265 - DNA, 22 bp, Artificial Sequence
  Synthetic Construct
cggctaacacattgcaggaatg

SEQ ID NO: 7266 - DNA, 22 bp, Artificial Sequence
  Synthetic Construct
gcagcaaccatcttcacaaggt

SEQ ID NO: 7267 - DNA, 21 bp, Artificial Sequence
  Synthetic Construct
ggaggagcaagggtggaagta

SEQ ID NO: 7268 - DNA, 24 bp, Artificial Sequence
  Synthetic Construct
tgtggcagaaatagatcccatgtc

SEQ ID NO: 7269 - DNA, 26 bp, Artificial Sequence
  Synthetic Construct
ccatctgcttatgtgacagagaccaa

SEQ ID NO: 7270 - DNA, 21 bp, Artificial Sequence
  Synthetic Construct
cccattgcctacaacggtcat

SEQ ID NO: 7271 - DNA, 26 bp, Artificial Sequence
  Synthetic Construct
cgctagtccagattttagtgtaatgc

SEQ ID NO: 7272 - DNA, 22 bp, Artificial Sequence
  Synthetic Construct
tgaaaaaccctggttgccagtt

SEQ ID NO: 7273 - DNA, 20 bp, Artificial Sequence
  Synthetic Construct
gcctcacagggctgacatgt

SEQ ID NO: 7274 - DNA, 25 bp, Artificial Sequence
  Synthetic Construct
tgatggtttaaaacgtggaggaaac

SEQ ID NO: 7275 - DNA, 23 bp, Artificial Sequence
  Synthetic Construct
gcaggctgtcgctacgttttctt

SEQ ID NO: 7276 - DNA, 24 bp, Artificial Sequence
  Synthetic Construct
ggggtaaaaggaggttatcaagca

SEQ ID NO: 7277 - DNA, 22 bp, Artificial Sequence
  Synthetic Construct
gcctgcctggaaatctcagtct

SEQ ID NO: 7278 - DNA, 25 bp, Artificial Sequence
  Synthetic Construct
gtgatgagcacaggttattctgaca

SEQ ID NO: 7279 - DNA, 22 bp, Artificial Sequence
  Synthetic Construct
gccatgctttcattggcaaagg

SEQ ID NO: 7280 - DNA, 25 bp, Artificial Sequence
  Synthetic Construct
gatgactaagttgccttgtgagtct

SEQ ID NO: 7281 - DNA, 24 bp, Artificial Sequence
  Synthetic Construct
ctgtgagcaagtggagaggtatca

SEQ ID NO: 7282 - DNA, 21 bp, Artificial Sequence
  Synthetic Construct
tggcagcttttcgctctggtt

SEQ ID NO: 7283 - DNA, 20 bp, Artificial Sequence
  Synthetic Construct
cccgcctgtgtgactcaaac

SEQ ID NO: 7284 - DNA, 24 bp, Artificial Sequence
  Synthetic Construct
ccgtaggtgggagttcatgtctta

SEQ ID NO: 7285 - DNA, 20 bp, Artificial Sequence
  Synthetic Construct
ccccatggcaccaacttaca

SEQ ID NO: 7286 - DNA, 21 bp, Artificial Sequence
  Synthetic Construct
aggtggcacataggagctgaa

SEQ ID NO: 7287 - DNA, 25 bp, Artificial Sequence
  Synthetic Construct
caaaaggagaggtaaaccctgttct

SEQ ID NO: 7288 - DNA, 20 bp, Artificial Sequence
  Synthetic Construct
aggttctgatggcccagaga

SEQ ID NO: 7289 - DNA, 24 bp, Artificial Sequence
  Synthetic Construct
gggtaagtggcttatccaagttca

SEQ ID NO: 7290 - DNA, 24 bp, Artificial Sequence
  Synthetic Construct
cctgatccatcttgctcccttttc

SEQ ID NO: 7291 - DNA, 21 bp, Artificial Sequence
  Synthetic Construct
ttcacccccatgacccagaca

SEQ ID NO: 7292 - DNA, 24 bp, Artificial Sequence
  Synthetic Construct
tccaagggtcctgagtgtatccta

SEQ ID NO: 7293 - DNA, 28 bp, Artificial Sequence
  Synthetic Construct
gtgaaacaattcaagggtcattgatctg

SEQ ID NO: 7294 - DNA, 23 bp, Artificial Sequence
  Synthetic Construct
ctgagttgccctggacaacagtt

SEQ ID NO: 7295 - DNA, 26 bp, Artificial Sequence
  Synthetic Construct
caaggttcttcagctgacacttaaag

SEQ ID NO: 7296 - DNA, 18 bp, Artificial Sequence
  Synthetic Construct
ctggagcccaccctctgt

SEQ ID NO: 7297 - DNA, 22 bp, Artificial Sequence
  Synthetic Construct
gtgggggtgttatttggtgtca

SEQ ID NO: 7298 - DNA, 23 bp, Artificial Sequence
  Synthetic Construct
tggacacagaatcagcattccat

SEQ ID NO: 7299 - DNA, 26 bp, Artificial Sequence
  Synthetic Construct
tttactggtggtagattagccaagag

SEQ ID NO: 7300 - DNA, 23 bp, Artificial Sequence
  Synthetic Construct
ccacctgcatttctttgctgtgt

SEQ ID NO: 7301 - DNA, 21 bp, Artificial Sequence
  Synthetic Construct
agctgtgggaaaagggtcctt

SEQ ID NO: 7302 - DNA, 19 bp, Artificial Sequence
  Synthetic Construct
atgcccggcttgttgttgt

SEQ ID NO: 7303 - DNA, 22 bp, Artificial Sequence
  Synthetic Construct
ctcttccgtcctttggagttga

SEQ ID NO: 7304 - DNA, 22 bp, Artificial Sequence
  Synthetic Construct
gctgcccggtgtcaagataata

SEQ ID NO: 7305 - DNA, 26 bp, Artificial Sequence
  Synthetic Construct
agtcttggttatcaggtccttaggat

SEQ ID NO: 7306 - DNA, 22 bp, Artificial Sequence
  Synthetic Construct
atgcaaagaactctgggaagct

SEQ ID NO: 7307 - DNA, 25 bp, Artificial Sequence
  Synthetic Construct
ctgaaggatgattgggaaaggttga

SEQ ID NO: 7308 - DNA, 23 bp, Artificial Sequence
  Synthetic Construct
cgattttgccaagggaaattgct

SEQ ID NO: 7309 - DNA, 26 bp, Artificial Sequence
  Synthetic Construct
gctttgtgtatgcaagagtggtacca

SEQ ID NO: 7310 - DNA, 25 bp, Artificial Sequence
  Synthetic Construct
tctcacatagtgttgtgcctttact

SEQ ID NO: 7311 - DNA, 26 bp, Artificial Sequence
  Synthetic Construct
gagtaagtggagcaggttttaaatgg

SEQ ID NO: 7312 - DNA, 22 bp, Artificial Sequence
  Synthetic Construct
cacacattggcacatggtcaca

SEQ ID NO: 7313 - DNA, 22 bp, Artificial Sequence
  Synthetic Construct
atagcctcctcacctcatctgt

SEQ ID NO: 7314 - DNA, 25 bp, Artificial Sequence
  Synthetic Construct
gggtacacagcaaacttctcttgtc

SEQ ID NO: 7315 - DNA, 22 bp, Artificial Sequence
  Synthetic Construct
agcgtggagaggatctgtaagt

SEQ ID NO: 7316 - DNA, 27 bp, Artificial Sequence
  Synthetic Construct
actggttgctgagtatatccactatac

SEQ ID NO: 7317 - DNA, 24 bp, Artificial Sequence
  Synthetic Construct
acgtacactaaggatgggatagct

SEQ ID NO: 7318 - DNA, 24 bp, Artificial Sequence
  Synthetic Construct
gatccatacctgtgagggaggtaa

SEQ ID NO: 7319 - DNA, 24 bp, Artificial Sequence
  Synthetic Construct
tctactcttgccactgaaattgct

SEQ ID NO: 7320 - DNA, 21 bp, Artificial Sequence
  Synthetic Construct
gggggaggaaatgagcttcaa

SEQ ID NO: 7321 - DNA, 19 bp, Artificial Sequence
  Synthetic Construct
accccctgcccatatcaca

SEQ ID NO: 7322 - DNA, 23 bp, Artificial Sequence
  Synthetic Construct
cctgccctattctgtaactgcaa

SEQ ID NO: 7323 - DNA, 26 bp, Artificial Sequence
  Synthetic Construct
gctttcagacaacagttctagacaca

SEQ ID NO: 7324 - DNA, 22 bp, Artificial Sequence
  Synthetic Construct
cataatgcttgcatggctgtca

SEQ ID NO: 7325 - DNA, 27 bp, Artificial Sequence
  Synthetic Construct
ggctagtcaaaagaaaggtaggaatgg

SEQ ID NO: 7326 - DNA, 22 bp, Artificial Sequence
  Synthetic Construct
aagcatcgcagaagaggcatct

SEQ ID NO: 7327 - DNA, 24 bp, Artificial Sequence
  Synthetic Construct
gcttggaaaggaggggttggaaaa

SEQ ID NO: 7328 - DNA, 26 bp, Artificial Sequence
  Synthetic Construct
tggagagcttattcaatctccactac

SEQ ID NO: 7329 - DNA, 23 bp, Artificial Sequence
  Synthetic Construct
agaagcatcagaacaggttcaca

SEQ ID NO: 7330 - DNA, 19 bp, Artificial Sequence
  Synthetic Construct
ccccggcttgagaactgtt

SEQ ID NO: 7331 - DNA, 21 bp, Artificial Sequence
  Synthetic Construct
agctgagagaatggggacagt

SEQ ID NO: 7332 - DNA, 29 bp, Artificial Sequence
  Synthetic Construct
tcacggtaatcagtcatttacatttctct

SEQ ID NO: 7333 - DNA, 25 bp, Artificial Sequence
  Synthetic Construct
cacatacaacaggctgttagaggaa

SEQ ID NO: 7334 - DNA, 21 bp, Artificial Sequence
  Synthetic Construct
tggacttctggacccagcttt

SEQ ID NO: 7335 - DNA, 25 bp, Artificial Sequence
  Synthetic Construct
tcaaggtcataatgcacacttttgc

SEQ ID NO: 7336 - DNA, 26 bp, Artificial Sequence
  Synthetic Construct
gagatttcatgacaatggtcctcagt

SEQ ID NO: 7337 - DNA, 26 bp, Artificial Sequence
  Synthetic Construct
attacattgatggggattgttttgca

SEQ ID NO: 7338 - DNA, 24 bp, Artificial Sequence
  Synthetic Construct
aggacccaaactaggtctctttct

SEQ ID NO: 7339 - DNA, 23 bp, Artificial Sequence
  Synthetic Construct
cattggtccttcaaccttgcttt

SEQ ID NO: 7340 - DNA, 25 bp, Artificial Sequence
  Synthetic Construct
gacagacaaaagtctatggcatcca

SEQ ID NO: 7341 - DNA, 22 bp, Artificial Sequence
  Synthetic Construct
caggtgtgcatggagatgtttg

SEQ ID NO: 7342 - DNA, 23 bp, Artificial Sequence
  Synthetic Construct
ttggagctagggaagtggaggat

SEQ ID NO: 7343 - DNA, 24 bp, Artificial Sequence
  Synthetic Construct
ggggatacaagaaggcacaaagct

SEQ ID NO: 7344 - DNA, 19 bp, Artificial Sequence
  Synthetic Construct
tgcacagcctcagcatcct

SEQ ID NO: 7345 - DNA, 24 bp, Artificial Sequence
  Synthetic Construct
gcaaggaagtttgtccagtatgca

SEQ ID NO: 7346 - DNA, 21 bp, Artificial Sequence
  Synthetic Construct
aaggccaaaggtgggagcaat

SEQ ID NO: 7347 - DNA, 25 bp, Artificial Sequence
  Synthetic Construct
gtctgagagaggagcagtctatact

SEQ ID NO: 7348 - DNA, 24 bp, Artificial Sequence
  Synthetic Construct
gctccaccccaagatgttgttgaa

SEQ ID NO: 7349 - DNA, 23 bp, Artificial Sequence
  Synthetic Construct
cccatgagtgacattctgcagta

SEQ ID NO: 7350 - DNA, 21 bp, Artificial Sequence
  Synthetic Construct
accagtgggtatgctcagtct

SEQ ID NO: 7351 - DNA, 25 bp, Artificial Sequence
  Synthetic Construct
cagttagagaaaagtgtggcttcct

SEQ ID NO: 7352 - DNA, 21 bp, Artificial Sequence
  Synthetic Construct
aacccacactgccacgtttct

SEQ ID NO: 7353 - DNA, 25 bp, Artificial Sequence
  Synthetic Construct
gagagtgacaggaagtgaagtctga

SEQ ID NO: 7354 - DNA, 22 bp, Artificial Sequence
  Synthetic Construct
accaaggcctactggtttttcc

SEQ ID NO: 7355 - DNA, 24 bp, Artificial Sequence
  Synthetic Construct
ggttttaagcactggcaggaccat

SEQ ID NO: 7356 - DNA, 24 bp, Artificial Sequence
  Synthetic Construct
catgtctgtttgcctagtcaccaa

SEQ ID NO: 7357 - DNA, 23 bp, Artificial Sequence
  Synthetic Construct
gcactagaacatcaacgcatctg

SEQ ID NO: 7358 - DNA, 24 bp, Artificial Sequence
  Synthetic Construct
ggcctagagttgcaaccttacgaa

SEQ ID NO: 7359 - DNA, 22 bp, Artificial Sequence
  Synthetic Construct
agttccctctctgctcttttgc

SEQ ID NO: 7360 - DNA, 25 bp, Artificial Sequence
  Synthetic Construct
gggacatatgttgcaggtagagcta

SEQ ID NO: 7361 - DNA, 21 bp, Artificial Sequence
  Synthetic Construct
tcagcctaccacactcacact

SEQ ID NO: 7362 - DNA, 22 bp, Artificial Sequence
  Synthetic Construct
ccacaccagtttttgcggcaaa

SEQ ID NO: 7363 - DNA, 24 bp, Artificial Sequence
  Synthetic Construct
agactagggggagacagaaaagtc

SEQ ID NO: 7364 - DNA, 24 bp, Artificial Sequence
  Synthetic Construct
caaggagaatgtgccccttctaaa

SEQ ID NO: 7365 - DNA, 23 bp, Artificial Sequence
  Synthetic Construct
gaggtgtgttgattgtgctacct

SEQ ID NO: 7366 - DNA, 22 bp, Artificial Sequence
  Synthetic Construct
cgtggcaagtacctcacaactt

SEQ ID NO: 7367 - DNA, 27 bp, Artificial Sequence
  Synthetic Construct
cgcttttatctggaatcaggaatgttg

SEQ ID NO: 7368 - DNA, 22 bp, Artificial Sequence
  Synthetic Construct
cagcgcttaaccagacctaagt

SEQ ID NO: 7369 - DNA, 23 bp, Artificial Sequence
  Synthetic Construct
gggccttatcaaagcctttcaca

SEQ ID NO: 7370 - DNA, 24 bp, Artificial Sequence
  Synthetic Construct
gctctttgagaagacagcctccat

SEQ ID NO: 7371 - DNA, 24 bp, Artificial Sequence
  Synthetic Construct
agctggagcacttgagtcatatcc

SEQ ID NO: 7372 - DNA, 25 bp, Artificial Sequence
  Synthetic Construct
caacagtgcctatttcaaggtgttg

SEQ ID NO: 7373 - DNA, 25 bp, Artificial Sequence
  Synthetic Construct
gatgaagccaacattattgctagct

SEQ ID NO: 7374 - DNA, 24 bp, Artificial Sequence
  Synthetic Construct
ggacattggggggattggaaaaag

SEQ ID NO: 7375 - DNA, 20 bp, Artificial Sequence
  Synthetic Construct
gggctctgatggcattgtga

SEQ ID NO: 7376 - DNA, 22 bp, Artificial Sequence
  Synthetic Construct
cctgtgacaaagaggcaatgct

SEQ ID NO: 7377 - DNA, 22 bp, Artificial Sequence
  Synthetic Construct
ccacaagcagtttgagctacct

SEQ ID NO: 7378 - DNA, 26 bp, Artificial Sequence
  Synthetic Construct
ccaagtccttacaacattgcctctca

SEQ ID NO: 7379 - DNA, 20 bp, Artificial Sequence
  Synthetic Construct
gtcacactcaaccccttgca

SEQ ID NO: 7380 - DNA, 25 bp, Artificial Sequence
  Synthetic Construct
ccatatcatccatggtgcagaagac

SEQ ID NO: 7381 - DNA, 23 bp, Artificial Sequence
  Synthetic Construct
ttcaaacgcacagcttgggactt

SEQ ID NO: 7382 - DNA, 21 bp, Artificial Sequence
  Synthetic Construct
tccctgagagctggtgatgag

SEQ ID NO: 7383 - DNA, 21 bp, Artificial Sequence
  Synthetic Construct
ttcccagtctgagctcttgca

SEQ ID NO: 7384 - DNA, 22 bp, Artificial Sequence
  Synthetic Construct
ggccttttcccactgtgattgt

SEQ ID NO: 7385 - DNA, 25 bp, Artificial Sequence
  Synthetic Construct
gttggtgactgattcgattgaggta

SEQ ID NO: 7386 - DNA, 21 bp, Artificial Sequence
  Synthetic Construct
tctcgccagcattgtcctctt

SEQ ID NO: 7387 - DNA, 27 bp, Artificial Sequence
  Synthetic Construct
ggagataatgtgtttacaggagtgtct

SEQ ID NO: 7388 - DNA, 27 bp, Artificial Sequence
  Synthetic Construct
gcacacaaacttctgctcatttttagc

SEQ ID NO: 7389 - DNA, 23 bp, Artificial Sequence
  Synthetic Construct
ctgacaggcacatctaagaagct

SEQ ID NO: 7390 - DNA, 19 bp, Artificial Sequence
  Synthetic Construct
gctccgagggaaaggcatt

SEQ ID NO: 7391 - DNA, 20 bp, Artificial Sequence
  Synthetic Construct
agcagatgggcctgttccaa

SEQ ID NO: 7392 - DNA, 22 bp, Artificial Sequence
  Synthetic Construct
ctagacagtgtggctggaacat

SEQ ID NO: 7393 - DNA, 22 bp, Artificial Sequence
  Synthetic Construct
cctgtgagctgggccatttttt

SEQ ID NO: 7394 - DNA, 22 bp, Artificial Sequence
  Synthetic Construct
ggtggcatgctgaaatcagaag

SEQ ID NO: 7395 - DNA, 27 bp, Artificial Sequence
  Synthetic Construct
cccaaaaaagatggaacagcctttgtc

SEQ ID NO: 7396 - DNA, 21 bp, Artificial Sequence
  Synthetic Construct
tcttgaacagtgtgccatgct

SEQ ID NO: 7397 - DNA, 22 bp, Artificial Sequence
  Synthetic Construct
tgaacatcttggtggggagaca

SEQ ID NO: 7398 - DNA, 25 bp, Artificial Sequence
  Synthetic Construct
gttcaggaaacacttgctagaggaa

SEQ ID NO: 7399 - DNA, 23 bp, Artificial Sequence
  Synthetic Construct
cagaaagttcatgcactgccttt

SEQ ID NO: 7400 - DNA, 20 bp, Artificial Sequence
  Synthetic Construct
agaaggctgagtggggagtt

SEQ ID NO: 7401 - DNA, 22 bp, Artificial Sequence
  Synthetic Construct
gccaacagcacttgtcatacca

SEQ ID NO: 7402 - DNA, 24 bp, Artificial Sequence
  Synthetic Construct
ggccgggtagaatatgatcagaca

SEQ ID NO: 7403 - DNA, 22 bp, Artificial Sequence
  Synthetic Construct
tgggcttgcaacagttggaact

SEQ ID NO: 7404 - DNA, 23 bp, Artificial Sequence
  Synthetic Construct
tgggaggaacttgctggttttgg

SEQ ID NO: 7405 - DNA, 21 bp, Artificial Sequence
  Synthetic Construct
tggctggaggttgtgatttgg

SEQ ID NO: 7406 - DNA, 21 bp, Artificial Sequence
  Synthetic Construct
tgtgggggctaatggtttcct

SEQ ID NO: 7407 - DNA, 29 bp, Artificial Sequence
  Synthetic Construct
ggaaggaatcactagtacttctagcctat

SEQ ID NO: 7408 - DNA, 22 bp, Artificial Sequence
  Synthetic Construct
agcatacaagcaaccaggtgaa

SEQ ID NO: 7409 - DNA, 27 bp, Artificial Sequence
  Synthetic Construct
tggatagaccgttctatgccatatcta

SEQ ID NO: 7410 - DNA, 23 bp, Artificial Sequence
  Synthetic Construct
ggataacaaggggccagatagtg

SEQ ID NO: 7411 - DNA, 18 bp, Artificial Sequence
  Synthetic Construct
gcggggggtctactcaga

SEQ ID NO: 7412 - DNA, 30 bp, Artificial Sequence
  Synthetic Construct
catgagaaataataagtcattgctgcttca

SEQ ID NO: 7413 - DNA, 24 bp, Artificial Sequence
  Synthetic Construct
ggtggaagaatgaggctgtacctt

SEQ ID NO: 7414 - DNA, 28 bp, Artificial Sequence
  Synthetic Construct
caaagactgtatcctccataaagcctaa

SEQ ID NO: 7415 - DNA, 24 bp, Artificial Sequence
  Synthetic Construct
atgtgaaggtagaagcatgtgtct

SEQ ID NO: 7416 - DNA, 19 bp, Artificial Sequence
  Synthetic Construct
tccctcgctcatcccactt

SEQ ID NO: 7417 - DNA, 24 bp, Artificial Sequence
  Synthetic Construct
agcttttgacaggacctcattcaa

SEQ ID NO: 7418 - DNA, 20 bp, Artificial Sequence
  Synthetic Construct
ccgatccaagttgccatcct

SEQ ID NO: 7419 - DNA, 22 bp, Artificial Sequence
  Synthetic Construct
tgctgcaggggttttggtgata

SEQ ID NO: 7420 - DNA, 26 bp, Artificial Sequence
  Synthetic Construct
tgagcagtgacattgtagttaaagct

SEQ ID NO: 7421 - DNA, 24 bp, Artificial Sequence
  Synthetic Construct
agggactgaggaacagcagtaatg

SEQ ID NO: 7422 - DNA, 22 bp, Artificial Sequence
  Synthetic Construct
ggcagcttccaggagtaaagag

SEQ ID NO: 7423 - DNA, 24 bp, Artificial Sequence
  Synthetic Construct
tgatggtcacacagctctcatagg

SEQ ID NO: 7424 - DNA, 20 bp, Artificial Sequence
  Synthetic Construct
tgactgcagggtgtgactgt

SEQ ID NO: 7425 - DNA, 21 bp, Artificial Sequence
  Synthetic Construct
ccacatgctaggctgggtaga

SEQ ID NO: 7426 - DNA, 24 bp, Artificial Sequence
  Synthetic Construct
ccagatggagtggggtaaaatcac

SEQ ID NO: 7427 - DNA, 20 bp, Artificial Sequence
  Synthetic Construct
cagttggcaagctggagact

SEQ ID NO: 7428 - DNA, 22 bp, Artificial Sequence
  Synthetic Construct
ttgtccctgagtcagtggctta

SEQ ID NO: 7429 - DNA, 25 bp, Artificial Sequence
  Synthetic Construct
cctcaagccctcttagtaggcataa

SEQ ID NO: 7430 - DNA, 22 bp, Artificial Sequence
  Synthetic Construct
ctggtccagtcctttcttgctt

SEQ ID NO: 7431 - DNA, 25 bp, Artificial Sequence
  Synthetic Construct
ccctgtcctttactcctaagagtct

SEQ ID NO: 7432 - DNA, 22 bp, Artificial Sequence
  Synthetic Construct
tccacagttcagctcagtcact

SEQ ID NO: 7433 - DNA, 26 bp, Artificial Sequence
  Synthetic Construct
cactgctccattttggcttatgtttt

SEQ ID NO: 7434 - DNA, 25 bp, Artificial Sequence
  Synthetic Construct
cctgctgaacaccttggttatagtg

SEQ ID NO: 7435 - DNA, 22 bp, Artificial Sequence
  Synthetic Construct
tgggttgtggggattggagaga

SEQ ID NO: 7436 - DNA, 20 bp, Artificial Sequence
  Synthetic Construct
cggtgcagaggatggtgtga

SEQ ID NO: 7437 - DNA, 22 bp, Artificial Sequence
  Synthetic Construct
ttctgtcacccccacacacttg

SEQ ID NO: 7438 - DNA, 22 bp, Artificial Sequence
  Synthetic Construct
cgatggaggcagattgtagcaa

SEQ ID NO: 7439 - DNA, 24 bp, Artificial Sequence
  Synthetic Construct
ctgttgcatgttgcttgaggctat

SEQ ID NO: 7440 - DNA, 25 bp, Artificial Sequence
  Synthetic Construct
caaaccttgcaggtctgaccttcat

SEQ ID NO: 7441 - DNA, 24 bp, Artificial Sequence
  Synthetic Construct
tcaacacctgagaaagactgttca

SEQ ID NO: 7442 - DNA, 26 bp, Artificial Sequence
  Synthetic Construct
gactctccagttagatggaccaagag

SEQ ID NO: 7443 - DNA, 27 bp, Artificial Sequence
  Synthetic Construct
ggttaaggagacagaatgttaccagtt

SEQ ID NO: 7444 - DNA, 19 bp, Artificial Sequence
  Synthetic Construct
tggcatggcagtggcagaa

SEQ ID NO: 7445 - DNA, 25 bp, Artificial Sequence
  Synthetic Construct
gttcccagagagtggtttatactgt

SEQ ID NO: 7446 - DNA, 24 bp, Artificial Sequence
  Synthetic Construct
cctctcagaatgcaaatggtagga

SEQ ID NO: 7447 - DNA, 22 bp, Artificial Sequence
  Synthetic Construct
tgcaacgaactttctcctccat

SEQ ID NO: 7448 - DNA, 21 bp, Artificial Sequence
  Synthetic Construct
aagtcacaggggtggtttcca

SEQ ID NO: 7449 - DNA, 26 bp, Artificial Sequence
  Synthetic Construct
gcaaagtccttacgaagtgagatgga

SEQ ID NO: 7450 - DNA, 25 bp, Artificial Sequence
  Synthetic Construct
ggctgtgcatcttagggtcatgata

SEQ ID NO: 7451 - DNA, 22 bp, Artificial Sequence
  Synthetic Construct
cttaagttggacgcagctgtct

SEQ ID NO: 7452 - DNA, 22 bp, Artificial Sequence
  Synthetic Construct
accaacatgcaaacaggacaca

SEQ ID NO: 7453 - DNA, 21 bp, Artificial Sequence
  Synthetic Construct
tcacgcagcctatgagtaggt

SEQ ID NO: 7454 - DNA, 21 bp, Artificial Sequence
  Synthetic Construct
ggctctatcccttgccccaat

SEQ ID NO: 7455 - DNA, 20 bp, Artificial Sequence
  Synthetic Construct
aacgcacagagcctgacttg

SEQ ID NO: 7456 - DNA, 22 bp, Artificial Sequence
  Synthetic Construct
tgtgtcacagtctgccaaccta

SEQ ID NO: 7457 - DNA, 23 bp, Artificial Sequence
  Synthetic Construct
ggccatcatccaattagggtttg

SEQ ID NO: 7458 - DNA, 26 bp, Artificial Sequence
  Synthetic Construct
cagtgttatcttaatgggagcaccta

SEQ ID NO: 7459 - DNA, 27 bp, Artificial Sequence
  Synthetic Construct
cccagctgtatctcaacaggtaagaag

SEQ ID NO: 7460 - DNA, 21 bp, Artificial Sequence
  Synthetic Construct
aggacccagcactctgaggaa

SEQ ID NO: 7461 - DNA, 27 bp, Artificial Sequence
  Synthetic Construct
ggactgcaaaagactgaatgataaggt

SEQ ID NO: 7462 - DNA, 24 bp, Artificial Sequence
  Synthetic Construct
agtggcttataggtccctaatgca

SEQ ID NO: 7463 - DNA, 22 bp, Artificial Sequence
  Synthetic Construct
tccgttttcagggctgggataa

SEQ ID NO: 7464 - DNA, 23 bp, Artificial Sequence
  Synthetic Construct
cctgggtaagctgtcagtagcat

SEQ ID NO: 7465 - DNA, 24 bp, Artificial Sequence
  Synthetic Construct
gttcagagctttgcctagatctca

SEQ ID NO: 7466 - DNA, 21 bp, Artificial Sequence
  Synthetic Construct
gcagggcagaagctacacaga

SEQ ID NO: 7467 - DNA, 29 bp, Artificial Sequence
  Synthetic Construct
acaaactacatgtaaaggcaggatagtag

SEQ ID NO: 7468 - DNA, 24 bp, Artificial Sequence
  Synthetic Construct
caaattgcctggcttcacattctg

SEQ ID NO: 7469 - DNA, 23 bp, Artificial Sequence
  Synthetic Construct
tctcacctcactgtcatctctgt

SEQ ID NO: 7470 - DNA, 21 bp, Artificial Sequence
  Synthetic Construct
tcaggcctcactgagacatca

SEQ ID NO: 7471 - DNA, 20 bp, Artificial Sequence
  Synthetic Construct
ttcagcatgctcgccactac

SEQ ID NO: 7472 - DNA, 22 bp, Artificial Sequence
  Synthetic Construct
agcactggtctggaagtgagat

SEQ ID NO: 7473 - DNA, 19 bp, Artificial Sequence
  Synthetic Construct
ccacagcccacgctactgt

SEQ ID NO: 7474 - DNA, 20 bp, Artificial Sequence
  Synthetic Construct
gctctcctccctcccagtct

SEQ ID NO: 7475 - DNA, 21 bp, Artificial Sequence
  Synthetic Construct
tccctccacccatcttatgca

SEQ ID NO: 7476 - DNA, 23 bp, Artificial Sequence
  Synthetic Construct
tgctttggcatagtctccatctc

SEQ ID NO: 7477 - DNA, 23 bp, Artificial Sequence
  Synthetic Construct
tggagactggtcatgtacacaca

SEQ ID NO: 7478 - DNA, 25 bp, Artificial Sequence
  Synthetic Construct
ggtaatggcaaaagttcctcatgag

SEQ ID NO: 7479 - DNA, 22 bp, Artificial Sequence
  Synthetic Construct
accaggaccacagttggaatcc

SEQ ID NO: 7480 - DNA, 23 bp, Artificial Sequence
  Synthetic Construct
tcctgtgattgctttccctttga

SEQ ID NO: 7481 - DNA, 22 bp, Artificial Sequence
  Synthetic Construct
agcagcaagtacagccatagag

SEQ ID NO: 7482 - DNA, 25 bp, Artificial Sequence
  Synthetic Construct
aaaccacaattatcccccaaaacac

SEQ ID NO: 7483 - DNA, 21 bp, Artificial Sequence
  Synthetic Construct
agctgtctgtgcactgatgtg

SEQ ID NO: 7484 - DNA, 24 bp, Artificial Sequence
  Synthetic Construct
gccctcactcttcagggacaatag

SEQ ID NO: 7485 - DNA, 19 bp, Artificial Sequence
  Synthetic Construct
ccgggtcaagcctgtgaca

SEQ ID NO: 7486 - DNA, 23 bp, Artificial Sequence
  Synthetic Construct
gtctctgggaagttgcatgtaca

SEQ ID NO: 7487 - DNA, 21 bp, Artificial Sequence
  Synthetic Construct
atcctgggacaccggtagcat

SEQ ID NO: 7488 - DNA, 20 bp, Artificial Sequence
  Synthetic Construct
aagcagggctgtgagttgtg

SEQ ID NO: 7489 - DNA, 23 bp, Artificial Sequence
  Synthetic Construct
accgagggtgtctttatcaaggt

SEQ ID NO: 7490 - DNA, 21 bp, Artificial Sequence
  Synthetic Construct
agaaggccacgtgtcacaaga

SEQ ID NO: 7491 - DNA, 22 bp, Artificial Sequence
  Synthetic Construct
ggcgagagagacaaaggattca

SEQ ID NO: 7492 - DNA, 24 bp, Artificial Sequence
  Synthetic Construct
gtgtgtgtgtttatccaggttcac

SEQ ID NO: 7493 - DNA, 19 bp, Artificial Sequence
  Synthetic Construct
gccaggctgcacagatcag

SEQ ID NO: 7494 - DNA, 21 bp, Artificial Sequence
  Synthetic Construct
tgctgagacggtggatttgtg

SEQ ID NO: 7495 - DNA, 22 bp, Artificial Sequence
  Synthetic Construct
agacagatgggtgcatcaagga

SEQ ID NO: 7496 - DNA, 22 bp, Artificial Sequence
  Synthetic Construct
tgccagtgcatttgaaggatga

SEQ ID NO: 7497 - DNA, 22 bp, Artificial Sequence
  Synthetic Construct
actgctgcgtcctaaagaagac

SEQ ID NO: 7498 - DNA, 26 bp, Artificial Sequence
  Synthetic Construct
agctggcaccaaatttatcacataag

SEQ ID NO: 7499 - DNA, 26 bp, Artificial Sequence
  Synthetic Construct
ctactgtttaacttctggggatcact

SEQ ID NO: 7500 - DNA, 24 bp, Artificial Sequence
  Synthetic Construct
gggtggaatggagatcagaaactg

SEQ ID NO: 7501 - DNA, 22 bp, Artificial Sequence
  Synthetic Construct
actttagggccagctgttttct

SEQ ID NO: 7502 - DNA, 28 bp, Artificial Sequence
  Synthetic Construct
acaaagctatactaaacgatctgtctca

SEQ ID NO: 7503 - DNA, 23 bp, Artificial Sequence
  Synthetic Construct
aagttgagaccagtgtcattgct

SEQ ID NO: 7504 - DNA, 20 bp, Artificial Sequence
  Synthetic Construct
acgctccacatgtggcaaat

SEQ ID NO: 7505 - DNA, 19 bp, Artificial Sequence
  Synthetic Construct
ccacccccacctcaagcta

SEQ ID NO: 7506 - DNA, 26 bp, Artificial Sequence
  Synthetic Construct
gggtactctggactttttgcatttgg

SEQ ID NO: 7507 - DNA, 24 bp, Artificial Sequence
  Synthetic Construct
gcctaggaagtgaagaaccaaagc

SEQ ID NO: 7508 - DNA, 21 bp, Artificial Sequence
  Synthetic Construct
agcacccaggcttcaaacact

SEQ ID NO: 7509 - DNA, 25 bp, Artificial Sequence
  Synthetic Construct
cctcactcaggaagaatgtgtcctt

SEQ ID NO: 7510 - DNA, 24 bp, Artificial Sequence
  Synthetic Construct
gagccatcttcctgccttttaaga

SEQ ID NO: 7511 - DNA, 25 bp, Artificial Sequence
  Synthetic Construct
gctactcactcaagacctctgtcaa

SEQ ID NO: 7512 - DNA, 24 bp, Artificial Sequence
  Synthetic Construct
ggtgcttggaaatgggctaaattg

SEQ ID NO: 7513 - DNA, 21 bp, Artificial Sequence
  Synthetic Construct
agtttccctctgtcgcagtct

SEQ ID NO: 7514 - DNA, 22 bp, Artificial Sequence
  Synthetic Construct
gacaattgctcagctcctctgt

SEQ ID NO: 7515 - DNA, 22 bp, Artificial Sequence
  Synthetic Construct
cctgtacagcatctgtcgctat

SEQ ID NO: 7516 - DNA, 24 bp, Artificial Sequence
  Synthetic Construct
ggtggttgaggtcaggtcaatgaa

SEQ ID NO: 7517 - DNA, 24 bp, Artificial Sequence
  Synthetic Construct
gtggtggaatgcctctagattgtg

SEQ ID NO: 7518 - DNA, 23 bp, Artificial Sequence
  Synthetic Construct
tgcggtccaggtatcatctaggt

SEQ ID NO: 7519 - DNA, 23 bp, Artificial Sequence
  Synthetic Construct
ggccaagttctgggataacaaca

SEQ ID NO: 7520 - DNA, 22 bp, Artificial Sequence
  Synthetic Construct
gcagaaatgggagcagttcaca

SEQ ID NO: 7521 - DNA, 24 bp, Artificial Sequence
  Synthetic Construct
ggacagcaggcatttcctagtcaa

SEQ ID NO: 7522 - DNA, 22 bp, Artificial Sequence
  Synthetic Construct
agcaaggaaaggggtcaccaaa

SEQ ID NO: 7523 - DNA, 24 bp, Artificial Sequence
  Synthetic Construct
ggaaccaagcttgtttgcatttgc

SEQ ID NO: 7524 - DNA, 24 bp, Artificial Sequence
  Synthetic Construct
ggaggaataccaatcagacgacaa

SEQ ID NO: 7525 - DNA, 22 bp, Artificial Sequence
  Synthetic Construct
gggttgcttccaaggtcacttt

SEQ ID NO: 7526 - DNA, 22 bp, Artificial Sequence
  Synthetic Construct
ccgtggttctacaagcaaccaa

SEQ ID NO: 7527 - DNA, 22 bp, Artificial Sequence
  Synthetic Construct
tgccacttggagactgtgatca

SEQ ID NO: 7528 - DNA, 23 bp, Artificial Sequence
  Synthetic Construct
tggtgggtggcaaggagtgatat

SEQ ID NO: 7529 - DNA, 24 bp, Artificial Sequence
  Synthetic Construct
ctcaaactcctggcttcatatggt

SEQ ID NO: 7530 - DNA, 22 bp, Artificial Sequence
  Synthetic Construct
cagcagcaacaaggagatctga

SEQ ID NO: 7531 - DNA, 19 bp, Artificial Sequence
  Synthetic Construct
tgcactcctgcctgttctg

SEQ ID NO: 7532 - DNA, 25 bp, Artificial Sequence
  Synthetic Construct
aactggattttttcctagggctaca

SEQ ID NO: 7533 - DNA, 23 bp, Artificial Sequence
  Synthetic Construct
gccactctgccaatcttatttgc

SEQ ID NO: 7534 - DNA, 26 bp, Artificial Sequence
  Synthetic Construct
cctatgggctttacaattggagtaga

SEQ ID NO: 7535 - DNA, 25 bp, Artificial Sequence
  Synthetic Construct
gaaaaggcaacagattacgtcaaca

SEQ ID NO: 7536 - DNA, 25 bp, Artificial Sequence
  Synthetic Construct
ggactaggcaacagaggatatgaac

SEQ ID NO: 7537 - DNA, 28 bp, Artificial Sequence
  Synthetic Construct
agaggtgtagagttatttgcactgtatc

SEQ ID NO: 7538 - DNA, 23 bp, Artificial Sequence
  Synthetic Construct
acctctggggtcttggtatacat

SEQ ID NO: 7539 - DNA, 24 bp, Artificial Sequence
  Synthetic Construct
gatggagagagatggtccaaagac

SEQ ID NO: 7540 - DNA, 21 bp, Artificial Sequence
  Synthetic Construct
gtaagcgtgctggaggatgaa

SEQ ID NO: 7541 - DNA, 26 bp, Artificial Sequence
  Synthetic Construct
cccttcccttgaatgtgttgaaagtg

SEQ ID NO: 7542 - DNA, 24 bp, Artificial Sequence
  Synthetic Construct
tcaaccccatctgaggacattgag

SEQ ID NO: 7543 - DNA, 24 bp, Artificial Sequence
  Synthetic Construct
gcagagaagagaacagctgctttc

SEQ ID NO: 7544 - DNA, 22 bp, Artificial Sequence
  Synthetic Construct
ctgtaggacaagcatggaagca

SEQ ID NO: 7545 - DNA, 21 bp, Artificial Sequence
  Synthetic Construct
tcagggtttcagctgctggaa

SEQ ID NO: 7546 - DNA, 26 bp, Artificial Sequence
  Synthetic Construct
ccaagattgtgatggaaattcccaaa

SEQ ID NO: 7547 - DNA, 25 bp, Artificial Sequence
  Synthetic Construct
ctggataaaagtggggagcttaagg

SEQ ID NO: 7548 - DNA, 25 bp, Artificial Sequence
  Synthetic Construct
gctctgtctccaatgtgtttttgtg

SEQ ID NO: 7549 - DNA, 23 bp, Artificial Sequence
  Synthetic Construct
agcacaggagctgcagagtgaaa

SEQ ID NO: 7550 - DNA, 24 bp, Artificial Sequence
  Synthetic Construct
tgagcccttgaattacaggagaga

SEQ ID NO: 7551 - DNA, 21 bp, Artificial Sequence
  Synthetic Construct
tcctcccttgacccatgttct

SEQ ID NO: 7552 - DNA, 27 bp, Artificial Sequence
  Synthetic Construct
ggcctgaaggtaatgattcttatcaca

SEQ ID NO: 7553 - DNA, 21 bp, Artificial Sequence
  Synthetic Construct
acacagcaaaggcaggctctt

SEQ ID NO: 7554 - DNA, 23 bp, Artificial Sequence
  Synthetic Construct
cagaacctggagctgtgaattca

SEQ ID NO: 7555 - DNA, 20 bp, Artificial Sequence
  Synthetic Construct
atcccatccggagccaaagg

SEQ ID NO: 7556 - DNA, 24 bp, Artificial Sequence
  Synthetic Construct
tgtccaggttgcatactacacaac

SEQ ID NO: 7557 - DNA, 27 bp, Artificial Sequence
  Synthetic Construct
gggtaacaaatgggtcaggtatattgg

SEQ ID NO: 7558 - DNA, 27 bp, Artificial Sequence
  Synthetic Construct
cctgtaatggagttgatggggatttaa

SEQ ID NO: 7559 - DNA, 20 bp, Artificial Sequence
  Synthetic Construct
ggtgggtgtgggtgtcatct

SEQ ID NO: 7560 - DNA, 26 bp, Artificial Sequence
  Synthetic Construct
gatgtgaatgatgtgttacggtaacc

SEQ ID NO: 7561 - DNA, 21 bp, Artificial Sequence
  Synthetic Construct
cgggtgtctgtcgagtaacag

SEQ ID NO: 7562 - DNA, 25 bp, Artificial Sequence
  Synthetic Construct
acaagcttgggatagtctgttgatt

SEQ ID NO: 7563 - DNA, 25 bp, Artificial Sequence
  Synthetic Construct
cagagaagtggcaaggagaagtttg

SEQ ID NO: 7564 - DNA, 24 bp, Artificial Sequence
  Synthetic Construct
aaactgggtctgaacttggaatct

SEQ ID NO: 7565 - DNA, 21 bp, Artificial Sequence
  Synthetic Construct
acaagccagtgtgcccattaa

SEQ ID NO: 7566 - DNA, 23 bp, Artificial Sequence
  Synthetic Construct
ttgaggtcaggaatcccaagttc

SEQ ID NO: 7567 - DNA, 22 bp, Artificial Sequence
  Synthetic Construct
tgaactgtgccttccactgaca

SEQ ID NO: 7568 - DNA, 25 bp, Artificial Sequence
  Synthetic Construct
cagtggtttcttctttgcagtagct

SEQ ID NO: 7569 - DNA, 23 bp, Artificial Sequence
  Synthetic Construct
gccaccaaagacttatggagtgt

SEQ ID NO: 7570 - DNA, 24 bp, Artificial Sequence
  Synthetic Construct
aggccagattggatctccatgaga

SEQ ID NO: 7571 - DNA, 20 bp, Artificial Sequence
  Synthetic Construct
tctcgtgcactggaagcaaa

SEQ ID NO: 7572 - DNA, 22 bp, Artificial Sequence
  Synthetic Construct
agcagtagcatctcctctctgt

SEQ ID NO: 7573 - DNA, 22 bp, Artificial Sequence
  Synthetic Construct
gccgactcattctccctatgca

SEQ ID NO: 7574 - DNA, 22 bp, Artificial Sequence
  Synthetic Construct
agaaagcaagctgcatggagat

SEQ ID NO: 7575 - DNA, 27 bp, Artificial Sequence
  Synthetic Construct
gcctacttctcacatcacagctctcta

SEQ ID NO: 7576 - DNA, 28 bp, Artificial Sequence
  Synthetic Construct
actagaatgtggaaaccctaaattcaga

SEQ ID NO: 7577 - DNA, 23 bp, Artificial Sequence
  Synthetic Construct
gcttgcaggaatctaaccctgta

SEQ ID NO: 7578 - DNA, 24 bp, Artificial Sequence
  Synthetic Construct
atctctgggagttgagttgttgag

SEQ ID NO: 7579 - DNA, 21 bp, Artificial Sequence
  Synthetic Construct
ccatgcttcagtgtgcaagag

SEQ ID NO: 7580 - DNA, 20 bp, Artificial Sequence
  Synthetic Construct
agggtgagaacggagtgcat

SEQ ID NO: 7581 - DNA, 22 bp, Artificial Sequence
  Synthetic Construct
gcacctcaccttccccatcatt

SEQ ID NO: 7582 - DNA, 22 bp, Artificial Sequence
  Synthetic Construct
ggctgtggtattgaacctccaa

SEQ ID NO: 7583 - DNA, 24 bp, Artificial Sequence
  Synthetic Construct
ggtgaacaggtgatgtcgacttga

SEQ ID NO: 7584 - DNA, 22 bp, Artificial Sequence
  Synthetic Construct
tgtcctctgtctcagccatgtg

SEQ ID NO: 7585 - DNA, 19 bp, Artificial Sequence
  Synthetic Construct
tgctgttcaggcccactct

SEQ ID NO: 7586 - DNA, 24 bp, Artificial Sequence
  Synthetic Construct
gctcagcagggggattattctaca

SEQ ID NO: 7587 - DNA, 21 bp, Artificial Sequence
  Synthetic Construct
tgaagcctgggtgtagctttg

SEQ ID NO: 7588 - DNA, 20 bp, Artificial Sequence
  Synthetic Construct
ccagcacagggttggatacc

SEQ ID NO: 7589 - DNA, 22 bp, Artificial Sequence
  Synthetic Construct
gccttggctcacagagtcatct

SEQ ID NO: 7590 - DNA, 20 bp, Artificial Sequence
  Synthetic Construct
aaccggtgtgaggcaatacc

SEQ ID NO: 7591 - DNA, 22 bp, Artificial Sequence
  Synthetic Construct
cgaacgctggttctttctttgc

SEQ ID NO: 7592 - DNA, 22 bp, Artificial Sequence
  Synthetic Construct
ggatttgggctttcggctatct

SEQ ID NO: 7593 - DNA, 20 bp, Artificial Sequence
  Synthetic Construct
gtggcttgggctagattgca

SEQ ID NO: 7594 - DNA, 25 bp, Artificial Sequence
  Synthetic Construct
acaacagacaagcaatgttcattga

SEQ ID NO: 7595 - DNA, 21 bp, Artificial Sequence
  Synthetic Construct
tggggtcaggggaatgtggat

SEQ ID NO: 7596 - DNA, 22 bp, Artificial Sequence
  Synthetic Construct
ggacacacagcactctaaagct

SEQ ID NO: 7597 - DNA, 23 bp, Artificial Sequence
  Synthetic Construct
ccagtgagtggtatctgttggaa

SEQ ID NO: 7598 - DNA, 22 bp, Artificial Sequence
  Synthetic Construct
cgctttcgaagtctgactttcc

SEQ ID NO: 7599 - DNA, 21 bp, Artificial Sequence
  Synthetic Construct
gatgccttctcctgctagcaa

SEQ ID NO: 7600 - DNA, 21 bp, Artificial Sequence
  Synthetic Construct
tccactgccctacctttccat

SEQ ID NO: 7601 - DNA, 22 bp, Artificial Sequence
  Synthetic Construct
gccagtttgcaacctctatgct

SEQ ID NO: 7602 - DNA, 19 bp, Artificial Sequence
  Synthetic Construct
gcgtgggcctggatgttca

SEQ ID NO: 7603 - DNA, 26 bp, Artificial Sequence
  Synthetic Construct
gctgtaaacagaggcatttggtacct

SEQ ID NO: 7604 - DNA, 22 bp, Artificial Sequence
  Synthetic Construct
gtttggtgtagggagccacaat

SEQ ID NO: 7605 - DNA, 25 bp, Artificial Sequence
  Synthetic Construct
gcaaccaacctgtattctcaaaagg

SEQ ID NO: 7606 - DNA, 24 bp, Artificial Sequence
  Synthetic Construct
ggctggaagctaattttggtttgg

SEQ ID NO: 7607 - DNA, 24 bp, Artificial Sequence
  Synthetic Construct
acacaccttggacagtctataacc

SEQ ID NO: 7608 - DNA, 22 bp, Artificial Sequence
  Synthetic Construct
tttagccaggcatgagctacag

SEQ ID NO: 7609 - DNA, 22 bp, Artificial Sequence
  Synthetic Construct
agattccacaaagggcccatct

SEQ ID NO: 7610 - DNA, 24 bp, Artificial Sequence
  Synthetic Construct
gtctaacctatggccatgggattt

SEQ ID NO: 7611 - DNA, 26 bp, Artificial Sequence
  Synthetic Construct
cgttgaggaaagtttcaagggaggat

SEQ ID NO: 7612 - DNA, 20 bp, Artificial Sequence
  Synthetic Construct
aaatggctgcaggtgtcaca

SEQ ID NO: 7613 - DNA, 21 bp, Artificial Sequence
  Synthetic Construct
cccccatcctacacagagcaa

SEQ ID NO: 7614 - DNA, 25 bp, Artificial Sequence
  Synthetic Construct
gacaaagtcttcatggtggttttca

SEQ ID NO: 7615 - DNA, 28 bp, Artificial Sequence
  Synthetic Construct
ggaaatgctagtacctactgctctatcc

SEQ ID NO: 7616 - DNA, 20 bp, Artificial Sequence
  Synthetic Construct
ggggaggctttctgctccta

SEQ ID NO: 7617 - DNA, 24 bp, Artificial Sequence
  Synthetic Construct
ggatgggttcagttgcattttgtc

SEQ ID NO: 7618 - DNA, 23 bp, Artificial Sequence
  Synthetic Construct
gaagccaggaaatgacgtaggat

SEQ ID NO: 7619 - DNA, 25 bp, Artificial Sequence
  Synthetic Construct
ctgggaatttgtggttaacattggt

SEQ ID NO: 7620 - DNA, 22 bp, Artificial Sequence
  Synthetic Construct
ccgattcacagtgctgctttca

SEQ ID NO: 7621 - DNA, 25 bp, Artificial Sequence
  Synthetic Construct
ccccagctatactcacaacagtgat

SEQ ID NO: 7622 - DNA, 22 bp, Artificial Sequence
  Synthetic Construct
tgggcagttcagcttgttgtgt

SEQ ID NO: 7623 - DNA, 25 bp, Artificial Sequence
  Synthetic Construct
agagctgataatacaccctgactgt

SEQ ID NO: 7624 - DNA, 24 bp, Artificial Sequence
  Synthetic Construct
cagcagttggggttattccagaag

SEQ ID NO: 7625 - DNA, 24 bp, Artificial Sequence
  Synthetic Construct
cattctgaactagccacggtactg

SEQ ID NO: 7626 - DNA, 22 bp, Artificial Sequence
  Synthetic Construct
ccctaatgatgggcacaaggtt

SEQ ID NO: 7627 - DNA, 21 bp, Artificial Sequence
  Synthetic Construct
cccagctcctccacggtctgt

SEQ ID NO: 7628 - DNA, 22 bp, Artificial Sequence
  Synthetic Construct
gcttggaaatgtggcactgagt

SEQ ID NO: 7629 - DNA, 22 bp, Artificial Sequence
  Synthetic Construct
tggagtggggactgagttcatt

SEQ ID NO: 7630 - DNA, 21 bp, Artificial Sequence
  Synthetic Construct
agctgtaagacctggggcttt

SEQ ID NO: 7631 - DNA, 25 bp, Artificial Sequence
  Synthetic Construct
gagatgtctctggtgcaaatacaga

SEQ ID NO: 7632 - DNA, 22 bp, Artificial Sequence
  Synthetic Construct
agccaaaccctgctagcttacc

SEQ ID NO: 7633 - DNA, 22 bp, Artificial Sequence
  Synthetic Construct
acccagtgaagctgatgcgtaa

SEQ ID NO: 7634 - DNA, 25 bp, Artificial Sequence
  Synthetic Construct
gctcaaatcagttctgtctctggtt

SEQ ID NO: 7635 - DNA, 25 bp, Artificial Sequence
  Synthetic Construct
gcactcactctggttaacagtggtt

SEQ ID NO: 7636 - DNA, 21 bp, Artificial Sequence
  Synthetic Construct
agggcagactgggttgggtta

SEQ ID NO: 7637 - DNA, 24 bp, Artificial Sequence
  Synthetic Construct
agggagaagacactctctcacctt

SEQ ID NO: 7638 - DNA, 22 bp, Artificial Sequence
  Synthetic Construct
tggcaggataaaagcccctaag

SEQ ID NO: 7639 - DNA, 26 bp, Artificial Sequence
  Synthetic Construct
gtctgcatgattgagatttgattgca

SEQ ID NO: 7640 - DNA, 22 bp, Artificial Sequence
  Synthetic Construct
aggaagcctccagcaattacag

SEQ ID NO: 7641 - DNA, 23 bp, Artificial Sequence
  Synthetic Construct
gtgccctattgtgggaaattagc

SEQ ID NO: 7642 - DNA, 24 bp, Artificial Sequence
  Synthetic Construct
aggtacaagcactccttcaagtag

SEQ ID NO: 7643 - DNA, 26 bp, Artificial Sequence
  Synthetic Construct
gcagataaaatcttggtgttcgtaca

SEQ ID NO: 7644 - DNA, 23 bp, Artificial Sequence
  Synthetic Construct
gaaaagtgggtcaatgggagtca

SEQ ID NO: 7645 - DNA, 18 bp, Artificial Sequence
  Synthetic Construct
tggcacctccggatctca

SEQ ID NO: 7646 - DNA, 22 bp, Artificial Sequence
  Synthetic Construct
ctgtggtgagctcaaggatgtt

SEQ ID NO: 7647 - DNA, 26 bp, Artificial Sequence
  Synthetic Construct
ccatagaacaaatctctgggttgatg

SEQ ID NO: 7648 - DNA, 24 bp, Artificial Sequence
  Synthetic Construct
cctctccacatccagtcatccaat

SEQ ID NO: 7649 - DNA, 21 bp, Artificial Sequence
  Synthetic Construct
gacctggagggctgagtgata

SEQ ID NO: 7650 - DNA, 29 bp, Artificial Sequence
  Synthetic Construct
ctcaaagtaattgttgggattgaatgaga

SEQ ID NO: 7651 - DNA, 24 bp, Artificial Sequence
  Synthetic Construct
ctgaaggcaggttgataagagcat

SEQ ID NO: 7652 - DNA, 27 bp, Artificial Sequence
  Synthetic Construct
cctccagaacttttgttacagtaagga

SEQ ID NO: 7653 - DNA, 22 bp, Artificial Sequence
  Synthetic Construct
agtacggaacaggaggaggaaa

SEQ ID NO: 7654 - DNA, 26 bp, Artificial Sequence
  Synthetic Construct
cctttgtactgcagtctgcttctaac

SEQ ID NO: 7655 - DNA, 21 bp, Artificial Sequence
  Synthetic Construct
aggggtcaagcagcagtttga

SEQ ID NO: 7656 - DNA, 26 bp, Artificial Sequence
  Synthetic Construct
ctctgtgaatattctacccccatcaa

SEQ ID NO: 7657 - DNA, 22 bp, Artificial Sequence
  Synthetic Construct
gctaggcgcataatccttctct

SEQ ID NO: 7658 - DNA, 27 bp, Artificial Sequence
  Synthetic Construct
ccattgagaactttacttcccacatca

SEQ ID NO: 7659 - DNA, 21 bp, Artificial Sequence
  Synthetic Construct
actcacgccgctatccctatt

SEQ ID NO: 7660 - DNA, 20 bp, Artificial Sequence
  Synthetic Construct
cagacactgccacccatctg

SEQ ID NO: 7661 - DNA, 18 bp, Artificial Sequence
  Synthetic Construct
tgctggtgcgaggagaga

SEQ ID NO: 7662 - DNA, 26 bp, Artificial Sequence
  Synthetic Construct
cagccaaaccatatcattcactatgc

SEQ ID NO: 7663 - DNA, 18 bp, Artificial Sequence
  Synthetic Construct
ctggctgccagggagtgt

SEQ ID NO: 7664 - DNA, 22 bp, Artificial Sequence
  Synthetic Construct
gcataagccaggctgtagtaca

SEQ ID NO: 7665 - DNA, 23 bp, Artificial Sequence
  Synthetic Construct
ggaaagaaaagggtgctctggat

SEQ ID NO: 7666 - DNA, 23 bp, Artificial Sequence
  Synthetic Construct
gcagaacccctacaaagaaggta

SEQ ID NO: 7667 - DNA, 25 bp, Artificial Sequence
  Synthetic Construct
ggtggtgttaagaagccaagaagat

SEQ ID NO: 7668 - DNA, 28 bp, Artificial Sequence
  Synthetic Construct
gggtcaggaaaatattgtctggagtgtt

SEQ ID NO: 7669 - DNA, 22 bp, Artificial Sequence
  Synthetic Construct
gcttttgcacttggctccttgt

SEQ ID NO: 7670 - DNA, 24 bp, Artificial Sequence
  Synthetic Construct
tgcctcccaagtaggatagaactc

SEQ ID NO: 7671 - DNA, 25 bp, Artificial Sequence
  Synthetic Construct
ccttctcattgctgagtgtttaacc

SEQ ID NO: 7672 - DNA, 21 bp, Artificial Sequence
  Synthetic Construct
cctctcccctttgagcagaca

SEQ ID NO: 7673 - DNA, 25 bp, Artificial Sequence
  Synthetic Construct
gaggcacaagataaagaggtttagc

SEQ ID NO: 7674 - DNA, 24 bp, Artificial Sequence
  Synthetic Construct
gaataggaatgtgtggagcagaca

SEQ ID NO: 7675 - DNA, 21 bp, Artificial Sequence
  Synthetic Construct
catgtgttgcaagccacatgt

SEQ ID NO: 7676 - DNA, 21 bp, Artificial Sequence
  Synthetic Construct
agccctcccacctggtaacta

SEQ ID NO: 7677 - DNA, 18 bp, Artificial Sequence
  Synthetic Construct
ccctgctgcccacatcag

SEQ ID NO: 7678 - DNA, 20 bp, Artificial Sequence
  Synthetic Construct
tcattgctggcatgcatcca

SEQ ID NO: 7679 - DNA, 24 bp, Artificial Sequence
  Synthetic Construct
cctttgcagtcaccaatgttttgt

SEQ ID NO: 7680 - DNA, 28 bp, Artificial Sequence
  Synthetic Construct
cgagctataagtgatggagctagtatct

SEQ ID NO: 7681 - DNA, 22 bp, Artificial Sequence
  Synthetic Construct
gaactggagctccacacttagg

SEQ ID NO: 7682 - DNA, 26 bp, Artificial Sequence
  Synthetic Construct
ccagttctgaaggaggcatttatcag

SEQ ID NO: 7683 - DNA, 23 bp, Artificial Sequence
  Synthetic Construct
gtgtacccactgtcactcatacc

SEQ ID NO: 7684 - DNA, 23 bp, Artificial Sequence
  Synthetic Construct
gcagattttgacaagggttggaa

SEQ ID NO: 7685 - DNA, 24 bp, Artificial Sequence
  Synthetic Construct
ccacagagctaggaaactcgtgaa

SEQ ID NO: 7686 - DNA, 23 bp, Artificial Sequence
  Synthetic Construct
ttcctcggcccttcttcctgaga

SEQ ID NO: 7687 - DNA, 24 bp, Artificial Sequence
  Synthetic Construct
aggggtgaaacaaatcatgcttct

SEQ ID NO: 7688 - DNA, 24 bp, Artificial Sequence
  Synthetic Construct
aggaaccctgtccttgctttaacc

SEQ ID NO: 7689 - DNA, 25 bp, Artificial Sequence
  Synthetic Construct
ggaaagtctgaacacacacttccat

SEQ ID NO: 7690 - DNA, 22 bp, Artificial Sequence
  Synthetic Construct
aagccaaatacgcacccctaac

SEQ ID NO: 7691 - DNA, 25 bp, Artificial Sequence
  Synthetic Construct
ggcctttcacaaactactccttcct

SEQ ID NO: 7692 - DNA, 23 bp, Artificial Sequence
  Synthetic Construct
gtgtttgtgtgcagacactgtac

SEQ ID NO: 7693 - DNA, 23 bp, Artificial Sequence
  Synthetic Construct
gtgcttgcttgagttctcagcta

SEQ ID NO: 7694 - DNA, 26 bp, Artificial Sequence
  Synthetic Construct
gcaacagcatctttgatagggaacac

SEQ ID NO: 7695 - DNA, 22 bp, Artificial Sequence
  Synthetic Construct
ggctggaaggaaaggcaaacat

SEQ ID NO: 7696 - DNA, 22 bp, Artificial Sequence
  Synthetic Construct
agatccctgctgccctacatta

SEQ ID NO: 7697 - DNA, 23 bp, Artificial Sequence
  Synthetic Construct
cctgagccacccaggactttttg

SEQ ID NO: 7698 - DNA, 26 bp, Artificial Sequence
  Synthetic Construct
ttgccaccaatatcaggagtgtatag

SEQ ID NO: 7699 - DNA, 28 bp, Artificial Sequence
  Synthetic Construct
tgtgagactctttggtacttaagtttgt

SEQ ID NO: 7700 - DNA, 20 bp, Artificial Sequence
  Synthetic Construct
tgcctcacagccaagcttct

SEQ ID NO: 7701 - DNA, 25 bp, Artificial Sequence
  Synthetic Construct
tgaagtaattgacggtctcagttct

SEQ ID NO: 7702 - DNA, 26 bp, Artificial Sequence
  Synthetic Construct
cgtggttatcttgtcaatgggaactc

SEQ ID NO: 7703 - DNA, 29 bp, Artificial Sequence
  Synthetic Construct
ggtcaagatggagcagtattttgatcatc

SEQ ID NO: 7704 - DNA, 22 bp, Artificial Sequence
  Synthetic Construct
aacacctgccagtgtcaatgag

SEQ ID NO: 7705 - DNA, 22 bp, Artificial Sequence
  Synthetic Construct
tgcctggaggtgaggtgtgttt

SEQ ID NO: 7706 - DNA, 23 bp, Artificial Sequence
  Synthetic Construct
agattgaggtggcatttcctgaa

SEQ ID NO: 7707 - DNA, 21 bp, Artificial Sequence
  Synthetic Construct
acacgggggttacagagatga

SEQ ID NO: 7708 - DNA, 25 bp, Artificial Sequence
  Synthetic Construct
tgaaaagtagaagagtctgctgtgt

SEQ ID NO: 7709 - DNA, 25 bp, Artificial Sequence
  Synthetic Construct
ggtttcacagggaggactggagtta

SEQ ID NO: 7710 - DNA, 25 bp, Artificial Sequence
  Synthetic Construct
aggccattgggttaaatatccatca

SEQ ID NO: 7711 - DNA, 22 bp, Artificial Sequence
  Synthetic Construct
gcaaactccacttcagcaggat

SEQ ID NO: 7712 - DNA, 18 bp, Artificial Sequence
  Synthetic Construct
gctttctgccggcaagca

SEQ ID NO: 7713 - DNA, 25 bp, Artificial Sequence
  Synthetic Construct
actaaggcaatggatttcaaatgca

SEQ ID NO: 7714 - DNA, 27 bp, Artificial Sequence
  Synthetic Construct
ccaccaatttcagtagggttttatgca

SEQ ID NO: 7715 - DNA, 26 bp, Artificial Sequence
  Synthetic Construct
ctcagacacacatcatagctctacag

SEQ ID NO: 7716 - DNA, 23 bp, Artificial Sequence
  Synthetic Construct
agatctagaaccaaggccactga

SEQ ID NO: 7717 - DNA, 20 bp, Artificial Sequence
  Synthetic Construct
ccatcagagccacccacact

SEQ ID NO: 7718 - DNA, 24 bp, Artificial Sequence
  Synthetic Construct
ctaaggtggggattcacatcaaca

SEQ ID NO: 7719 - DNA, 22 bp, Artificial Sequence
  Synthetic Construct
ccttgaactgttggctgtagca

SEQ ID NO: 7720 - DNA, 20 bp, Artificial Sequence
  Synthetic Construct
accgttgagctgttgcaact

SEQ ID NO: 7721 - DNA, 24 bp, Artificial Sequence
  Synthetic Construct
ctggtggctcaaaccgttagtgaa

SEQ ID NO: 7722 - DNA, 23 bp, Artificial Sequence
  Synthetic Construct
gacattactggaagctgggttga

SEQ ID NO: 7723 - DNA, 22 bp, Artificial Sequence
  Synthetic Construct
cttgggtgtgtttctcctgtct

SEQ ID NO: 7724 - DNA, 24 bp, Artificial Sequence
  Synthetic Construct
gtaacccttccagtgattgagtca

SEQ ID NO: 7725 - DNA, 21 bp, Artificial Sequence
  Synthetic Construct
cagcccagtgtctcagaacag

SEQ ID NO: 7726 - DNA, 24 bp, Artificial Sequence
  Synthetic Construct
actcagctgaactattgccttctc

SEQ ID NO: 7727 - DNA, 22 bp, Artificial Sequence
  Synthetic Construct
gcgtttgttcaggctcaaagtc

SEQ ID NO: 7728 - DNA, 22 bp, Artificial Sequence
  Synthetic Construct
caggcggtggaattttctgcta

SEQ ID NO: 7729 - DNA, 20 bp, Artificial Sequence
  Synthetic Construct
acaggagccaaaccggtact

SEQ ID NO: 7730 - DNA, 24 bp, Artificial Sequence
  Synthetic Construct
caaccacagaagcagcagaagttg

SEQ ID NO: 7731 - DNA, 24 bp, Artificial Sequence
  Synthetic Construct
cagaggctctgtagagttcagact

SEQ ID NO: 7732 - DNA, 24 bp, Artificial Sequence
  Synthetic Construct
gggtttccctctagctgtttactg

SEQ ID NO: 7733 - DNA, 25 bp, Artificial Sequence
  Synthetic Construct
ctctagataggtgcctgtagcctaa

SEQ ID NO: 7734 - DNA, 22 bp, Artificial Sequence
  Synthetic Construct
gcctaacttgcttgctcctgtt

SEQ ID NO: 7735 - DNA, 24 bp, Artificial Sequence
  Synthetic Construct
agaagccctgcttatactgtcatc

SEQ ID NO: 7736 - DNA, 20 bp, Artificial Sequence
  Synthetic Construct
caccctctggcactctcaga

SEQ ID NO: 7737 - DNA, 22 bp, Artificial Sequence
  Synthetic Construct
ccagatagctgcttcacatggt

SEQ ID NO: 7738 - DNA, 21 bp, Artificial Sequence
  Synthetic Construct
tggcttacctgcaacctgtca

SEQ ID NO: 7739 - DNA, 19 bp, Artificial Sequence
  Synthetic Construct
tgcgaggggcagagacttt

SEQ ID NO: 7740 - DNA, 28 bp, Artificial Sequence
  Synthetic Construct
cctgtcttcaagtttactgaacgttcct

SEQ ID NO: 7741 - DNA, 22 bp, Artificial Sequence
  Synthetic Construct
gagtggcctttgaagtcttgca

SEQ ID NO: 7742 - DNA, 27 bp, Artificial Sequence
  Synthetic Construct
aagaattgctagaaatgtgggaacatc

SEQ ID NO: 7743 - DNA, 24 bp, Artificial Sequence
  Synthetic Construct
ccgctgaacaggttcttgagttga

SEQ ID NO: 7744 - DNA, 22 bp, Artificial Sequence
  Synthetic Construct
gcagcaacaactcattcaggtt

SEQ ID NO: 7745 - DNA, 21 bp, Artificial Sequence
  Synthetic Construct
aagtgcctttcagccattcca

SEQ ID NO: 7746 - DNA, 26 bp, Artificial Sequence
  Synthetic Construct
agtctagatacagcctcagaatcctt

SEQ ID NO: 7747 - DNA, 21 bp, Artificial Sequence
  Synthetic Construct
gcccttgagatctgcccaagt

SEQ ID NO: 7748 - DNA, 26 bp, Artificial Sequence
  Synthetic Construct
ggtagccaaagctccatattcttagc

SEQ ID NO: 7749 - DNA, 22 bp, Artificial Sequence
  Synthetic Construct
cccatgacttccacccaaaacc

SEQ ID NO: 7750 - DNA, 22 bp, Artificial Sequence
  Synthetic Construct
ggcctgtctgcaatctctttgt

SEQ ID NO: 7751 - DNA, 20 bp, Artificial Sequence
  Synthetic Construct
atccggccgtgattccattt

SEQ ID NO: 7752 - DNA, 22 bp, Artificial Sequence
  Synthetic Construct
gcaataccagaccctgtggaat

SEQ ID NO: 7753 - DNA, 25 bp, Artificial Sequence
  Synthetic Construct
caagaacagccaacaggaaatgatg

SEQ ID NO: 7754 - DNA, 22 bp, Artificial Sequence
  Synthetic Construct
ctgcacgcatgatcagttatgg

SEQ ID NO: 7755 - DNA, 22 bp, Artificial Sequence
  Synthetic Construct
tgtgcacacacacttccctctt

SEQ ID NO: 7756 - DNA, 22 bp, Artificial Sequence
  Synthetic Construct
tccatcccctggtgtatgaaca

SEQ ID NO: 7757 - DNA, 23 bp, Artificial Sequence
  Synthetic Construct
gtgtccctgtgtcttcagcaata

SEQ ID NO: 7758 - DNA, 28 bp, Artificial Sequence
  Synthetic Construct
agcattgacacagtttatcatacaacag

SEQ ID NO: 7759 - DNA, 20 bp, Artificial Sequence
  Synthetic Construct
tgcagctgcagaaacgatca

SEQ ID NO: 7760 - DNA, 26 bp, Artificial Sequence
  Synthetic Construct
gcctcctgtctctcatatccatgaac

SEQ ID NO: 7761 - DNA, 20 bp, Artificial Sequence
  Synthetic Construct
ggctcctcctgctccaactt

SEQ ID NO: 7762 - DNA, 21 bp, Artificial Sequence
  Synthetic Construct
tggccgctgaactcttccttt

SEQ ID NO: 7763 - DNA, 26 bp, Artificial Sequence
  Synthetic Construct
gcattcaattaaccagaggggagaca

SEQ ID NO: 7764 - DNA, 26 bp, Artificial Sequence
  Synthetic Construct
gcatgtgacctagggagataccagat

SEQ ID NO: 7765 - DNA, 25 bp, Artificial Sequence
  Synthetic Construct
gagtcctgctctctggaatgattct

SEQ ID NO: 7766 - DNA, 22 bp, Artificial Sequence
  Synthetic Construct
cagagccacacctgaactgttt

SEQ ID NO: 7767 - DNA, 26 bp, Artificial Sequence
  Synthetic Construct
ggttgtatgtgtagttgtgtgtgctt

SEQ ID NO: 7768 - DNA, 26 bp, Artificial Sequence
  Synthetic Construct
gtaaggctttctgggataggagatag

SEQ ID NO: 7769 - DNA, 26 bp, Artificial Sequence
  Synthetic Construct
ggcccagactagaaagggattatcca

SEQ ID NO: 7770 - DNA, 25 bp, Artificial Sequence
  Synthetic Construct
caagagatgctgctgttgatgttag

SEQ ID NO: 7771 - DNA, 27 bp, Artificial Sequence
  Synthetic Construct
gcagaatgctaagggaggttgttaagg

SEQ ID NO: 7772 - DNA, 25 bp, Artificial Sequence
  Synthetic Construct
ggtgagcctaaagtccatgcatgat

SEQ ID NO: 7773 - DNA, 26 bp, Artificial Sequence
  Synthetic Construct
cagccaagtatgcgtttaaacttctc

SEQ ID NO: 7774 - DNA, 22 bp, Artificial Sequence
  Synthetic Construct
agcaaggagcaatgaacagcta

SEQ ID NO: 7775 - DNA, 27 bp, Artificial Sequence
  Synthetic Construct
aggcatacattttaactaggacaccaa

SEQ ID NO: 7776 - DNA, 22 bp, Artificial Sequence
  Synthetic Construct
gcattggtgtgaaagcctgctt

SEQ ID NO: 7777 - DNA, 20 bp, Artificial Sequence
  Synthetic Construct
aggccatccaccactgaaca

SEQ ID NO: 7778 - DNA, 25 bp, Artificial Sequence
  Synthetic Construct
tctccatggtactaacccattctct

SEQ ID NO: 7779 - DNA, 20 bp, Artificial Sequence
  Synthetic Construct
actcctccgttggtgtgttc

SEQ ID NO: 7780 - DNA, 21 bp, Artificial Sequence
  Synthetic Construct
cctgctgggattctgctctca

SEQ ID NO: 7781 - DNA, 18 bp, Artificial Sequence
  Synthetic Construct
ctcacccctggccctctt

SEQ ID NO: 7782 - DNA, 27 bp, Artificial Sequence
  Synthetic Construct
gcataatgtaacaggtaggggtacttc

SEQ ID NO: 7783 - DNA, 20 bp, Artificial Sequence
  Synthetic Construct
tgcggtcccatttctgaaca

SEQ ID NO: 7784 - DNA, 24 bp, Artificial Sequence
  Synthetic Construct
cccagatggatgagtctgaagctt

SEQ ID NO: 7785 - DNA, 26 bp, Artificial Sequence
  Synthetic Construct
ggaactccatcaattaaacagttgca

SEQ ID NO: 7786 - DNA, 22 bp, Artificial Sequence
  Synthetic Construct
tgcagactgaccctgtgacttt

SEQ ID NO: 7787 - DNA, 25 bp, Artificial Sequence
  Synthetic Construct
gtcattcaaggccatagaggtacag

SEQ ID NO: 7788 - DNA, 24 bp, Artificial Sequence
  Synthetic Construct
gggagaggatggggattaaagcat

SEQ ID NO: 7789 - DNA, 23 bp, Artificial Sequence
  Synthetic Construct
catgggctaagaggacacattct

SEQ ID NO: 7790 - DNA, 22 bp, Artificial Sequence
  Synthetic Construct
gcctcaggaacttgagtccttt

SEQ ID NO: 7791 - DNA, 26 bp, Artificial Sequence
  Synthetic Construct
ccagtaagaacatgctagaacactca

SEQ ID NO: 7792 - DNA, 20 bp, Artificial Sequence
  Synthetic Construct
tcctgccctgtgagccttct

SEQ ID NO: 7793 - DNA, 23 bp, Artificial Sequence
  Synthetic Construct
tctaaagagccctcctcccatct

SEQ ID NO: 7794 - DNA, 24 bp, Artificial Sequence
  Synthetic Construct
agcaaagaccatgttcctcatgtt

SEQ ID NO: 7795 - DNA, 24 bp, Artificial Sequence
  Synthetic Construct
accctcatctcaggcctttatctg

SEQ ID NO: 7796 - DNA, 25 bp, Artificial Sequence
  Synthetic Construct
gttagtcttctctctgccaggaaac

SEQ ID NO: 7797 - DNA, 22 bp, Artificial Sequence
  Synthetic Construct
ccagcgtttgttcacagtgtgt

SEQ ID NO: 7798 - DNA, 26 bp, Artificial Sequence
  Synthetic Construct
agtggcaactatctttcatcttagct

SEQ ID NO: 7799 - DNA, 24 bp, Artificial Sequence
  Synthetic Construct
gcagtggaatgagtgaaggtacag

SEQ ID NO: 7800 - DNA, 23 bp, Artificial Sequence
  Synthetic Construct
caaggctcaagttcagagaggtt

SEQ ID NO: 7801 - DNA, 25 bp, Artificial Sequence
  Synthetic Construct
gctacatcctgcatttccacatagc

SEQ ID NO: 7802 - DNA, 24 bp, Artificial Sequence
  Synthetic Construct
cctttgggaacatggtttggaaag

SEQ ID NO: 7803 - DNA, 22 bp, Artificial Sequence
  Synthetic Construct
aaggcgcacattagtcccataa

SEQ ID NO: 7804 - DNA, 24 bp, Artificial Sequence
  Synthetic Construct
ccaaccccacagactgtcaacatt

SEQ ID NO: 7805 - DNA, 24 bp, Artificial Sequence
  Synthetic Construct
cccggttattctgtggcctattgt

SEQ ID NO: 7806 - DNA, 22 bp, Artificial Sequence
  Synthetic Construct
tcaggggaagcagcatcattag

SEQ ID NO: 7807 - DNA, 21 bp, Artificial Sequence
  Synthetic Construct
tctggttccacaggagggtaa

SEQ ID NO: 7808 - DNA, 26 bp, Artificial Sequence
  Synthetic Construct
gtactatctgggctcaatgatactgt

SEQ ID NO: 7809 - DNA, 23 bp, Artificial Sequence
  Synthetic Construct
gcagaagtggggatgtgagaatt

SEQ ID NO: 7810 - DNA, 22 bp, Artificial Sequence
  Synthetic Construct
cagagtgccatgcattgtggta

SEQ ID NO: 7811 - DNA, 22 bp, Artificial Sequence
  Synthetic Construct
gctacctgggctgtggtatctt

SEQ ID NO: 7812 - DNA, 29 bp, Artificial Sequence
  Synthetic Construct
atgtctagagctctacataatagcttctg

SEQ ID NO: 7813 - DNA, 22 bp, Artificial Sequence
  Synthetic Construct
caccttgcatccacttgagact

SEQ ID NO: 7814 - DNA, 21 bp, Artificial Sequence
  Synthetic Construct
ccaacttcccctctccagtct

SEQ ID NO: 7815 - DNA, 26 bp, Artificial Sequence
  Synthetic Construct
cattaacccatcattcagcttcaaca

SEQ ID NO: 7816 - DNA, 22 bp, Artificial Sequence
  Synthetic Construct
agtttgcccctagagctgaaac

SEQ ID NO: 7817 - DNA, 22 bp, Artificial Sequence
  Synthetic Construct
acgtaggagctccacaacctaa

SEQ ID NO: 7818 - DNA, 23 bp, Artificial Sequence
  Synthetic Construct
acttggcataaaaccccacgtaa

SEQ ID NO: 7819 - DNA, 22 bp, Artificial Sequence
  Synthetic Construct
gaagccccagtcctacttgaaa

SEQ ID NO: 7820 - DNA, 23 bp, Artificial Sequence
  Synthetic Construct
ctacacttgtggagctgtctgaa

SEQ ID NO: 7821 - DNA, 19 bp, Artificial Sequence
  Synthetic Construct
tggctccactccggcacaa

SEQ ID NO: 7822 - DNA, 22 bp, Artificial Sequence
  Synthetic Construct
cctcctgacctgttcacagtga

SEQ ID NO: 7823 - DNA, 22 bp, Artificial Sequence
  Synthetic Construct
gtgcccaaactattcccactgt

SEQ ID NO: 7824 - DNA, 25 bp, Artificial Sequence
  Synthetic Construct
ttggtaacctgacttcaacacctaa

SEQ ID NO: 7825 - DNA, 22 bp, Artificial Sequence
  Synthetic Construct
gcatgggccaagacatacacaa

SEQ ID NO: 7826 - DNA, 22 bp, Artificial Sequence
  Synthetic Construct
tttgggcaaggcggtttcctta

SEQ ID NO: 7827 - DNA, 25 bp, Artificial Sequence
  Synthetic Construct
ggtctgtactcaagtacacatgctt

SEQ ID NO: 7828 - DNA, 20 bp, Artificial Sequence
  Synthetic Construct
tgccagccagtcacagaagt

SEQ ID NO: 7829 - DNA, 28 bp, Artificial Sequence
  Synthetic Construct
aatgtcactcttacccattgcattaatc

SEQ ID NO: 7830 - DNA, 22 bp, Artificial Sequence
  Synthetic Construct
ggtaggcaaagcttgggtatct

SEQ ID NO: 7831 - DNA, 23 bp, Artificial Sequence
  Synthetic Construct
tcctgtgcttgggatctgagtca

SEQ ID NO: 7832 - DNA, 23 bp, Artificial Sequence
  Synthetic Construct
gcagcttcagtattggggatttc

SEQ ID NO: 7833 - DNA, 26 bp, Artificial Sequence
  Synthetic Construct
gggtacaattagccatgacccatctg

SEQ ID NO: 7834 - DNA, 29 bp, Artificial Sequence
  Synthetic Construct
gactagaaaaatgtaatcagtccccaagt

SEQ ID NO: 7835 - DNA, 22 bp, Artificial Sequence
  Synthetic Construct
acactgaccagaaccacaagtt

SEQ ID NO: 7836 - DNA, 22 bp, Artificial Sequence
  Synthetic Construct
ccaaatttctggcctccacttg

SEQ ID NO: 7837 - DNA, 22 bp, Artificial Sequence
  Synthetic Construct
tcagcaatgcagtgtgttcaga

SEQ ID NO: 7838 - DNA, 22 bp, Artificial Sequence
  Synthetic Construct
gaatggccacactcaagcttct

SEQ ID NO: 7839 - DNA, 21 bp, Artificial Sequence
  Synthetic Construct
aggccgtccaggtagagtaga

SEQ ID NO: 7840 - DNA, 20 bp, Artificial Sequence
  Synthetic Construct
tggccaccctgagatgtcat

SEQ ID NO: 7841 - DNA, 22 bp, Artificial Sequence
  Synthetic Construct
tgcctgtcagtcacatgcttct

SEQ ID NO: 7842 - DNA, 24 bp, Artificial Sequence
  Synthetic Construct
gacaaatgtctgcttcaacaagct

SEQ ID NO: 7843 - DNA, 26 bp, Artificial Sequence
  Synthetic Construct
agtggggtatcagtatcttcctcatt

SEQ ID NO: 7844 - DNA, 22 bp, Artificial Sequence
  Synthetic Construct
ttcccccactgatccattgctt

SEQ ID NO: 7845 - DNA, 20 bp, Artificial Sequence
  Synthetic Construct
tcctctcccggtctctacct

SEQ ID NO: 7846 - DNA, 22 bp, Artificial Sequence
  Synthetic Construct
tccaggagtggagatgtcacat

SEQ ID NO: 7847 - DNA, 24 bp, Artificial Sequence
  Synthetic Construct
gactggtgtgtgtctctgaaagtc

SEQ ID NO: 7848 - DNA, 22 bp, Artificial Sequence
  Synthetic Construct
tgaggacagagggcatattcct

SEQ ID NO: 7849 - DNA, 18 bp, Artificial Sequence
  Synthetic Construct
ggaccggcagcagaacca

SEQ ID NO: 7850 - DNA, 22 bp, Artificial Sequence
  Synthetic Construct
cagcaccactttgcactacttc

SEQ ID NO: 7851 - DNA, 22 bp, Artificial Sequence
  Synthetic Construct
ctgacctcagacatgcaggatt

SEQ ID NO: 7852 - DNA, 21 bp, Artificial Sequence
  Synthetic Construct
tgcctccccacaatccgttct

SEQ ID NO: 7853 - DNA, 23 bp, Artificial Sequence
  Synthetic Construct
ctgtgcattacctccatccttgt

SEQ ID NO: 7854 - DNA, 24 bp, Artificial Sequence
  Synthetic Construct
acatcacacagagtcctttgctaa

SEQ ID NO: 7855 - DNA, 25 bp, Artificial Sequence
  Synthetic Construct
agtatggcatgggagactaatttgg

SEQ ID NO: 7856 - DNA, 22 bp, Artificial Sequence
  Synthetic Construct
tggacgtgatgggtagaatcca

SEQ ID NO: 7857 - DNA, 23 bp, Artificial Sequence
  Synthetic Construct
ggtgctttagaaggcccttaaca

SEQ ID NO: 7858 - DNA, 28 bp, Artificial Sequence
  Synthetic Construct
acctttgtaacctaagatagggtagact

SEQ ID NO: 7859 - DNA, 22 bp, Artificial Sequence
  Synthetic Construct
accgtctccttctccaagttct

SEQ ID NO: 7860 - DNA, 20 bp, Artificial Sequence
  Synthetic Construct
cagccaggtcagcaggttca

SEQ ID NO: 7861 - DNA, 19 bp, Artificial Sequence
  Synthetic Construct
aggaagccgcagagccata

SEQ ID NO: 7862 - DNA, 23 bp, Artificial Sequence
  Synthetic Construct
ggctgagacttgaactcttctgt

SEQ ID NO: 7863 - DNA, 19 bp, Artificial Sequence
  Synthetic Construct
tgggtccgtgccacagtga

SEQ ID NO: 7864 - DNA, 26 bp, Artificial Sequence
  Synthetic Construct
ggatttagggacccagcttcttactg

SEQ ID NO: 7865 - DNA, 24 bp, Artificial Sequence
  Synthetic Construct
agacagtttgccagtcattatcca

SEQ ID NO: 7866 - DNA, 26 bp, Artificial Sequence
  Synthetic Construct
cctctagaaggaggggatagtcagat

SEQ ID NO: 7867 - DNA, 24 bp, Artificial Sequence
  Synthetic Construct
gacctggtattggtgaccctaaga

SEQ ID NO: 7868 - DNA, 25 bp, Artificial Sequence
  Synthetic Construct
gctcggaggtgactatcttctacag

SEQ ID NO: 7869 - DNA, 22 bp, Artificial Sequence
  Synthetic Construct
ccaaccactccctcatgctaca

SEQ ID NO: 7870 - DNA, 27 bp, Artificial Sequence
  Synthetic Construct
ccactgctatttctttgttgtgacaca

SEQ ID NO: 7871 - DNA, 26 bp, Artificial Sequence
  Synthetic Construct
gctgactatatgcttctgctgaactg

SEQ ID NO: 7872 - DNA, 24 bp, Artificial Sequence
  Synthetic Construct
gccacaaagtagttgccagatcac

SEQ ID NO: 7873 - DNA, 21 bp, Artificial Sequence
  Synthetic Construct
tgggagcatggatggtgatca

SEQ ID NO: 7874 - DNA, 26 bp, Artificial Sequence
  Synthetic Construct
ctgcacatccttaattcttcctgtct

SEQ ID NO: 7875 - DNA, 21 bp, Artificial Sequence
  Synthetic Construct
tgctgtgctaggtggctttag

SEQ ID NO: 7876 - DNA, 21 bp, Artificial Sequence
  Synthetic Construct
aaaccctggcacacagaatca

SEQ ID NO: 7877 - DNA, 20 bp, Artificial Sequence
  Synthetic Construct
tggagaccctggggcttgtg

SEQ ID NO: 7878 - DNA, 22 bp, Artificial Sequence
  Synthetic Construct
acaccttagcagcactgaacac

SEQ ID NO: 7879 - DNA, 21 bp, Artificial Sequence
  Synthetic Construct
gaacacccgagccattctgaa

SEQ ID NO: 7880 - DNA, 26 bp, Artificial Sequence
  Synthetic Construct
ccagtgtaactatttgagctggacta

SEQ ID NO: 7881 - DNA, 24 bp, Artificial Sequence
  Synthetic Construct
tcttgcttgaggctgatctctatg

SEQ ID NO: 7882 - DNA, 22 bp, Artificial Sequence
  Synthetic Construct
aacagggtctggaagggctttt

SEQ ID NO: 7883 - DNA, 25 bp, Artificial Sequence
  Synthetic Construct
ggtgtgtatgaagccaagtctagga

SEQ ID NO: 7884 - DNA, 21 bp, Artificial Sequence
  Synthetic Construct
tgatgcagctctctcctgtca

SEQ ID NO: 7885 - DNA, 28 bp, Artificial Sequence
  Synthetic Construct
gagataggtcatctcttgaagacagagt

SEQ ID NO: 7886 - DNA, 24 bp, Artificial Sequence
  Synthetic Construct
gcaacggaggcagttctagatctt

SEQ ID NO: 7887 - DNA, 23 bp, Artificial Sequence
  Synthetic Construct
gctctggaaggtacaagccataa

SEQ ID NO: 7888 - DNA, 21 bp, Artificial Sequence
  Synthetic Construct
ctaggccccacccacaaaacc

SEQ ID NO: 7889 - DNA, 21 bp, Artificial Sequence
  Synthetic Construct
cacaccatccaacctgagcaa

SEQ ID NO: 7890 - DNA, 25 bp, Artificial Sequence
  Synthetic Construct
gtttgaccaaatacctgtggaccta

SEQ ID NO: 7891 - DNA, 22 bp, Artificial Sequence
  Synthetic Construct
ctcctgctccttcacacacaaa

SEQ ID NO: 7892 - DNA, 24 bp, Artificial Sequence
  Synthetic Construct
tccactctaaagctttcccattcc

SEQ ID NO: 7893 - DNA, 25 bp, Artificial Sequence
  Synthetic Construct
agcattccaatgtcacttgattgtg

SEQ ID NO: 7894 - DNA, 21 bp, Artificial Sequence
  Synthetic Construct
aatgtgtggcagggacagcaa

SEQ ID NO: 7895 - DNA, 25 bp, Artificial Sequence
  Synthetic Construct
cctttaggggacaacttttcatgga

SEQ ID NO: 7896 - DNA, 19 bp, Artificial Sequence
  Synthetic Construct
cagggtgaaccagcaagct

SEQ ID NO: 7897 - DNA, 22 bp, Artificial Sequence
  Synthetic Construct
agggcagggaccttatttacct

SEQ ID NO: 7898 - DNA, 23 bp, Artificial Sequence
  Synthetic Construct
tggaccatctgaaggcctactga

SEQ ID NO: 7899 - DNA, 25 bp, Artificial Sequence
  Synthetic Construct
cccactgaacctgcagacattattt

SEQ ID NO: 7900 - DNA, 24 bp, Artificial Sequence
  Synthetic Construct
caagaggagaaagtgtggatttgc

SEQ ID NO: 7901 - DNA, 23 bp, Artificial Sequence
  Synthetic Construct
catgcaggagcttagagactgat

SEQ ID NO: 7902 - DNA, 21 bp, Artificial Sequence
  Synthetic Construct
ttggacccgaatgcagatctg

SEQ ID NO: 7903 - DNA, 24 bp, Artificial Sequence
  Synthetic Construct
tggagcccagagaggttttatgtc

SEQ ID NO: 7904 - DNA, 22 bp, Artificial Sequence
  Synthetic Construct
tcctcagcttgtggacacaaac

SEQ ID NO: 7905 - DNA, 21 bp, Artificial Sequence
  Synthetic Construct
caaaaaggcagcacacacgat

SEQ ID NO: 7906 - DNA, 22 bp, Artificial Sequence
  Synthetic Construct
gggtaggaggaggacacagtac

SEQ ID NO: 7907 - DNA, 24 bp, Artificial Sequence
  Synthetic Construct
gcactaccaaaacctctcctccaa

SEQ ID NO: 7908 - DNA, 25 bp, Artificial Sequence
  Synthetic Construct
ggcttagagcaataggagtttgttc

SEQ ID NO: 7909 - DNA, 27 bp, Artificial Sequence
  Synthetic Construct
gtggtaactgtttagtccacacttagg

SEQ ID NO: 7910 - DNA, 21 bp, Artificial Sequence
  Synthetic Construct
caaagctgtggtgacccagat

SEQ ID NO: 7911 - DNA, 24 bp, Artificial Sequence
  Synthetic Construct
ggaatagaaggcagggaacacttc

SEQ ID NO: 7912 - DNA, 22 bp, Artificial Sequence
  Synthetic Construct
ctgtcaacagggctttcaagct

SEQ ID NO: 7913 - DNA, 24 bp, Artificial Sequence
  Synthetic Construct
gccatcattcagaggagctttcga

SEQ ID NO: 7914 - DNA, 24 bp, Artificial Sequence
  Synthetic Construct
gtcaacagcctgcctctttttatg

SEQ ID NO: 7915 - DNA, 22 bp, Artificial Sequence
  Synthetic Construct
gtgcatctccaatccaggtgat

SEQ ID NO: 7916 - DNA, 24 bp, Artificial Sequence
  Synthetic Construct
gacctggagatttcttctcacctt

SEQ ID NO: 7917 - DNA, 22 bp, Artificial Sequence
  Synthetic Construct
acctgacttcccatgcttaagc

SEQ ID NO: 7918 - DNA, 27 bp, Artificial Sequence
  Synthetic Construct
ccaaagtttgaaaaggatagagcttga

SEQ ID NO: 7919 - DNA, 22 bp, Artificial Sequence
  Synthetic Construct
tctccagccagtctacctctca

SEQ ID NO: 7920 - DNA, 24 bp, Artificial Sequence
  Synthetic Construct
gataggggcagagtcttcctaaac

SEQ ID NO: 7921 - DNA, 18 bp, Artificial Sequence
  Synthetic Construct
tggctgacccgggtagct

SEQ ID NO: 7922 - DNA, 24 bp, Artificial Sequence
  Synthetic Construct
ggtgtgacttacagccagatgatc

SEQ ID NO: 7923 - DNA, 27 bp, Artificial Sequence
  Synthetic Construct
ctgcacattgtggcctaccctctctta

SEQ ID NO: 7924 - DNA, 22 bp, Artificial Sequence
  Synthetic Construct
tgggattgtgctcctgctaagt

SEQ ID NO: 7925 - DNA, 25 bp, Artificial Sequence
  Synthetic Construct
aaacagacttcatttccccaatcac

SEQ ID NO: 7926 - DNA, 27 bp, Artificial Sequence
  Synthetic Construct
gcttaaaaagaaggtttgcatcccata

SEQ ID NO: 7927 - DNA, 26 bp, Artificial Sequence
  Synthetic Construct
gtgaccataaagatgcgtctctttcc

SEQ ID NO: 7928 - DNA, 24 bp, Artificial Sequence
  Synthetic Construct
cccatcccacctttctacagcatt

SEQ ID NO: 7929 - DNA, 20 bp, Artificial Sequence
  Synthetic Construct
ttctggcccctctccctaca

SEQ ID NO: 7930 - DNA, 23 bp, Artificial Sequence
  Synthetic Construct
atgggaagaaagccatagagcaa

SEQ ID NO: 7931 - DNA, 20 bp, Artificial Sequence
  Synthetic Construct
tgcttgactcacgccttcca

SEQ ID NO: 7932 - DNA, 21 bp, Artificial Sequence
  Synthetic Construct
aagactggggacgggatactt

SEQ ID NO: 7933 - DNA, 24 bp, Artificial Sequence
  Synthetic Construct
ccaggaactctagggaagacagaa

SEQ ID NO: 7934 - DNA, 23 bp, Artificial Sequence
  Synthetic Construct
cacccagataacacactctggaa

SEQ ID NO: 7935 - DNA, 22 bp, Artificial Sequence
  Synthetic Construct
cagcaaggcttcttctggtcaa

SEQ ID NO: 7936 - DNA, 21 bp, Artificial Sequence
  Synthetic Construct
tgccagcgaaccctagaagga

SEQ ID NO: 7937 - DNA, 26 bp, Artificial Sequence
  Synthetic Construct
accagcccaatattatccccaatatg

SEQ ID NO: 7938 - DNA, 23 bp, Artificial Sequence
  Synthetic Construct
agcccagattcctgagggcttta

SEQ ID NO: 7939 - DNA, 22 bp, Artificial Sequence
  Synthetic Construct
tgctccacttcagtgactaggt

SEQ ID NO: 7940 - DNA, 19 bp, Artificial Sequence
  Synthetic Construct
agagctgtgctgccttctg

SEQ ID NO: 7941 - DNA, 27 bp, Artificial Sequence
  Synthetic Construct
gctccttctattttgagggtcaaggtt

SEQ ID NO: 7942 - DNA, 23 bp, Artificial Sequence
  Synthetic Construct
cctcttgggaaacagctctttgg

SEQ ID NO: 7943 - DNA, 24 bp, Artificial Sequence
  Synthetic Construct
cgtctctctccctgatacattcct

SEQ ID NO: 7944 - DNA, 20 bp, Artificial Sequence
  Synthetic Construct
acggctctttccacccatca

SEQ ID NO: 7945 - DNA, 22 bp, Artificial Sequence
  Synthetic Construct
aggcccatgtctgagctggtaa

SEQ ID NO: 7946 - DNA, 22 bp, Artificial Sequence
  Synthetic Construct
tcactgtgcccagcctttgtaa

SEQ ID NO: 7947 - DNA, 24 bp, Artificial Sequence
  Synthetic Construct
actacaggattcggagagggaaac

SEQ ID NO: 7948 - DNA, 22 bp, Artificial Sequence
  Synthetic Construct
ggaacgcttgtctttggattgg

SEQ ID NO: 7949 - DNA, 25 bp, Artificial Sequence
  Synthetic Construct
gaaaggatgttcataggggagtgat

SEQ ID NO: 7950 - DNA, 21 bp, Artificial Sequence
  Synthetic Construct
aggctggaggaggacacattt

SEQ ID NO: 7951 - DNA, 23 bp, Artificial Sequence
  Synthetic Construct
tgtcttcatgtgtatggctgtgt

SEQ ID NO: 7952 - DNA, 22 bp, Artificial Sequence
  Synthetic Construct
gggtcaacagatgcatgtgaag

SEQ ID NO: 7953 - DNA, 23 bp, Artificial Sequence
  Synthetic Construct
caccacacctggcctattttcct

SEQ ID NO: 7954 - DNA, 20 bp, Artificial Sequence
  Synthetic Construct
accaggtggctgggtgacat

SEQ ID NO: 7955 - DNA, 26 bp, Artificial Sequence
  Synthetic Construct
cctacagtgatcatgatgaactgcta

SEQ ID NO: 7956 - DNA, 30 bp, Artificial Sequence
  Synthetic Construct
ctgttcttattttaggtgcatagggttatg

SEQ ID NO: 7957 - DNA, 19 bp, Artificial Sequence
  Synthetic Construct
acttccccaaccccactct

SEQ ID NO: 7958 - DNA, 22 bp, Artificial Sequence
  Synthetic Construct
cagctccaggaattgctgtact

SEQ ID NO: 7959 - DNA, 24 bp, Artificial Sequence
  Synthetic Construct
acctgggtcttcattctggagaga

SEQ ID NO: 7960 - DNA, 23 bp, Artificial Sequence
  Synthetic Construct
actctttcctgcttcaactgcaa

SEQ ID NO: 7961 - DNA, 26 bp, Artificial Sequence
  Synthetic Construct
ccctaaaacacaaccttgatcatgct

SEQ ID NO: 7962 - DNA, 24 bp, Artificial Sequence
  Synthetic Construct
ccttccctcaaatcactgctgctt

SEQ ID NO: 7963 - DNA, 22 bp, Artificial Sequence
  Synthetic Construct
aggaggaacccaggcaaatagg

SEQ ID NO: 7964 - DNA, 23 bp, Artificial Sequence
  Synthetic Construct
agtcagtggcctgagttctagtc

SEQ ID NO: 7965 - DNA, 24 bp, Artificial Sequence
  Synthetic Construct
cctggaagacagaaagctcattcc

SEQ ID NO: 7966 - DNA, 20 bp, Artificial Sequence
  Synthetic Construct
tcccccatgccttccaaatc

SEQ ID NO: 7967 - DNA, 26 bp, Artificial Sequence
  Synthetic Construct
ctcttgttgattggactctgctagtg

SEQ ID NO: 7968 - DNA, 23 bp, Artificial Sequence
  Synthetic Construct
tggagggacctggaattccatgt

SEQ ID NO: 7969 - DNA, 25 bp, Artificial Sequence
  Synthetic Construct
gggatccatagttacccttctccta

SEQ ID NO: 7970 - DNA, 23 bp, Artificial Sequence
  Synthetic Construct
ccctacctcttagcccagaaact

SEQ ID NO: 7971 - DNA, 25 bp, Artificial Sequence
  Synthetic Construct
ctgcagtgtcactttacttctctgt

SEQ ID NO: 7972 - DNA, 22 bp, Artificial Sequence
  Synthetic Construct
tcactctgtccactcctcagtt

SEQ ID NO: 7973 - DNA, 24 bp, Artificial Sequence
  Synthetic Construct
ccaaccatggcttgagatcttcac

SEQ ID NO: 7974 - DNA, 20 bp, Artificial Sequence
  Synthetic Construct
atttcacggcagaggtgtgt

SEQ ID NO: 7975 - DNA, 24 bp, Artificial Sequence
  Synthetic Construct
ggctggtactgtgggtgattacaa

SEQ ID NO: 7976 - DNA, 23 bp, Artificial Sequence
  Synthetic Construct
gagagaggcctgggtcagatcct

SEQ ID NO: 7977 - DNA, 24 bp, Artificial Sequence
  Synthetic Construct
gctctttcacatgtgggagtagct

SEQ ID NO: 7978 - DNA, 22 bp, Artificial Sequence
  Synthetic Construct
ccaggtcatgcacaaagaccta

SEQ ID NO: 7979 - DNA, 25 bp, Artificial Sequence
  Synthetic Construct
cgaagcccatgtttagtcacttagt

SEQ ID NO: 7980 - DNA, 25 bp, Artificial Sequence
  Synthetic Construct
gagtggttctagggaagtcacactt

SEQ ID NO: 7981 - DNA, 26 bp, Artificial Sequence
  Synthetic Construct
caatcatgttttggagactggaggat

SEQ ID NO: 7982 - DNA, 22 bp, Artificial Sequence
  Synthetic Construct
cagccttccacaacatgaacca

SEQ ID NO: 7983 - DNA, 21 bp, Artificial Sequence
  Synthetic Construct
ccacttgcagaagaggtgcat

SEQ ID NO: 7984 - DNA, 22 bp, Artificial Sequence
  Synthetic Construct
gttcccacacagttaccaagct

SEQ ID NO: 7985 - DNA, 22 bp, Artificial Sequence
  Synthetic Construct
tgcactaagggaaagggaacac

SEQ ID NO: 7986 - DNA, 25 bp, Artificial Sequence
  Synthetic Construct
ccaatttgggattccaatgctactt

SEQ ID NO: 7987 - DNA, 22 bp, Artificial Sequence
  Synthetic Construct
cagttacgctcactggatggat

SEQ ID NO: 7988 - DNA, 26 bp, Artificial Sequence
  Synthetic Construct
gcatgaggactactctgggtctattg

SEQ ID NO: 7989 - DNA, 22 bp, Artificial Sequence
  Synthetic Construct
cctgatgggaacaggcattctt

SEQ ID NO: 7990 - DNA, 23 bp, Artificial Sequence
  Synthetic Construct
gaagcagcctgaggttaatctct

SEQ ID NO: 7991 - DNA, 24 bp, Artificial Sequence
  Synthetic Construct
ccttacttgtgggagtgacatggt

SEQ ID NO: 7992 - DNA, 21 bp, Artificial Sequence
  Synthetic Construct
aggtaaccgaggctgggagtt

SEQ ID NO: 7993 - DNA, 22 bp, Artificial Sequence
  Synthetic Construct
ttgagcaggaccatctcctttg

SEQ ID NO: 7994 - DNA, 23 bp, Artificial Sequence
  Synthetic Construct
tcaataaatggcagccaccatca

SEQ ID NO: 7995 - DNA, 20 bp, Artificial Sequence
  Synthetic Construct
tgcctgcatctcctcccttt

SEQ ID NO: 7996 - DNA, 24 bp, Artificial Sequence
  Synthetic Construct
ggaggtcagacacaggacaaacaa

SEQ ID NO: 7997 - DNA, 18 bp, Artificial Sequence
  Synthetic Construct
tcgccacccagctcaaca

SEQ ID NO: 7998 - DNA, 24 bp, Artificial Sequence
  Synthetic Construct
gctgccgtgttaaaaaaccatggt

SEQ ID NO: 7999 - DNA, 24 bp, Artificial Sequence
  Synthetic Construct
cagctgagctcatctcttcctctt

SEQ ID NO: 8000 - DNA, 22 bp, Artificial Sequence
  Synthetic Construct
ggcctagaagagctctgagaca

SEQ ID NO: 8001 - DNA, 20 bp, Artificial Sequence
  Synthetic Construct
acggtagttccccccttacc

SEQ ID NO: 8002 - DNA, 23 bp, Artificial Sequence
  Synthetic Construct
caaatatgcagtcagcccttgtc

SEQ ID NO: 8003 - DNA, 22 bp, Artificial Sequence
  Synthetic Construct
ccacagcattcccagtctacct

SEQ ID NO: 8004 - DNA, 25 bp, Artificial Sequence
  Synthetic Construct
agctcctggattaaaaggcacatag

SEQ ID NO: 8005 - DNA, 23 bp, Artificial Sequence
  Synthetic Construct
agactgctgctgagtttttgagt

SEQ ID NO: 8006 - DNA, 23 bp, Artificial Sequence
  Synthetic Construct
gaagccgggtatggaaatagtga

SEQ ID NO: 8007 - DNA, 24 bp, Artificial Sequence
  Synthetic Construct
gggtcagtcaacaccaggagttaa

SEQ ID NO: 8008 - DNA, 23 bp, Artificial Sequence
  Synthetic Construct
tcagtttcccccctacacaatgg

SEQ ID NO: 8009 - DNA, 27 bp, Artificial Sequence
  Synthetic Construct
tgtatagataggggtcttgccattttg

SEQ ID NO: 8010 - DNA, 21 bp, Artificial Sequence
  Synthetic Construct
ggtggaacggatttgggcata

SEQ ID NO: 8011 - DNA, 21 bp, Artificial Sequence
  Synthetic Construct
caggatggcttggttcactga

SEQ ID NO: 8012 - DNA, 22 bp, Artificial Sequence
  Synthetic Construct
catccagctgtgtctgctttgt

SEQ ID NO: 8013 - DNA, 26 bp, Artificial Sequence
  Synthetic Construct
cttaccttaagattcatgccccatca

SEQ ID NO: 8014 - DNA, 20 bp, Artificial Sequence
  Synthetic Construct
agtcctgcctttcccacatg

SEQ ID NO: 8015 - DNA, 25 bp, Artificial Sequence
  Synthetic Construct
gggagagaggtgtgaaggaccacat

SEQ ID NO: 8016 - DNA, 22 bp, Artificial Sequence
  Synthetic Construct
tccagggtcacggtgttctttt

SEQ ID NO: 8017 - DNA, 23 bp, Artificial Sequence
  Synthetic Construct
ccttctgtggctgctctcctttt

SEQ ID NO: 8018 - DNA, 23 bp, Artificial Sequence
  Synthetic Construct
ccaatgccattagctccagaaca

SEQ ID NO: 8019 - DNA, 25 bp, Artificial Sequence
  Synthetic Construct
gtgttaagttaagccgtgtcagcaa

SEQ ID NO: 8020 - DNA, 24 bp, Artificial Sequence
  Synthetic Construct
ggtgatcccctgcaaagttgaaac

SEQ ID NO: 8021 - DNA, 25 bp, Artificial Sequence
  Synthetic Construct
ggcttgaccttttacagatcacctt

SEQ ID NO: 8022 - DNA, 26 bp, Artificial Sequence
  Synthetic Construct
gttcaagagtcacggcaaacatacag

SEQ ID NO: 8023 - DNA, 26 bp, Artificial Sequence
  Synthetic Construct
ctgcaatagtttggtggagacataac

SEQ ID NO: 8024 - DNA, 20 bp, Artificial Sequence
  Synthetic Construct
atgcccctgtgcctttgagt

SEQ ID NO: 8025 - DNA, 21 bp, Artificial Sequence
  Synthetic Construct
agtcgcacccttccatctcat

SEQ ID NO: 8026 - DNA, 23 bp, Artificial Sequence
  Synthetic Construct
cacctaattcctccccagatcct

SEQ ID NO: 8027 - DNA, 24 bp, Artificial Sequence
  Synthetic Construct
ggaagacaaaggaggcaagacatc

SEQ ID NO: 8028 - DNA, 24 bp, Artificial Sequence
  Synthetic Construct
gggttgccagtctgattgtggtaa

SEQ ID NO: 8029 - DNA, 23 bp, Artificial Sequence
  Synthetic Construct
gccatgggctgtgatctcactta

SEQ ID NO: 8030 - DNA, 23 bp, Artificial Sequence
  Synthetic Construct
gacaatcctcacaatggctctgt

SEQ ID NO: 8031 - DNA, 22 bp, Artificial Sequence
  Synthetic Construct
agaccctgaccaccctgtttaa

SEQ ID NO: 8032 - DNA, 19 bp, Artificial Sequence
  Synthetic Construct
tgctgctggggctgacaga

SEQ ID NO: 8033 - DNA, 25 bp, Artificial Sequence
  Synthetic Construct
agtgatacccctgtgtagaatcgat

SEQ ID NO: 8034 - DNA, 21 bp, Artificial Sequence
  Synthetic Construct
tgggtctagcctccctactgt

SEQ ID NO: 8035 - DNA, 21 bp, Artificial Sequence
  Synthetic Construct
tcccaccttcccaggatgtca

SEQ ID NO: 8036 - DNA, 21 bp, Artificial Sequence
  Synthetic Construct
agccatggagagacaggaact

SEQ ID NO: 8037 - DNA, 26 bp, Artificial Sequence
  Synthetic Construct
catggttgctgtgataattggatcag

SEQ ID NO: 8038 - DNA, 22 bp, Artificial Sequence
  Synthetic Construct
catccagggacaacaagactgt

SEQ ID NO: 8039 - DNA, 24 bp, Artificial Sequence
  Synthetic Construct
gagccgcccaggtataaaataacc

SEQ ID NO: 8040 - DNA, 19 bp, Artificial Sequence
  Synthetic Construct
tggtgccaatgcagttgct

SEQ ID NO: 8041 - DNA, 22 bp, Artificial Sequence
  Synthetic Construct
aaggagcttggaagtcgccatt

SEQ ID NO: 8042 - DNA, 19 bp, Artificial Sequence
  Synthetic Construct
atgtgcccccttccttcca

SEQ ID NO: 8043 - DNA, 19 bp, Artificial Sequence
  Synthetic Construct
gccctcccctcagcttctg

SEQ ID NO: 8044 - DNA, 26 bp, Artificial Sequence
  Synthetic Construct
ccaaaactcaggaaagaaaggtacga

SEQ ID NO: 8045 - DNA, 22 bp, Artificial Sequence
  Synthetic Construct
aggtaaaccccatctggctttc

SEQ ID NO: 8046 - DNA, 27 bp, Artificial Sequence
  Synthetic Construct
caacacacatatccaggtgtttttctc

SEQ ID NO: 8047 - DNA, 21 bp, Artificial Sequence
  Synthetic Construct
atcaaccagcagggctcatca

SEQ ID NO: 8048 - DNA, 30 bp, Artificial Sequence
  Synthetic Construct
gcataaagagtaggtggtttagaagggtta

SEQ ID NO: 8049 - DNA, 19 bp, Artificial Sequence
  Synthetic Construct
tgcgtaaagcccccacaac

SEQ ID NO: 8050 - DNA, 21 bp, Artificial Sequence
  Synthetic Construct
tgtgtgtttcgggtgggagta

SEQ ID NO: 8051 - DNA, 22 bp, Artificial Sequence
  Synthetic Construct
aactcgccagtcccttcctaat

SEQ ID NO: 8052 - DNA, 21 bp, Artificial Sequence
  Synthetic Construct
ccatgacccagagctcagaga

SEQ ID NO: 8053 - DNA, 21 bp, Artificial Sequence
  Synthetic Construct
ccagccttgccaatcatacca

SEQ ID NO: 8054 - DNA, 24 bp, Artificial Sequence
  Synthetic Construct
gcctgtgataactctggcttgatg

SEQ ID NO: 8055 - DNA, 21 bp, Artificial Sequence
  Synthetic Construct
tgcacaagcctcagtgtttgg

SEQ ID NO: 8056 - DNA, 25 bp, Artificial Sequence
  Synthetic Construct
tctggtgtttaaaagacaccctctt

SEQ ID NO: 8057 - DNA, 19 bp, Artificial Sequence
  Synthetic Construct
gcacaggactggtgcttct

SEQ ID NO: 8058 - DNA, 22 bp, Artificial Sequence
  Synthetic Construct
cctcatggggtggttgggaata

SEQ ID NO: 8059 - DNA, 20 bp, Artificial Sequence
  Synthetic Construct
ggctctcagtcctccaaagc

SEQ ID NO: 8060 - DNA, 22 bp, Artificial Sequence
  Synthetic Construct
gaggggcctgataaagtttggt

SEQ ID NO: 8061 - DNA, 18 bp, Artificial Sequence
  Synthetic Construct
acaggccaggtggacagt

SEQ ID NO: 8062 - DNA, 24 bp, Artificial Sequence
  Synthetic Construct
agcaggtacaccgttaatgagaag

SEQ ID NO: 8063 - DNA, 27 bp, Artificial Sequence
  Synthetic Construct
ccttacctctactctgaactggacttg

SEQ ID NO: 8064 - DNA, 23 bp, Artificial Sequence
  Synthetic Construct
aggcactctgagttacagtttgg

SEQ ID NO: 8065 - DNA, 22 bp, Artificial Sequence
  Synthetic Construct
gaagccagcatggtctcatgtt

SEQ ID NO: 8066 - DNA, 25 bp, Artificial Sequence
  Synthetic Construct
gactgtcttcaaatcagctgcattc

SEQ ID NO: 8067 - DNA, 22 bp, Artificial Sequence
  Synthetic Construct
aagacagcaggagggagacatt

SEQ ID NO: 8068 - DNA, 24 bp, Artificial Sequence
  Synthetic Construct
ctgtactttgcccatctctttcct

SEQ ID NO: 8069 - DNA, 24 bp, Artificial Sequence
  Synthetic Construct
gctcaagccccctcaataatggat

SEQ ID NO: 8070 - DNA, 20 bp, Artificial Sequence
  Synthetic Construct
acagacactgagcccagtca

SEQ ID NO: 8071 - DNA, 26 bp, Artificial Sequence
  Synthetic Construct
tcacatagagcagtgttacttcttca

SEQ ID NO: 8072 - DNA, 26 bp, Artificial Sequence
  Synthetic Construct
ggacatttgttaccaaaggctaagca

SEQ ID NO: 8073 - DNA, 24 bp, Artificial Sequence
  Synthetic Construct
gagtaccctaacacaccccatagt

SEQ ID NO: 8074 - DNA, 22 bp, Artificial Sequence
  Synthetic Construct
ttcccttgcagtgagcttttcc

SEQ ID NO: 8075 - DNA, 25 bp, Artificial Sequence
  Synthetic Construct
gagacactcattttgcagagaacaa

SEQ ID NO: 8076 - DNA, 22 bp, Artificial Sequence
  Synthetic Construct
tggtggcctgacttccttctga

SEQ ID NO: 8077 - DNA, 22 bp, Artificial Sequence
  Synthetic Construct
gcactgaggattccagattcca

SEQ ID NO: 8078 - DNA, 23 bp, Artificial Sequence
  Synthetic Construct
tcctcctgtctatctgcctttct

SEQ ID NO: 8079 - DNA, 24 bp, Artificial Sequence
  Synthetic Construct
cctctgcttgtcagcccttatctt

SEQ ID NO: 8080 - DNA, 22 bp, Artificial Sequence
  Synthetic Construct
tgggaaaagagaaccagttgca

SEQ ID NO: 8081 - DNA, 22 bp, Artificial Sequence
  Synthetic Construct
gttcacatggagcatcgtgcat

SEQ ID NO: 8082 - DNA, 24 bp, Artificial Sequence
  Synthetic Construct
gcaccaaaagggagagcaagtttc

SEQ ID NO: 8083 - DNA, 24 bp, Artificial Sequence
  Synthetic Construct
agcaggacctgactctgacctata

SEQ ID NO: 8084 - DNA, 22 bp, Artificial Sequence
  Synthetic Construct
aacctcagacccaggctctaca

SEQ ID NO: 8085 - DNA, 24 bp, Artificial Sequence
  Synthetic Construct
ggcttccttgctgtaccttcatct

SEQ ID NO: 8086 - DNA, 23 bp, Artificial Sequence
  Synthetic Construct
aggctgggaatgggattctttcc

SEQ ID NO: 8087 - DNA, 24 bp, Artificial Sequence
  Synthetic Construct
gccttagtgagtggaagtcatgtt

SEQ ID NO: 8088 - DNA, 22 bp, Artificial Sequence
  Synthetic Construct
ccaggacacagtgctactccaa

SEQ ID NO: 8089 - DNA, 22 bp, Artificial Sequence
  Synthetic Construct
tctgacaatggtgccgatatgg

SEQ ID NO: 8090 - DNA, 20 bp, Artificial Sequence
  Synthetic Construct
accagaagcaagggcagaca

SEQ ID NO: 8091 - DNA, 24 bp, Artificial Sequence
  Synthetic Construct
tgccaggatttgatgacttgttga

SEQ ID NO: 8092 - DNA, 22 bp, Artificial Sequence
  Synthetic Construct
tggaggccacccttatgtctca

SEQ ID NO: 8093 - DNA, 28 bp, Artificial Sequence
  Synthetic Construct
agtgccagtatattattcaaacgtctct

SEQ ID NO: 8094 - DNA, 22 bp, Artificial Sequence
  Synthetic Construct
gaaatctggctaggagcaaggt

SEQ ID NO: 8095 - DNA, 22 bp, Artificial Sequence
  Synthetic Construct
ggccatttctacaggggattcc

SEQ ID NO: 8096 - DNA, 21 bp, Artificial Sequence
  Synthetic Construct
cgctgaccctcccatagtgtt

SEQ ID NO: 8097 - DNA, 24 bp, Artificial Sequence
  Synthetic Construct
cctgcataaagccctgatggtgaa

SEQ ID NO: 8098 - DNA, 19 bp, Artificial Sequence
  Synthetic Construct
aggagggcaggtggaagca

SEQ ID NO: 8099 - DNA, 18 bp, Artificial Sequence
  Synthetic Construct
gccccctcactggcttct

SEQ ID NO: 8100 - DNA, 24 bp, Artificial Sequence
  Synthetic Construct
ggaaaacctcagagacgagggttt

SEQ ID NO: 8101 - DNA, 24 bp, Artificial Sequence
  Synthetic Construct
tgggagtgctgtcattgagctatg

SEQ ID NO: 8102 - DNA, 26 bp, Artificial Sequence
  Synthetic Construct
tgcacctatgatttttactgcacttg

SEQ ID NO: 8103 - DNA, 22 bp, Artificial Sequence
  Synthetic Construct
tccagctgtcactgtggtatga

SEQ ID NO: 8104 - DNA, 22 bp, Artificial Sequence
  Synthetic Construct
tgttgcggcttaggacatgcta

SEQ ID NO: 8105 - DNA, 24 bp, Artificial Sequence
  Synthetic Construct
gggtgtctagatgggtgagtaagt

SEQ ID NO: 8106 - DNA, 29 bp, Artificial Sequence
  Synthetic Construct
gcaaggtattcactatgattcccttacag

SEQ ID NO: 8107 - DNA, 23 bp, Artificial Sequence
  Synthetic Construct
cagcccataaggtttctcttggt

SEQ ID NO: 8108 - DNA, 27 bp, Artificial Sequence
  Synthetic Construct
gttgggagtttaagatagctgaatcac

SEQ ID NO: 8109 - DNA, 26 bp, Artificial Sequence
  Synthetic Construct
gtataggcctagagactaaggtgtca

SEQ ID NO: 8110 - DNA, 26 bp, Artificial Sequence
  Synthetic Construct
ggtaaatcagagtggactcagcatct

SEQ ID NO: 8111 - DNA, 24 bp, Artificial Sequence
  Synthetic Construct
ccagtgccatgctctaaacaagga

SEQ ID NO: 8112 - DNA, 25 bp, Artificial Sequence
  Synthetic Construct
gactctactgcaaaaggatctggat

SEQ ID NO: 8113 - DNA, 26 bp, Artificial Sequence
  Synthetic Construct
gatgaaaagagatgaagggacatgac

SEQ ID NO: 8114 - DNA, 19 bp, Artificial Sequence
  Synthetic Construct
gctgaccccttggcaccat

SEQ ID NO: 8115 - DNA, 21 bp, Artificial Sequence
  Synthetic Construct
tctcaatggtggctgcaatca

SEQ ID NO: 8116 - DNA, 22 bp, Artificial Sequence
  Synthetic Construct
ttggagcccagtgagcttcatc

SEQ ID NO: 8117 - DNA, 20 bp, Artificial Sequence
  Synthetic Construct
tccttgcaagttgcctggaa

SEQ ID NO: 8118 - DNA, 19 bp, Artificial Sequence
  Synthetic Construct
ttcccccacctccatgaca

SEQ ID NO: 8119 - DNA, 21 bp, Artificial Sequence
  Synthetic Construct
gtgatcaagggggaggaacct

SEQ ID NO: 8120 - DNA, 25 bp, Artificial Sequence
  Synthetic Construct
gctaaaatctcaggccattgctatc

SEQ ID NO: 8121 - DNA, 22 bp, Artificial Sequence
  Synthetic Construct
gtccagggaatcagcaaagaca

SEQ ID NO: 8122 - DNA, 24 bp, Artificial Sequence
  Synthetic Construct
cccccttcagaaaagcagctttca

SEQ ID NO: 8123 - DNA, 21 bp, Artificial Sequence
  Synthetic Construct
tcccgtaacagcagcctaatc

SEQ ID NO: 8124 - DNA, 22 bp, Artificial Sequence
  Synthetic Construct
ccttgatgtcctgctcaattgc

SEQ ID NO: 8125 - DNA, 22 bp, Artificial Sequence
  Synthetic Construct
ggaggttgcacacagttggtat

SEQ ID NO: 8126 - DNA, 21 bp, Artificial Sequence
  Synthetic Construct
tgggacaggcagaagaagtgt

SEQ ID NO: 8127 - DNA, 19 bp, Artificial Sequence
  Synthetic Construct
aaacacccagcccccaaca

SEQ ID NO: 8128 - DNA, 25 bp, Artificial Sequence
  Synthetic Construct
ccagttctgagcacagagttatgtg

SEQ ID NO: 8129 - DNA, 20 bp, Artificial Sequence
  Synthetic Construct
ccaagcctgcagcaaggtta

SEQ ID NO: 8130 - DNA, 23 bp, Artificial Sequence
  Synthetic Construct
gagttgcaggaggtagctgtatg

SEQ ID NO: 8131 - DNA, 22 bp, Artificial Sequence
  Synthetic Construct
ggctgaacctgaggttttcact

SEQ ID NO: 8132 - DNA, 23 bp, Artificial Sequence
  Synthetic Construct
ccaaaagagatcccatccttcca

SEQ ID NO: 8133 - DNA, 22 bp, Artificial Sequence
  Synthetic Construct
aacccttcctcttcccagatga

SEQ ID NO: 8134 - DNA, 22 bp, Artificial Sequence
  Synthetic Construct
tggggacatttgcatctcacat

SEQ ID NO: 8135 - DNA, 23 bp, Artificial Sequence
  Synthetic Construct
ggttccagaactgttggaatcct

SEQ ID NO: 8136 - DNA, 24 bp, Artificial Sequence
  Synthetic Construct
ggttccctaacgacatcctttcac

SEQ ID NO: 8137 - DNA, 26 bp, Artificial Sequence
  Synthetic Construct
ctcctgatggttaaatcgtggaagac

SEQ ID NO: 8138 - DNA, 18 bp, Artificial Sequence
  Synthetic Construct
cgaatccccggccagtct

SEQ ID NO: 8139 - DNA, 24 bp, Artificial Sequence
  Synthetic Construct
ggcaggaaatgtttctgcctaagc

SEQ ID NO: 8140 - DNA, 22 bp, Artificial Sequence
  Synthetic Construct
tggcagaactcaaggggcaaaa

SEQ ID NO: 8141 - DNA, 24 bp, Artificial Sequence
  Synthetic Construct
tgccaactctgtaatcttgggaaa

SEQ ID NO: 8142 - DNA, 27 bp, Artificial Sequence
  Synthetic Construct
cagaggatgcctaagagttttctaggt

SEQ ID NO: 8143 - DNA, 21 bp, Artificial Sequence
  Synthetic Construct
acccctggtgtatcgtatgct

SEQ ID NO: 8144 - DNA, 18 bp, Artificial Sequence
  Synthetic Construct
gtggcccacacgaaggtt

SEQ ID NO: 8145 - DNA, 21 bp, Artificial Sequence
  Synthetic Construct
ctgtgtgcacctcaccctatc

SEQ ID NO: 8146 - DNA, 25 bp, Artificial Sequence
  Synthetic Construct
gactttgggccctttttgattttca

SEQ ID NO: 8147 - DNA, 24 bp, Artificial Sequence
  Synthetic Construct
ggacaccaaaaatctcagcaagtt

SEQ ID NO: 8148 - DNA, 22 bp, Artificial Sequence
  Synthetic Construct
aggaatgtgtaggtggctgaga

SEQ ID NO: 8149 - DNA, 27 bp, Artificial Sequence
  Synthetic Construct
gggagtaagggttgattttactttcgt

SEQ ID NO: 8150 - DNA, 25 bp, Artificial Sequence
  Synthetic Construct
ggacataacctagtcgtatggcaaa

SEQ ID NO: 8151 - DNA, 23 bp, Artificial Sequence
  Synthetic Construct
cccaaaagccatatgctctgttg

SEQ ID NO: 8152 - DNA, 22 bp, Artificial Sequence
  Synthetic Construct
gccctgattaccctaagccaat

SEQ ID NO: 8153 - DNA, 29 bp, Artificial Sequence
  Synthetic Construct
ccaataggcaaagaaattactctgttgga

SEQ ID NO: 8154 - DNA, 20 bp, Artificial Sequence
  Synthetic Construct
tcccaggatcaccagagcat

SEQ ID NO: 8155 - DNA, 19 bp, Artificial Sequence
  Synthetic Construct
tgcttggggcatgcgttca

SEQ ID NO: 8156 - DNA, 22 bp, Artificial Sequence
  Synthetic Construct
tgctcccgaccttgtcagagta

SEQ ID NO: 8157 - DNA, 24 bp, Artificial Sequence
  Synthetic Construct
ggagctacaatcacctgagctgaa

SEQ ID NO: 8158 - DNA, 22 bp, Artificial Sequence
  Synthetic Construct
gacaattggcagacaccaacag

SEQ ID NO: 8159 - DNA, 20 bp, Artificial Sequence
  Synthetic Construct
aggtgagctgggtcagacaa

SEQ ID NO: 8160 - DNA, 24 bp, Artificial Sequence
  Synthetic Construct
ccactgctcttgaaaaggcctgaa

SEQ ID NO: 8161 - DNA, 22 bp, Artificial Sequence
  Synthetic Construct
ggaatgaagagggcttctcaca

SEQ ID NO: 8162 - DNA, 25 bp, Artificial Sequence
  Synthetic Construct
gagtctgcactgctaatctctacca

SEQ ID NO: 8163 - DNA, 21 bp, Artificial Sequence
  Synthetic Construct
ggggggaatagcacagaaggt

SEQ ID NO: 8164 - DNA, 24 bp, Artificial Sequence
  Synthetic Construct
gaaagatgggcagagttcttttgg

SEQ ID NO: 8165 - DNA, 22 bp, Artificial Sequence
  Synthetic Construct
ggacgcacagcctttttatgag

SEQ ID NO: 8166 - DNA, 20 bp, Artificial Sequence
  Synthetic Construct
gcagtgaaatgggcatgcat

SEQ ID NO: 8167 - DNA, 21 bp, Artificial Sequence
  Synthetic Construct
ggtttgggtgggctagaaagc

SEQ ID NO: 8168 - DNA, 23 bp, Artificial Sequence
  Synthetic Construct
tgcatctgctgatccttcagttc

SEQ ID NO: 8169 - DNA, 21 bp, Artificial Sequence
  Synthetic Construct
agctgttggaagggtcaagct

SEQ ID NO: 8170 - DNA, 26 bp, Artificial Sequence
  Synthetic Construct
caggtagatgaataaggccagaatgg

SEQ ID NO: 8171 - DNA, 19 bp, Artificial Sequence
  Synthetic Construct
atggctgcagaggccttga

SEQ ID NO: 8172 - DNA, 22 bp, Artificial Sequence
  Synthetic Construct
atttccctcccccaacatgtct

SEQ ID NO: 8173 - DNA, 22 bp, Artificial Sequence
  Synthetic Construct
agccaccccctcgactattcaa

SEQ ID NO: 8174 - DNA, 21 bp, Artificial Sequence
  Synthetic Construct
ggtggtgagtgcaaagaggat

SEQ ID NO: 8175 - DNA, 24 bp, Artificial Sequence
  Synthetic Construct
gccttgtaccctgaaaacctccat

SEQ ID NO: 8176 - DNA, 28 bp, Artificial Sequence
  Synthetic Construct
cactcttcatgggatcattactgtaact

SEQ ID NO: 8177 - DNA, 19 bp, Artificial Sequence
  Synthetic Construct
cttggccacagcactggaa

SEQ ID NO: 8178 - DNA, 21 bp, Artificial Sequence
  Synthetic Construct
ccacagggggttgggactaaa

SEQ ID NO: 8179 - DNA, 28 bp, Artificial Sequence
  Synthetic Construct
gcctaataagaaagcttagggtacaagt

SEQ ID NO: 8180 - DNA, 22 bp, Artificial Sequence
  Synthetic Construct
gcttgcaagggtgagtaactga

SEQ ID NO: 8181 - DNA, 28 bp, Artificial Sequence
  Synthetic Construct
gtgatgcatgactatacttctacacaca

SEQ ID NO: 8182 - DNA, 25 bp, Artificial Sequence
  Synthetic Construct
gctgttatggtatcggtgtctacaa

SEQ ID NO: 8183 - DNA, 20 bp, Artificial Sequence
  Synthetic Construct
tgctcgtggttctgcagatt

SEQ ID NO: 8184 - DNA, 27 bp, Artificial Sequence
  Synthetic Construct
gaagaggagtcaggtagatgttctaag

SEQ ID NO: 8185 - DNA, 21 bp, Artificial Sequence
  Synthetic Construct
gctgagggagccaagcttaca

SEQ ID NO: 8186 - DNA, 23 bp, Artificial Sequence
  Synthetic Construct
cacgagacttgttgatcctgtga

SEQ ID NO: 8187 - DNA, 26 bp, Artificial Sequence
  Synthetic Construct
gggaagatgaccttagttcacacaga

SEQ ID NO: 8188 - DNA, 19 bp, Artificial Sequence
  Synthetic Construct
acccctgcctcctgctctt

SEQ ID NO: 8189 - DNA, 25 bp, Artificial Sequence
  Synthetic Construct
ctgctcacaactagagatggacatc

SEQ ID NO: 8190 - DNA, 22 bp, Artificial Sequence
  Synthetic Construct
gcctgtagcatggtggtatggt

SEQ ID NO: 8191 - DNA, 27 bp, Artificial Sequence
  Synthetic Construct
agtgtttccaaatacatagaccaccat

SEQ ID NO: 8192 - DNA, 28 bp, Artificial Sequence
  Synthetic Construct
acaaaaatcttcacatatcatgccactt

SEQ ID NO: 8193 - DNA, 22 bp, Artificial Sequence
  Synthetic Construct
cacaaggaagtgaggtgatcca

SEQ ID NO: 8194 - DNA, 24 bp, Artificial Sequence
  Synthetic Construct
gctctgtggtcaaggggatgtaat

SEQ ID NO: 8195 - DNA, 20 bp, Artificial Sequence
  Synthetic Construct
tcacctccctgtcccatgtt

SEQ ID NO: 8196 - DNA, 24 bp, Artificial Sequence
  Synthetic Construct
aggtcagggactactagacatgct

SEQ ID NO: 8197 - DNA, 24 bp, Artificial Sequence
  Synthetic Construct
tggctgtaaatcgctttgagtttg

SEQ ID NO: 8198 - DNA, 21 bp, Artificial Sequence
  Synthetic Construct
gaagtgggctttgggcaaaat

SEQ ID NO: 8199 - DNA, 25 bp, Artificial Sequence
  Synthetic Construct
tggaacagaaaagatgggataacga

SEQ ID NO: 8200 - DNA, 21 bp, Artificial Sequence
  Synthetic Construct
cacttccccacccagaggtaa

SEQ ID NO: 8201 - DNA, 24 bp, Artificial Sequence
  Synthetic Construct
gggagccttggaaggagtctttat

SEQ ID NO: 8202 - DNA, 22 bp, Artificial Sequence
  Synthetic Construct
gaagggagaatggctgttggat

SEQ ID NO: 8203 - DNA, 24 bp, Artificial Sequence
  Synthetic Construct
gtggaatcatgtccctgactgatg

SEQ ID NO: 8204 - DNA, 24 bp, Artificial Sequence
  Synthetic Construct
tctctggtatctttcccactctgt

SEQ ID NO: 8205 - DNA, 26 bp, Artificial Sequence
  Synthetic Construct
actttgaatcttaccaccagcttaga

SEQ ID NO: 8206 - DNA, 19 bp, Artificial Sequence
  Synthetic Construct
cggttccacccaggtttgg

SEQ ID NO: 8207 - DNA, 22 bp, Artificial Sequence
  Synthetic Construct
agttccaggggatgtcaatgct

SEQ ID NO: 8208 - DNA, 22 bp, Artificial Sequence
  Synthetic Construct
aatgcctcaagccagtgttact

SEQ ID NO: 8209 - DNA, 24 bp, Artificial Sequence
  Synthetic Construct
gaaaagtctgttgcctaggacaca

SEQ ID NO: 8210 - DNA, 26 bp, Artificial Sequence
  Synthetic Construct
ggggcaggcatataatacacaatcaa

SEQ ID NO: 8211 - DNA, 26 bp, Artificial Sequence
  Synthetic Construct
caaactgaaggtattgtttggtcctt

SEQ ID NO: 8212 - DNA, 23 bp, Artificial Sequence
  Synthetic Construct
gctgttaaaaaccactgcacaca

SEQ ID NO: 8213 - DNA, 24 bp, Artificial Sequence
  Synthetic Construct
ctcatcacgtggcttagtgttctg

SEQ ID NO: 8214 - DNA, 25 bp, Artificial Sequence
  Synthetic Construct
ctattcatcaggctctgtgtacact

SEQ ID NO: 8215 - DNA, 26 bp, Artificial Sequence
  Synthetic Construct
catcattagatgtgcctgtgtactct

SEQ ID NO: 8216 - DNA, 24 bp, Artificial Sequence
  Synthetic Construct
ctcctccatgtaagctcctatgct

SEQ ID NO: 8217 - DNA, 18 bp, Artificial Sequence
  Synthetic Construct
ccccgggcaagacaagct

SEQ ID NO: 8218 - DNA, 26 bp, Artificial Sequence
  Synthetic Construct
ccccaccatctacactttctgaacag

SEQ ID NO: 8219 - DNA, 26 bp, Artificial Sequence
  Synthetic Construct
gaagtgcctattcctaaaccaatcac

SEQ ID NO: 8220 - DNA, 26 bp, Artificial Sequence
  Synthetic Construct
cccatggatagtagggaatggtgtag

SEQ ID NO: 8221 - DNA, 22 bp, Artificial Sequence
  Synthetic Construct
gcctttgttgcccatcacttac

SEQ ID NO: 8222 - DNA, 24 bp, Artificial Sequence
  Synthetic Construct
aagaagtggactgacatcggaatt

SEQ ID NO: 8223 - DNA, 25 bp, Artificial Sequence
  Synthetic Construct
gtagccttgggaacattgtttaacc

SEQ ID NO: 8224 - DNA, 21 bp, Artificial Sequence
  Synthetic Construct
ttatcctccctccccaaagca

SEQ ID NO: 8225 - DNA, 24 bp, Artificial Sequence
  Synthetic Construct
cccagtggaagttgagtgtaagtc

SEQ ID NO: 8226 - DNA, 23 bp, Artificial Sequence
  Synthetic Construct
ttgtagagggcctttctctcact

SEQ ID NO: 8227 - DNA, 25 bp, Artificial Sequence
  Synthetic Construct
tgggagcaaaatgttttactttgca

SEQ ID NO: 8228 - DNA, 21 bp, Artificial Sequence
  Synthetic Construct
agcctgcatctgactcctgta

SEQ ID NO: 8229 - DNA, 23 bp, Artificial Sequence
  Synthetic Construct
gaatcaggaagtccagcacaagt

SEQ ID NO: 8230 - DNA, 24 bp, Artificial Sequence
  Synthetic Construct
ggtttctgccaatgacatctcaca

SEQ ID NO: 8231 - DNA, 21 bp, Artificial Sequence
  Synthetic Construct
cccgcatcgttttaggggtaa

SEQ ID NO: 8232 - DNA, 24 bp, Artificial Sequence
  Synthetic Construct
ctctccaatgcccctttcttcttc

SEQ ID NO: 8233 - DNA, 20 bp, Artificial Sequence
  Synthetic Construct
gggtgtgctccagaatgcat

SEQ ID NO: 8234 - DNA, 22 bp, Artificial Sequence
  Synthetic Construct
acagctgcctgaatttggaaac

SEQ ID NO: 8235 - DNA, 22 bp, Artificial Sequence
  Synthetic Construct
agatcacattgggtcccacaca

SEQ ID NO: 8236 - DNA, 24 bp, Artificial Sequence
  Synthetic Construct
ctcacaagtggaattggagctctt

SEQ ID NO: 8237 - DNA, 25 bp, Artificial Sequence
  Synthetic Construct
ccactttagctaccttggagaacat

SEQ ID NO: 8238 - DNA, 22 bp, Artificial Sequence
  Synthetic Construct
cagtttgtggagccttgctttt

SEQ ID NO: 8239 - DNA, 22 bp, Artificial Sequence
  Synthetic Construct
agggtgccaaacaggtttatgg

SEQ ID NO: 8240 - DNA, 18 bp, Artificial Sequence
  Synthetic Construct
tgccacgctgccacatct

SEQ ID NO: 8241 - DNA, 21 bp, Artificial Sequence
  Synthetic Construct
accttcaggcccacctactgt

SEQ ID NO: 8242 - DNA, 27 bp, Artificial Sequence
  Synthetic Construct
gaaacctgtagagtcttacatgccatt

SEQ ID NO: 8243 - DNA, 20 bp, Artificial Sequence
  Synthetic Construct
cctaggctggcccaagatga

SEQ ID NO: 8244 - DNA, 19 bp, Artificial Sequence
  Synthetic Construct
ctcaccatgcgcagttcct

SEQ ID NO: 8245 - DNA, 24 bp, Artificial Sequence
  Synthetic Construct
cacaggtcagacaaggctaaaacc

SEQ ID NO: 8246 - DNA, 22 bp, Artificial Sequence
  Synthetic Construct
aggactagcccttggtttggat

SEQ ID NO: 8247 - DNA, 22 bp, Artificial Sequence
  Synthetic Construct
aggcagaccactaactggagaa

SEQ ID NO: 8248 - DNA, 20 bp, Artificial Sequence
  Synthetic Construct
accactggtcccagcaacta

SEQ ID NO: 8249 - DNA, 20 bp, Artificial Sequence
  Synthetic Construct
agctgctacccacctaaggt

SEQ ID NO: 8250 - DNA, 26 bp, Artificial Sequence
  Synthetic Construct
gcttatctgggattgctaccaactag

SEQ ID NO: 8251 - DNA, 22 bp, Artificial Sequence
  Synthetic Construct
tgccttggatggtgtggcaaca

SEQ ID NO: 8252 - DNA, 26 bp, Artificial Sequence
  Synthetic Construct
ccaggtaggtaaaacctcttggattc

SEQ ID NO: 8253 - DNA, 26 bp, Artificial Sequence
  Synthetic Construct
ctccaacaagccacgtatatgttagg

SEQ ID NO: 8254 - DNA, 19 bp, Artificial Sequence
  Synthetic Construct
gggacagatgcggcaacaa

SEQ ID NO: 8255 - DNA, 25 bp, Artificial Sequence
  Synthetic Construct
ggcagcttgagcaatcttctaaagg

SEQ ID NO: 8256 - DNA, 25 bp, Artificial Sequence
  Synthetic Construct
gtgacattttcctgtgtccttgagt

SEQ ID NO: 8257 - DNA, 26 bp, Artificial Sequence
  Synthetic Construct
gcaggaaggatgagggttagatacca

SEQ ID NO: 8258 - DNA, 22 bp, Artificial Sequence
  Synthetic Construct
ggagtccacagaggcagcttat

SEQ ID NO: 8259 - DNA, 19 bp, Artificial Sequence
  Synthetic Construct
ccgtcttgggtggttcaca

SEQ ID NO: 8260 - DNA, 23 bp, Artificial Sequence
  Synthetic Construct
ctctgcttctcacactgtgcaaa

SEQ ID NO: 8261 - DNA, 23 bp, Artificial Sequence
  Synthetic Construct
gcttaaagctgcagtggagaaca

SEQ ID NO: 8262 - DNA, 22 bp, Artificial Sequence
  Synthetic Construct
ggcactagtgatcctcctacct

SEQ ID NO: 8263 - DNA, 24 bp, Artificial Sequence
  Synthetic Construct
ctatgtctcctccctgcataggta

SEQ ID NO: 8264 - DNA, 23 bp, Artificial Sequence
  Synthetic Construct
agtttcctgcagaaagacaagca

SEQ ID NO: 8265 - DNA, 18 bp, Artificial Sequence
  Synthetic Construct
aggaggcttgccctgtgt

SEQ ID NO: 8266 - DNA, 27 bp, Artificial Sequence
  Synthetic Construct
gcacacttgtcctagtaacaggtgaat

SEQ ID NO: 8267 - DNA, 20 bp, Artificial Sequence
  Synthetic Construct
tgggagtggagcaggaatcc

SEQ ID NO: 8268 - DNA, 22 bp, Artificial Sequence
  Synthetic Construct
tggggaaactgaccaacacaag

SEQ ID NO: 8269 - DNA, 22 bp, Artificial Sequence
  Synthetic Construct
ccctgatcactgcattctggat

SEQ ID NO: 8270 - DNA, 23 bp, Artificial Sequence
  Synthetic Construct
gtggggagtcaccaatgatactt

SEQ ID NO: 8271 - DNA, 22 bp, Artificial Sequence
  Synthetic Construct
ctggaggtccttcaaggtcttg

SEQ ID NO: 8272 - DNA, 24 bp, Artificial Sequence
  Synthetic Construct
aggggaagtgacacagagttacag

SEQ ID NO: 8273 - DNA, 22 bp, Artificial Sequence
  Synthetic Construct
gttcccacatccttgtgcatct

SEQ ID NO: 8274 - DNA, 24 bp, Artificial Sequence
  Synthetic Construct
cacagctgatgcaaactagctctt

SEQ ID NO: 8275 - DNA, 24 bp, Artificial Sequence
  Synthetic Construct
cgcactcagcctttgttgtagaag

SEQ ID NO: 8276 - DNA, 24 bp, Artificial Sequence
  Synthetic Construct
ctcaggtatggaggatgcaggaat

SEQ ID NO: 8277 - DNA, 26 bp, Artificial Sequence
  Synthetic Construct
cgcatagtccacaactgggatacttc

SEQ ID NO: 8278 - DNA, 23 bp, Artificial Sequence
  Synthetic Construct
caccaccaaacaaaccccaaatc

SEQ ID NO: 8279 - DNA, 20 bp, Artificial Sequence
  Synthetic Construct
tgtcccctccctacctcaca

SEQ ID NO: 8280 - DNA, 24 bp, Artificial Sequence
  Synthetic Construct
gaacagagagaatgaggggagaga

SEQ ID NO: 8281 - DNA, 22 bp, Artificial Sequence
  Synthetic Construct
tggaggtttgtgtcacccttct

SEQ ID NO: 8282 - DNA, 22 bp, Artificial Sequence
  Synthetic Construct
agtcagaacctgccacttcact

SEQ ID NO: 8283 - DNA, 24 bp, Artificial Sequence
  Synthetic Construct
gcagataggatggtctggaatgtc

SEQ ID NO: 8284 - DNA, 28 bp, Artificial Sequence
  Synthetic Construct
ggaaagcccctagtcacttagtcatatg

SEQ ID NO: 8285 - DNA, 19 bp, Artificial Sequence
  Synthetic Construct
aaggggctggtggcttcca

SEQ ID NO: 8286 - DNA, 25 bp, Artificial Sequence
  Synthetic Construct
tgctggacttgcatttcaaattagg

SEQ ID NO: 8287 - DNA, 22 bp, Artificial Sequence
  Synthetic Construct
tcaaactgtgggttgcaatcca

SEQ ID NO: 8288 - DNA, 25 bp, Artificial Sequence
  Synthetic Construct
gctcatccttcaggcttaaggacaa

SEQ ID NO: 8289 - DNA, 22 bp, Artificial Sequence
  Synthetic Construct
agagagcaagccagtgagtaga

SEQ ID NO: 8290 - DNA, 22 bp, Artificial Sequence
  Synthetic Construct
acaccactgctcccaagttgta

SEQ ID NO: 8291 - DNA, 26 bp, Artificial Sequence
  Synthetic Construct
agctgcttactacataccatcatcag

SEQ ID NO: 8292 - DNA, 24 bp, Artificial Sequence
  Synthetic Construct
gcagtttgtttcctgggctaatcc

SEQ ID NO: 8293 - DNA, 24 bp, Artificial Sequence
  Synthetic Construct
acaccaacatagctttcagttcct

SEQ ID NO: 8294 - DNA, 23 bp, Artificial Sequence
  Synthetic Construct
cacagcaagaataaagccaagct

SEQ ID NO: 8295 - DNA, 25 bp, Artificial Sequence
  Synthetic Construct
gagtttggtagcacagcaaaaactg

SEQ ID NO: 8296 - DNA, 24 bp, Artificial Sequence
  Synthetic Construct
ctgtgtgtagcctttgctctcaag

SEQ ID NO: 8297 - DNA, 22 bp, Artificial Sequence
  Synthetic Construct
gcttgggaaagggaggtcaatt

SEQ ID NO: 8298 - DNA, 23 bp, Artificial Sequence
  Synthetic Construct
acacataggcctagggaaagaca

SEQ ID NO: 8299 - DNA, 24 bp, Artificial Sequence
  Synthetic Construct
ggacctgcttgcagagtttatgat

SEQ ID NO: 8300 - DNA, 24 bp, Artificial Sequence
  Synthetic Construct
ggctgcaactaaatttcccaaacc

SEQ ID NO: 8301 - DNA, 22 bp, Artificial Sequence
  Synthetic Construct
agcatttggcagccagtgaaag

SEQ ID NO: 8302 - DNA, 21 bp, Artificial Sequence
  Synthetic Construct
tcgcctcctggtgagcttgta

SEQ ID NO: 8303 - DNA, 26 bp, Artificial Sequence
  Synthetic Construct
ggacagattcagaaggagggagaata

SEQ ID NO: 8304 - DNA, 22 bp, Artificial Sequence
  Synthetic Construct
ggagccccaaagtgcaacaatt

SEQ ID NO: 8305 - DNA, 22 bp, Artificial Sequence
  Synthetic Construct
gcaccctggctgttttgcaaat

SEQ ID NO: 8306 - DNA, 26 bp, Artificial Sequence
  Synthetic Construct
gctgagttcaagtctaaggaggattg

SEQ ID NO: 8307 - DNA, 25 bp, Artificial Sequence
  Synthetic Construct
ggctgttgacagtctatttttggaa

SEQ ID NO: 8308 - DNA, 23 bp, Artificial Sequence
  Synthetic Construct
gcgtgaaacctaaacaagctcaa

SEQ ID NO: 8309 - DNA, 23 bp, Artificial Sequence
  Synthetic Construct
agttccaggagatgcctttagtg

SEQ ID NO: 8310 - DNA, 22 bp, Artificial Sequence
  Synthetic Construct
tggaagcgtggattttgctaga

SEQ ID NO: 8311 - DNA, 26 bp, Artificial Sequence
  Synthetic Construct
ctggtggttcttccatgttcattatc

SEQ ID NO: 8312 - DNA, 22 bp, Artificial Sequence
  Synthetic Construct
gaggaaccagggagtaccttca

SEQ ID NO: 8313 - DNA, 24 bp, Artificial Sequence
  Synthetic Construct
ggaacactacaacaacccaatcct

SEQ ID NO: 8314 - DNA, 22 bp, Artificial Sequence
  Synthetic Construct
gagagccaggaacttccaagca

SEQ ID NO: 8315 - DNA, 24 bp, Artificial Sequence
  Synthetic Construct
aggatcacatcagtagtgtgcttt

SEQ ID NO: 8316 - DNA, 24 bp, Artificial Sequence
  Synthetic Construct
gcaaaggactgtaggtggatagga

SEQ ID NO: 8317 - DNA, 20 bp, Artificial Sequence
  Synthetic Construct
tgtgcataactggggtgcat

SEQ ID NO: 8318 - DNA, 25 bp, Artificial Sequence
  Synthetic Construct
caatacagtagtgccgagacagatc

SEQ ID NO: 8319 - DNA, 24 bp, Artificial Sequence
  Synthetic Construct
gactaggctggaaactgagttacc

SEQ ID NO: 8320 - DNA, 22 bp, Artificial Sequence
  Synthetic Construct
ggtgccatgttattgcatgcaa

SEQ ID NO: 8321 - DNA, 22 bp, Artificial Sequence
  Synthetic Construct
aggggagtgggatgacctgatt

SEQ ID NO: 8322 - DNA, 21 bp, Artificial Sequence
  Synthetic Construct
cggcaagtctcctgacctctt

SEQ ID NO: 8323 - DNA, 22 bp, Artificial Sequence
  Synthetic Construct
tgctggatggggtctgaaaaat

SEQ ID NO: 8324 - DNA, 25 bp, Artificial Sequence
  Synthetic Construct
gcatgtctcaccttctaaaatgctt

SEQ ID NO: 8325 - DNA, 22 bp, Artificial Sequence
  Synthetic Construct
tcaagatgcggcctatttccat

SEQ ID NO: 8326 - DNA, 20 bp, Artificial Sequence
  Synthetic Construct
ggtccctggggcttcggata

SEQ ID NO: 8327 - DNA, 26 bp, Artificial Sequence
  Synthetic Construct
cctatagacctctgcaggacaatatg

SEQ ID NO: 8328 - DNA, 22 bp, Artificial Sequence
  Synthetic Construct
tcctgggatgtctacagcaaca

SEQ ID NO: 8329 - DNA, 22 bp, Artificial Sequence
  Synthetic Construct
cctccaccgggttactgtttct

SEQ ID NO: 8330 - DNA, 26 bp, Artificial Sequence
  Synthetic Construct
agatgacaactaatgactcggtgtaa

SEQ ID NO: 8331 - DNA, 22 bp, Artificial Sequence
  Synthetic Construct
agagcaagggtcaacacactac

SEQ ID NO: 8332 - DNA, 26 bp, Artificial Sequence
  Synthetic Construct
cgaatgaacagcactctaccccttag

SEQ ID NO: 8333 - DNA, 21 bp, Artificial Sequence
  Synthetic Construct
tgagccagtggttcagtttgg

SEQ ID NO: 8334 - DNA, 20 bp, Artificial Sequence
  Synthetic Construct
ggagacgctgtacccacaaa

SEQ ID NO: 8335 - DNA, 25 bp, Artificial Sequence
  Synthetic Construct
gtgtaagggggcacgaagaaataac

SEQ ID NO: 8336 - DNA, 20 bp, Artificial Sequence
  Synthetic Construct
tcatgcaagggcctgtgttt

SEQ ID NO: 8337 - DNA, 22 bp, Artificial Sequence
  Synthetic Construct
ccttcatccatgcctctggttt

SEQ ID NO: 8338 - DNA, 22 bp, Artificial Sequence
  Synthetic Construct
aggaggccagattgcagtacag

SEQ ID NO: 8339 - DNA, 25 bp, Artificial Sequence
  Synthetic Construct
tcaatttatatcgcctggactacgt

SEQ ID NO: 8340 - DNA, 24 bp, Artificial Sequence
  Synthetic Construct
ggattctccaggcagaagtagtgt

SEQ ID NO: 8341 - DNA, 25 bp, Artificial Sequence
  Synthetic Construct
ggtgagaattaacttggcctaatgc

SEQ ID NO: 8342 - DNA, 22 bp, Artificial Sequence
  Synthetic Construct
ggaaagattccctggtctgcat

SEQ ID NO: 8343 - DNA, 23 bp, Artificial Sequence
  Synthetic Construct
ggaaactctcaaggcatcaaggt

SEQ ID NO: 8344 - DNA, 22 bp, Artificial Sequence
  Synthetic Construct
ccccaaatcctgccaatcctat

SEQ ID NO: 8345 - DNA, 24 bp, Artificial Sequence
  Synthetic Construct
gaggagagacagcagtgtttgtaa

SEQ ID NO: 8346 - DNA, 22 bp, Artificial Sequence
  Synthetic Construct
tgatgaggcaccaaggttacac

SEQ ID NO: 8347 - DNA, 25 bp, Artificial Sequence
  Synthetic Construct
ggcagataatctcaccccattttgg

SEQ ID NO: 8348 - DNA, 22 bp, Artificial Sequence
  Synthetic Construct
tggcgtgctgtcattctacatg

SEQ ID NO: 8349 - DNA, 21 bp, Artificial Sequence
  Synthetic Construct
tctcagagcctccctttgcat

SEQ ID NO: 8350 - DNA, 26 bp, Artificial Sequence
  Synthetic Construct
tggagacagggaaatatgaggagtag

SEQ ID NO: 8351 - DNA, 19 bp, Artificial Sequence
  Synthetic Construct
tccccgaacatgggcagat

SEQ ID NO: 8352 - DNA, 21 bp, Artificial Sequence
  Synthetic Construct
tcccaacctccagccctttaa

SEQ ID NO: 8353 - DNA, 24 bp, Artificial Sequence
  Synthetic Construct
gcactaagaacacagggggaaagt

SEQ ID NO: 8354 - DNA, 24 bp, Artificial Sequence
  Synthetic Construct
ctcaaagcctggaattggaatggt

SEQ ID NO: 8355 - DNA, 23 bp, Artificial Sequence
  Synthetic Construct
ccagctgtaatttgtggccaaaa

SEQ ID NO: 8356 - DNA, 27 bp, Artificial Sequence
  Synthetic Construct
ggcctcaagaactttctactcattcct

SEQ ID NO: 8357 - DNA, 20 bp, Artificial Sequence
  Synthetic Construct
ggtgactgggggtacacagt

SEQ ID NO: 8358 - DNA, 23 bp, Artificial Sequence
  Synthetic Construct
aggccccatcttactcactttcc

SEQ ID NO: 8359 - DNA, 22 bp, Artificial Sequence
  Synthetic Construct
gcttgggtttggctgacatcta

SEQ ID NO: 8360 - DNA, 21 bp, Artificial Sequence
  Synthetic Construct
ccactccaagggtgggtccta

SEQ ID NO: 8361 - DNA, 23 bp, Artificial Sequence
  Synthetic Construct
tgggtcccaatgccaagtaaagg

SEQ ID NO: 8362 - DNA, 23 bp, Artificial Sequence
  Synthetic Construct
tgaaaagctctggagtcacactt

SEQ ID NO: 8363 - DNA, 21 bp, Artificial Sequence
  Synthetic Construct
catttccgctcacaagccatt

SEQ ID NO: 8364 - DNA, 26 bp, Artificial Sequence
  Synthetic Construct
cccatacaaggatccaagtacctgtt

SEQ ID NO: 8365 - DNA, 24 bp, Artificial Sequence
  Synthetic Construct
caaagccatatgacaaaggaagca

SEQ ID NO: 8366 - DNA, 20 bp, Artificial Sequence
  Synthetic Construct
agaagcgagggtgcaaatgc

SEQ ID NO: 8367 - DNA, 22 bp, Artificial Sequence
  Synthetic Construct
agcaggaatcaggcaggaaaaa

SEQ ID NO: 8368 - DNA, 19 bp, Artificial Sequence
  Synthetic Construct
agccacctgccactatcct

SEQ ID NO: 8369 - DNA, 21 bp, Artificial Sequence
  Synthetic Construct
actgcactctggcatcaccat

SEQ ID NO: 8370 - DNA, 24 bp, Artificial Sequence
  Synthetic Construct
acaacatacattgctgggccttaa

SEQ ID NO: 8371 - DNA, 24 bp, Artificial Sequence
  Synthetic Construct
ggctaaccctgctgagaacctttt

SEQ ID NO: 8372 - DNA, 20 bp, Artificial Sequence
  Synthetic Construct
gctggcttcgggtagagaca

SEQ ID NO: 8373 - DNA, 22 bp, Artificial Sequence
  Synthetic Construct
gagaatagctcctgcagttgct

SEQ ID NO: 8374 - DNA, 25 bp, Artificial Sequence
  Synthetic Construct
actagcaaaccaaagctaacgacat

SEQ ID NO: 8375 - DNA, 25 bp, Artificial Sequence
  Synthetic Construct
gagcatgtatgattcacgcttcttg

SEQ ID NO: 8376 - DNA, 25 bp, Artificial Sequence
  Synthetic Construct
caggaaaggcagatgcttctaagtg

SEQ ID NO: 8377 - DNA, 27 bp, Artificial Sequence
  Synthetic Construct
gcagagatttcagctcatgtgtttcag

SEQ ID NO: 8378 - DNA, 22 bp, Artificial Sequence
  Synthetic Construct
tgggaaatgggcagtgcctaga

SEQ ID NO: 8379 - DNA, 22 bp, Artificial Sequence
  Synthetic Construct
caggagcctcagagacaaagac

SEQ ID NO: 8380 - DNA, 21 bp, Artificial Sequence
  Synthetic Construct
agaaggccaggtgcattgtga

SEQ ID NO: 8381 - DNA, 19 bp, Artificial Sequence
  Synthetic Construct
aggcagaggctcgcagtga

SEQ ID NO: 8382 - DNA, 22 bp, Artificial Sequence
  Synthetic Construct
aggaggaacaactgaggccaaa

SEQ ID NO: 8383 - DNA, 26 bp, Artificial Sequence
  Synthetic Construct
gctgactttcaaagcatgaacccttt

SEQ ID NO: 8384 - DNA, 20 bp, Artificial Sequence
  Synthetic Construct
accctcctgtggtggtagac

SEQ ID NO: 8385 - DNA, 29 bp, Artificial Sequence
  Synthetic Construct
gtggtgatatttcctaattccagggaatg

SEQ ID NO: 8386 - DNA, 25 bp, Artificial Sequence
  Synthetic Construct
ggcagaacaaatagttgagcaatgg

SEQ ID NO: 8387 - DNA, 24 bp, Artificial Sequence
  Synthetic Construct
gacaaaggccagcttctcatacag

SEQ ID NO: 8388 - DNA, 23 bp, Artificial Sequence
  Synthetic Construct
tggcaccaacctaataggaagtg

SEQ ID NO: 8389 - DNA, 25 bp, Artificial Sequence
  Synthetic Construct
gatgtttggcttttcttgcttctga

SEQ ID NO: 8390 - DNA, 22 bp, Artificial Sequence
  Synthetic Construct
aggagtgactgctacagctcaa

SEQ ID NO: 8391 - DNA, 25 bp, Artificial Sequence
  Synthetic Construct
gaatgacatttctgagctcctggaa

SEQ ID NO: 8392 - DNA, 22 bp, Artificial Sequence
  Synthetic Construct
cattgcaggagtggctacttca

SEQ ID NO: 8393 - DNA, 21 bp, Artificial Sequence
  Synthetic Construct
agctttggacccagctgtgaa

SEQ ID NO: 8394 - DNA, 24 bp, Artificial Sequence
  Synthetic Construct
ctgtttacagctcaaaccctctca

SEQ ID NO: 8395 - DNA, 24 bp, Artificial Sequence
  Synthetic Construct
tgcccctactaaatgtggtttctg

SEQ ID NO: 8396 - DNA, 27 bp, Artificial Sequence
  Synthetic Construct
ggaaatagctagaggatgagacaagct

SEQ ID NO: 8397 - DNA, 25 bp, Artificial Sequence
  Synthetic Construct
cgtctctaaatttgcctgctgtttg

SEQ ID NO: 8398 - DNA, 21 bp, Artificial Sequence
  Synthetic Construct
acccagagagactgcaaaggt

SEQ ID NO: 8399 - DNA, 28 bp, Artificial Sequence
  Synthetic Construct
gggactactaccagtgttaagtgagatg

SEQ ID NO: 8400 - DNA, 22 bp, Artificial Sequence
  Synthetic Construct
ccctcccctacctctctacaga

SEQ ID NO: 8401 - DNA, 20 bp, Artificial Sequence
  Synthetic Construct
gctgatgcccagatgtctgt

SEQ ID NO: 8402 - DNA, 18 bp, Artificial Sequence
  Synthetic Construct
tgcccagacacgcagcat

SEQ ID NO: 8403 - DNA, 23 bp, Artificial Sequence
  Synthetic Construct
gatctcactgttgctgtcggtat

SEQ ID NO: 8404 - DNA, 22 bp, Artificial Sequence
  Synthetic Construct
gccaccagaccattgctcattt

SEQ ID NO: 8405 - DNA, 26 bp, Artificial Sequence
  Synthetic Construct
catgtcaccttgcctatgagttagag

SEQ ID NO: 8406 - DNA, 24 bp, Artificial Sequence
  Synthetic Construct
ggacttctggctaacactccatgt

SEQ ID NO: 8407 - DNA, 18 bp, Artificial Sequence
  Synthetic Construct
tgcacgcctcctgactca

SEQ ID NO: 8408 - DNA, 22 bp, Artificial Sequence
  Synthetic Construct
gcttccaccaagccaaacaaca

SEQ ID NO: 8409 - DNA, 25 bp, Artificial Sequence
  Synthetic Construct
gagtgtatgccaggtgttaacaaca

SEQ ID NO: 8410 - DNA, 25 bp, Artificial Sequence
  Synthetic Construct
ggacagcagggatctatcttttcag

SEQ ID NO: 8411 - DNA, 20 bp, Artificial Sequence
  Synthetic Construct
atgactggtggctgctgagt

SEQ ID NO: 8412 - DNA, 26 bp, Artificial Sequence
  Synthetic Construct
cacacacactcacagaatgattagca

SEQ ID NO: 8413 - DNA, 22 bp, Artificial Sequence
  Synthetic Construct
tcacaggccttgaacttttcca

SEQ ID NO: 8414 - DNA, 20 bp, Artificial Sequence
  Synthetic Construct
tgtcacagcgtgaggtcact

SEQ ID NO: 8415 - DNA, 25 bp, Artificial Sequence
  Synthetic Construct
gcatatagcctatgccaaagaacag

SEQ ID NO: 8416 - DNA, 24 bp, Artificial Sequence
  Synthetic Construct
gatcaagatgtcacagctgatcct

SEQ ID NO: 8417 - DNA, 20 bp, Artificial Sequence
  Synthetic Construct
tgctcaccacgtaggcctat

SEQ ID NO: 8418 - DNA, 23 bp, Artificial Sequence
  Synthetic Construct
ctgagggagggtagggttacctt

SEQ ID NO: 8419 - DNA, 24 bp, Artificial Sequence
  Synthetic Construct
gagaaggaattggaaccaggacat

SEQ ID NO: 8420 - DNA, 21 bp, Artificial Sequence
  Synthetic Construct
tgcccctgcacagtattggat

SEQ ID NO: 8421 - DNA, 21 bp, Artificial Sequence
  Synthetic Construct
agactggaagcctgaggtcat

SEQ ID NO: 8422 - DNA, 26 bp, Artificial Sequence
  Synthetic Construct
cgcactgagtgttaattttccaagca

SEQ ID NO: 8423 - DNA, 27 bp, Artificial Sequence
  Synthetic Construct
cctctagcctggatgttctctcttttc

SEQ ID NO: 8424 - DNA, 19 bp, Artificial Sequence
  Synthetic Construct
gcagactgcagggtttcca

SEQ ID NO: 8425 - DNA, 23 bp, Artificial Sequence
  Synthetic Construct
ggacagggtcatctcagtgtgaa

SEQ ID NO: 8426 - DNA, 23 bp, Artificial Sequence
  Synthetic Construct
tgcccatgtcttctactcactgt

SEQ ID NO: 8427 - DNA, 25 bp, Artificial Sequence
  Synthetic Construct
ccatggaaggataccacaacaagac

SEQ ID NO: 8428 - DNA, 22 bp, Artificial Sequence
  Synthetic Construct
gggatcttcaagcacagtctga

SEQ ID NO: 8429 - DNA, 22 bp, Artificial Sequence
  Synthetic Construct
acatagtcctccttgggggaaa

SEQ ID NO: 8430 - DNA, 25 bp, Artificial Sequence
  Synthetic Construct
aaccccttgaaggagttgtctattc

SEQ ID NO: 8431 - DNA, 19 bp, Artificial Sequence
  Synthetic Construct
gcaaggggagctcaaaggt

SEQ ID NO: 8432 - DNA, 23 bp, Artificial Sequence
  Synthetic Construct
agagctcagtctgtctctcatct

SEQ ID NO: 8433 - DNA, 22 bp, Artificial Sequence
  Synthetic Construct
acgcttgtaggcccaactacac

SEQ ID NO: 8434 - DNA, 24 bp, Artificial Sequence
  Synthetic Construct
tcagtgtccactctgagagctaag

SEQ ID NO: 8435 - DNA, 23 bp, Artificial Sequence
  Synthetic Construct
tctgagtgtttggaatggacgtt

SEQ ID NO: 8436 - DNA, 28 bp, Artificial Sequence
  Synthetic Construct
ccaatccctgaagtctgtattacaagac

SEQ ID NO: 8437 - DNA, 24 bp, Artificial Sequence
  Synthetic Construct
gggactgggagacacatctattga

SEQ ID NO: 8438 - DNA, 20 bp, Artificial Sequence
  Synthetic Construct
ccctcctccctcaccactag

SEQ ID NO: 8439 - DNA, 22 bp, Artificial Sequence
  Synthetic Construct
agcgtagtgggtgggaaatctg

SEQ ID NO: 8440 - DNA, 21 bp, Artificial Sequence
  Synthetic Construct
gcctgtcatcctcctcgatgt

SEQ ID NO: 8441 - DNA, 24 bp, Artificial Sequence
  Synthetic Construct
gcacagtgattcagagagcagctt

SEQ ID NO: 8442 - DNA, 24 bp, Artificial Sequence
  Synthetic Construct
agctcagtccccaggttattagga

SEQ ID NO: 8443 - DNA, 24 bp, Artificial Sequence
  Synthetic Construct
tgcttgaaccccatcctttatgtc

SEQ ID NO: 8444 - DNA, 24 bp, Artificial Sequence
  Synthetic Construct
cctgaagagagtctacagccaatg

SEQ ID NO: 8445 - DNA, 21 bp, Artificial Sequence
  Synthetic Construct
agctaaccatggcctctgagt

SEQ ID NO: 8446 - DNA, 26 bp, Artificial Sequence
  Synthetic Construct
tgtattactgcatgcctagtccctaa

SEQ ID NO: 8447 - DNA, 19 bp, Artificial Sequence
  Synthetic Construct
tgcccaggggtggctctgt

SEQ ID NO: 8448 - DNA, 21 bp, Artificial Sequence
  Synthetic Construct
tgtgcctgatgtggtgaactt

SEQ ID NO: 8449 - DNA, 23 bp, Artificial Sequence
  Synthetic Construct
tcggaggggttcagtaacactca

SEQ ID NO: 8450 - DNA, 22 bp, Artificial Sequence
  Synthetic Construct
ccaacttcagctgctccactta

SEQ ID NO: 8451 - DNA, 21 bp, Artificial Sequence
  Synthetic Construct
tctcctgcagcccactatgtg

SEQ ID NO: 8452 - DNA, 20 bp, Artificial Sequence
  Synthetic Construct
atcccctgatgcccccactt

SEQ ID NO: 8453 - DNA, 24 bp, Artificial Sequence
  Synthetic Construct
tggaagcctcaagtcctcttcctt

SEQ ID NO: 8454 - DNA, 20 bp, Artificial Sequence
  Synthetic Construct
gcagatgacagccccttgtt

SEQ ID NO: 8455 - DNA, 25 bp, Artificial Sequence
  Synthetic Construct
tcagaccttcagaaacccatcattt

SEQ ID NO: 8456 - DNA, 24 bp, Artificial Sequence
  Synthetic Construct
cccatcctgaacctctagcaacta

SEQ ID NO: 8457 - DNA, 24 bp, Artificial Sequence
  Synthetic Construct
agagagactgaggatatggctgat

SEQ ID NO: 8458 - DNA, 21 bp, Artificial Sequence
  Synthetic Construct
accctgatggtttgcaccttt

SEQ ID NO: 8459 - DNA, 24 bp, Artificial Sequence
  Synthetic Construct
cagatcccacccacataggttaga

SEQ ID NO: 8460 - DNA, 26 bp, Artificial Sequence
  Synthetic Construct
gctcttgccaatgtttctagtgatga

SEQ ID NO: 8461 - DNA, 22 bp, Artificial Sequence
  Synthetic Construct
acagggacttccaagggagaca

SEQ ID NO: 8462 - DNA, 21 bp, Artificial Sequence
  Synthetic Construct
aggctttgtgctcctgtgatt

SEQ ID NO: 8463 - DNA, 24 bp, Artificial Sequence
  Synthetic Construct
acctacagggcattaggtgttacc

SEQ ID NO: 8464 - DNA, 26 bp, Artificial Sequence
  Synthetic Construct
acaagctcataaactcattgcacatt

SEQ ID NO: 8465 - DNA, 24 bp, Artificial Sequence
  Synthetic Construct
gccctgaattctgtgtctgcagat

SEQ ID NO: 8466 - DNA, 22 bp, Artificial Sequence
  Synthetic Construct
gcatatgtgctgtcgacaaagg

SEQ ID NO: 8467 - DNA, 24 bp, Artificial Sequence
  Synthetic Construct
caccacaccagacactgaagatag

SEQ ID NO: 8468 - DNA, 22 bp, Artificial Sequence
  Synthetic Construct
tgcaggtggtctgaggatcaca

SEQ ID NO: 8469 - DNA, 22 bp, Artificial Sequence
  Synthetic Construct
tgcagccttagaggagggagta

SEQ ID NO: 8470 - DNA, 25 bp, Artificial Sequence
  Synthetic Construct
cagtggcttttcatggtgaaatagc

SEQ ID NO: 8471 - DNA, 22 bp, Artificial Sequence
  Synthetic Construct
agctgagtgtcacctgtttctg

SEQ ID NO: 8472 - DNA, 21 bp, Artificial Sequence
  Synthetic Construct
tcctatcagcacccgccagaa

SEQ ID NO: 8473 - DNA, 22 bp, Artificial Sequence
  Synthetic Construct
caccttgcacttctggaagtct

SEQ ID NO: 8474 - DNA, 24 bp, Artificial Sequence
  Synthetic Construct
ctgcccgttgaatacatttaagca

SEQ ID NO: 8475 - DNA, 25 bp, Artificial Sequence
  Synthetic Construct
gagtactgggcacaaacaggtataa

SEQ ID NO: 8476 - DNA, 19 bp, Artificial Sequence
  Synthetic Construct
tgccttggtgacgccactt

SEQ ID NO: 8477 - DNA, 20 bp, Artificial Sequence
  Synthetic Construct
tcgggtctcagcagcccaat

SEQ ID NO: 8478 - DNA, 24 bp, Artificial Sequence
  Synthetic Construct
aaatactgttcacaagcccatgtg

SEQ ID NO: 8479 - DNA, 24 bp, Artificial Sequence
  Synthetic Construct
acattctttcctaactgccacaca

SEQ ID NO: 8480 - DNA, 25 bp, Artificial Sequence
  Synthetic Construct
ctcagcaaaggtaaagtgtgtagca

SEQ ID NO: 8481 - DNA, 27 bp, Artificial Sequence
  Synthetic Construct
ccagcagcaatgagaatgtatctgtag

SEQ ID NO: 8482 - DNA, 25 bp, Artificial Sequence
  Synthetic Construct
ccgtgaacttcctcttctagcaaac

SEQ ID NO: 8483 - DNA, 22 bp, Artificial Sequence
  Synthetic Construct
gcattcctcaagcaaccctaga

SEQ ID NO: 8484 - DNA, 21 bp, Artificial Sequence
  Synthetic Construct
tgtgttccaagccctgtagtg

SEQ ID NO: 8485 - DNA, 22 bp, Artificial Sequence
  Synthetic Construct
atccttgcaggtcattccaaca

SEQ ID NO: 8486 - DNA, 25 bp, Artificial Sequence
  Synthetic Construct
ttgtgactgttcatggctgtatagt

SEQ ID NO: 8487 - DNA, 22 bp, Artificial Sequence
  Synthetic Construct
cctgcagtgcttcattcaaagg

SEQ ID NO: 8488 - DNA, 23 bp, Artificial Sequence
  Synthetic Construct
acacttccctccatgcctctcta

SEQ ID NO: 8489 - DNA, 26 bp, Artificial Sequence
  Synthetic Construct
cccaactgaagataaccgatgcatgt

SEQ ID NO: 8490 - DNA, 28 bp, Artificial Sequence
  Synthetic Construct
caaaagttcccagagtgtatttaatcca

SEQ ID NO: 8491 - DNA, 28 bp, Artificial Sequence
  Synthetic Construct
ggcttattccccaaatggttcaatcatg

SEQ ID NO: 8492 - DNA, 23 bp, Artificial Sequence
  Synthetic Construct
gaaagctctcagggttaccagtt

SEQ ID NO: 8493 - DNA, 24 bp, Artificial Sequence
  Synthetic Construct
gactgagtgaatgaagagcagcta

SEQ ID NO: 8494 - DNA, 23 bp, Artificial Sequence
  Synthetic Construct
tccccctacaggctatggattag

SEQ ID NO: 8495 - DNA, 23 bp, Artificial Sequence
  Synthetic Construct
agtttcatagttgccccctttgt

SEQ ID NO: 8496 - DNA, 20 bp, Artificial Sequence
  Synthetic Construct
gctggctgttggaggacaga

SEQ ID NO: 8497 - DNA, 21 bp, Artificial Sequence
  Synthetic Construct
actgggacctcctctgcagat

SEQ ID NO: 8498 - DNA, 22 bp, Artificial Sequence
  Synthetic Construct
tgctgtctcttctaggcaaagg

SEQ ID NO: 8499 - DNA, 24 bp, Artificial Sequence
  Synthetic Construct
ctctccttcaaggtgcttctgaga

SEQ ID NO: 8500 - DNA, 22 bp, Artificial Sequence
  Synthetic Construct
gagactgcagtgaaccatcagt

SEQ ID NO: 8501 - DNA, 24 bp, Artificial Sequence
  Synthetic Construct
tgcctggcaatgttagataaggat

SEQ ID NO: 8502 - DNA, 24 bp, Artificial Sequence
  Synthetic Construct
gctgctttccctcttgttacacaa

SEQ ID NO: 8503 - DNA, 21 bp, Artificial Sequence
  Synthetic Construct
tgctgaatctgtggtgagctt

SEQ ID NO: 8504 - DNA, 21 bp, Artificial Sequence
  Synthetic Construct
aagtggccactgaagtcgatt

SEQ ID NO: 8505 - DNA, 28 bp, Artificial Sequence
  Synthetic Construct
ggaatcaaagcacctttatttactgctt

SEQ ID NO: 8506 - DNA, 21 bp, Artificial Sequence
  Synthetic Construct
agcccagagatccaagcactt

SEQ ID NO: 8507 - DNA, 26 bp, Artificial Sequence
  Synthetic Construct
agacttggagtaatctttgccttctt

SEQ ID NO: 8508 - DNA, 25 bp, Artificial Sequence
  Synthetic Construct
cctcaattttcaccccactcttctt

SEQ ID NO: 8509 - DNA, 24 bp, Artificial Sequence
  Synthetic Construct
agggtgaaattcctccagattcag

SEQ ID NO: 8510 - DNA, 22 bp, Artificial Sequence
  Synthetic Construct
agctcatcagcacatgagttca

SEQ ID NO: 8511 - DNA, 23 bp, Artificial Sequence
  Synthetic Construct
cctgtcacatgcagctatcaatg

SEQ ID NO: 8512 - DNA, 19 bp, Artificial Sequence
  Synthetic Construct
ggtgatgccagggctcaat

SEQ ID NO: 8513 - DNA, 29 bp, Artificial Sequence
  Synthetic Construct
ccattcttcccatcctctctaataatagg

SEQ ID NO: 8514 - DNA, 19 bp, Artificial Sequence
  Synthetic Construct
gctggggctcttctgcttt

SEQ ID NO: 8515 - DNA, 22 bp, Artificial Sequence
  Synthetic Construct
gagctcacatgccagattccat

SEQ ID NO: 8516 - DNA, 22 bp, Artificial Sequence
  Synthetic Construct
cctgggtagcactgtcttcaat

SEQ ID NO: 8517 - DNA, 25 bp, Artificial Sequence
  Synthetic Construct
tgcacggctaagcagtaagggactt

SEQ ID NO: 8518 - DNA, 27 bp, Artificial Sequence
  Synthetic Construct
gtctctcggggtaatttttctctatcc

SEQ ID NO: 8519 - DNA, 20 bp, Artificial Sequence
  Synthetic Construct
tgcaaacaggatggctgaca

SEQ ID NO: 8520 - DNA, 21 bp, Artificial Sequence
  Synthetic Construct
agccatgtccctgactaacct

SEQ ID NO: 8521 - DNA, 23 bp, Artificial Sequence
  Synthetic Construct
ctgaagggtaaaggcatgggtta

SEQ ID NO: 8522 - DNA, 24 bp, Artificial Sequence
  Synthetic Construct
ccagcagtgatgaccaaagatgac

SEQ ID NO: 8523 - DNA, 24 bp, Artificial Sequence
  Synthetic Construct
caaggtaatttgcctgagctttgg

SEQ ID NO: 8524 - DNA, 25 bp, Artificial Sequence
  Synthetic Construct
gcacattgctagctgagagaaacag

SEQ ID NO: 8525 - DNA, 21 bp, Artificial Sequence
  Synthetic Construct
tgccaagatcgtcgcagtgat

SEQ ID NO: 8526 - DNA, 21 bp, Artificial Sequence
  Synthetic Construct
gggaaccccaaacccttcttg

SEQ ID NO: 8527 - DNA, 21 bp, Artificial Sequence
  Synthetic Construct
agccaggtgcagtatgggaaa

SEQ ID NO: 8528 - DNA, 21 bp, Artificial Sequence
  Synthetic Construct
ctcatgcttgcctctggacaa

SEQ ID NO: 8529 - DNA, 25 bp, Artificial Sequence
  Synthetic Construct
gacccaaaactgaaactgagatgca

SEQ ID NO: 8530 - DNA, 22 bp, Artificial Sequence
  Synthetic Construct
ggccagcatttcttggatcctt

SEQ ID NO: 8531 - DNA, 24 bp, Artificial Sequence
  Synthetic Construct
ccccaggatagacaacatttggat

SEQ ID NO: 8532 - DNA, 22 bp, Artificial Sequence
  Synthetic Construct
tccaattggccacaagcttcgt

SEQ ID NO: 8533 - DNA, 22 bp, Artificial Sequence
  Synthetic Construct
gctcccctgacatcccactttt

SEQ ID NO: 8534 - DNA, 25 bp, Artificial Sequence
  Synthetic Construct
agatgttggggttcataagggaaac

SEQ ID NO: 8535 - DNA, 27 bp, Artificial Sequence
  Synthetic Construct
gccattatctctccaggtgtttactgt

SEQ ID NO: 8536 - DNA, 20 bp, Artificial Sequence
  Synthetic Construct
ccaggttgactgcacacaca

SEQ ID NO: 8537 - DNA, 22 bp, Artificial Sequence
  Synthetic Construct
ctggaccttggttaagcactga

SEQ ID NO: 8538 - DNA, 22 bp, Artificial Sequence
  Synthetic Construct
ctgggttctagtcctggttgtg

SEQ ID NO: 8539 - DNA, 25 bp, Artificial Sequence
  Synthetic Construct
gcaaagaggctgctactcagattca

SEQ ID NO: 8540 - DNA, 21 bp, Artificial Sequence
  Synthetic Construct
agtcaaaaggcaggaggcaaa

SEQ ID NO: 8541 - DNA, 21 bp, Artificial Sequence
  Synthetic Construct
agaaaagggcccactggtctt

SEQ ID NO: 8542 - DNA, 24 bp, Artificial Sequence
  Synthetic Construct
ccaatccactccacataccattgt

SEQ ID NO: 8543 - DNA, 24 bp, Artificial Sequence
  Synthetic Construct
ctgtaaagtctctggtgtcaaggt

SEQ ID NO: 8544 - DNA, 20 bp, Artificial Sequence
  Synthetic Construct
tggtcctggcttctgtgact

SEQ ID NO: 8545 - DNA, 27 bp, Artificial Sequence
  Synthetic Construct
gcattccgaacactgaattgttaagtg

SEQ ID NO: 8546 - DNA, 23 bp, Artificial Sequence
  Synthetic Construct
gactcagcttggggaattctctt

SEQ ID NO: 8547 - DNA, 22 bp, Artificial Sequence
  Synthetic Construct
gaggggctactagaagcaaacc

SEQ ID NO: 8548 - DNA, 27 bp, Artificial Sequence
  Synthetic Construct
gaatgcccctgataagctttaatgatg

SEQ ID NO: 8549 - DNA, 24 bp, Artificial Sequence
  Synthetic Construct
cacaaagagcagcaaatcacatca

SEQ ID NO: 8550 - DNA, 22 bp, Artificial Sequence
  Synthetic Construct
cagcaaatggtcccacaggatt

SEQ ID NO: 8551 - DNA, 26 bp, Artificial Sequence
  Synthetic Construct
gcccaattgcaatatttccgaatgca

SEQ ID NO: 8552 - DNA, 21 bp, Artificial Sequence
  Synthetic Construct
aaaagggatgtggtgcgatct

SEQ ID NO: 8553 - DNA, 21 bp, Artificial Sequence
  Synthetic Construct
aggcaacaggtggtcaaatga

SEQ ID NO: 8554 - DNA, 23 bp, Artificial Sequence
  Synthetic Construct
cgcattacttcccatcctaccaa

SEQ ID NO: 8555 - DNA, 21 bp, Artificial Sequence
  Synthetic Construct
tggctgtcagtctgcatgtgt

SEQ ID NO: 8556 - DNA, 22 bp, Artificial Sequence
  Synthetic Construct
acaagatccagggttgctctgt

SEQ ID NO: 8557 - DNA, 21 bp, Artificial Sequence
  Synthetic Construct
ttggggttgtcacctgttgca

SEQ ID NO: 8558 - DNA, 23 bp, Artificial Sequence
  Synthetic Construct
aagagggtacaagggaggcttct

SEQ ID NO: 8559 - DNA, 26 bp, Artificial Sequence
  Synthetic Construct
agaggagaagtggagactattacagt

SEQ ID NO: 8560 - DNA, 24 bp, Artificial Sequence
  Synthetic Construct
gcacagtaggaaaagtctgttgtg

SEQ ID NO: 8561 - DNA, 25 bp, Artificial Sequence
  Synthetic Construct
aagactcacctctccttctatcctt

SEQ ID NO: 8562 - DNA, 25 bp, Artificial Sequence
  Synthetic Construct
tgaacctagttcctgctcctatgat

SEQ ID NO: 8563 - DNA, 22 bp, Artificial Sequence
  Synthetic Construct
acccctttcaagccaaggatgt

SEQ ID NO: 8564 - DNA, 22 bp, Artificial Sequence
  Synthetic Construct
gggaaacccaacctcctgacta

SEQ ID NO: 8565 - DNA, 24 bp, Artificial Sequence
  Synthetic Construct
cctaacctgctctcaagcttttgc

SEQ ID NO: 8566 - DNA, 21 bp, Artificial Sequence
  Synthetic Construct
aacctggccactccaaccata

SEQ ID NO: 8567 - DNA, 22 bp, Artificial Sequence
  Synthetic Construct
tggtgggtatatggagggtgtt

SEQ ID NO: 8568 - DNA, 19 bp, Artificial Sequence
  Synthetic Construct
tggaagaggggggcatctg

SEQ ID NO: 8569 - DNA, 22 bp, Artificial Sequence
  Synthetic Construct
tgttggttgtgtctcccatgca

SEQ ID NO: 8570 - DNA, 20 bp, Artificial Sequence
  Synthetic Construct
acctgcatcatggcctgaca

SEQ ID NO: 8571 - DNA, 19 bp, Artificial Sequence
  Synthetic Construct
aggagcatgtggcctcaga

SEQ ID NO: 8572 - DNA, 23 bp, Artificial Sequence
  Synthetic Construct
ccttagaggaacaaggcctgact

SEQ ID NO: 8573 - DNA, 23 bp, Artificial Sequence
  Synthetic Construct
caagacagtttcccatcctgaca

SEQ ID NO: 8574 - DNA, 19 bp, Artificial Sequence
  Synthetic Construct
gcgttgtgctgtccattgg

SEQ ID NO: 8575 - DNA, 21 bp, Artificial Sequence
  Synthetic Construct
tttgcaggccttggacatggt

SEQ ID NO: 8576 - DNA, 25 bp, Artificial Sequence
  Synthetic Construct
actggtccaatttagtcaccatgat

SEQ ID NO: 8577 - DNA, 26 bp, Artificial Sequence
  Synthetic Construct
gctcattcttgccctcctgtaagtac

SEQ ID NO: 8578 - DNA, 26 bp, Artificial Sequence
  Synthetic Construct
gctaagaggctcttaggtagcagtag

SEQ ID NO: 8579 - DNA, 21 bp, Artificial Sequence
  Synthetic Construct
gctgtggctgttttcctgcta

SEQ ID NO: 8580 - DNA, 24 bp, Artificial Sequence
  Synthetic Construct
ctcctccctctagttcttctgtgt

SEQ ID NO: 8581 - DNA, 24 bp, Artificial Sequence
  Synthetic Construct
ccttccctcctcctcaaaaactgt

SEQ ID NO: 8582 - DNA, 25 bp, Artificial Sequence
  Synthetic Construct
gactccattgaaacaaaggcaagag

SEQ ID NO: 8583 - DNA, 25 bp, Artificial Sequence
  Synthetic Construct
ccctcttttatggggcatgcattct

SEQ ID NO: 8584 - DNA, 20 bp, Artificial Sequence
  Synthetic Construct
agccacagctctgacaacag

SEQ ID NO: 8585 - DNA, 25 bp, Artificial Sequence
  Synthetic Construct
caagcagacacaaggataagaggaa

SEQ ID NO: 8586 - DNA, 24 bp, Artificial Sequence
  Synthetic Construct
aacttttgtcactgagagggttga

SEQ ID NO: 8587 - DNA, 25 bp, Artificial Sequence
  Synthetic Construct
cacctgtttaccttcctagcctctt

SEQ ID NO: 8588 - DNA, 23 bp, Artificial Sequence
  Synthetic Construct
tccttgtccacctattgcagatg

SEQ ID NO: 8589 - DNA, 20 bp, Artificial Sequence
  Synthetic Construct
ggaggcctttggaccttgga

SEQ ID NO: 8590 - DNA, 23 bp, Artificial Sequence
  Synthetic Construct
accctggaggagatgaatcttga

SEQ ID NO: 8591 - DNA, 20 bp, Artificial Sequence
  Synthetic Construct
ctgcctgcctgaagttctga

SEQ ID NO: 8592 - DNA, 24 bp, Artificial Sequence
  Synthetic Construct
gcacgctcttcaaatcaaaacttc

SEQ ID NO: 8593 - DNA, 25 bp, Artificial Sequence
  Synthetic Construct
gctaccgtttgtttcccacctatct

SEQ ID NO: 8594 - DNA, 23 bp, Artificial Sequence
  Synthetic Construct
tgtaaggggttagtcctccacaa

SEQ ID NO: 8595 - DNA, 21 bp, Artificial Sequence
  Synthetic Construct
aggaaagagagctgggaggaa

SEQ ID NO: 8596 - DNA, 22 bp, Artificial Sequence
  Synthetic Construct
gtctgcttttgggtcaggatga

SEQ ID NO: 8597 - DNA, 21 bp, Artificial Sequence
  Synthetic Construct
atccccctgctttctggacaa

SEQ ID NO: 8598 - DNA, 22 bp, Artificial Sequence
  Synthetic Construct
cctttctcaactcctggttgct

SEQ ID NO: 8599 - DNA, 25 bp, Artificial Sequence
  Synthetic Construct
cccttttcaccacactgatgtttgc

SEQ ID NO: 8600 - DNA, 22 bp, Artificial Sequence
  Synthetic Construct
aggtgaagcctcctgtcattct

SEQ ID NO: 8601 - DNA, 22 bp, Artificial Sequence
  Synthetic Construct
caggtcacagcaggaaaacaac

SEQ ID NO: 8602 - DNA, 21 bp, Artificial Sequence
  Synthetic Construct
agggagtgaatggtggcagaa

SEQ ID NO: 8603 - DNA, 21 bp, Artificial Sequence
  Synthetic Construct
acagtgaggaaggctgagcat

SEQ ID NO: 8604 - DNA, 28 bp, Artificial Sequence
  Synthetic Construct
ggccatgacattaagattgcttgaattc

SEQ ID NO: 8605 - DNA, 21 bp, Artificial Sequence
  Synthetic Construct
aggctgggctactggagatag

SEQ ID NO: 8606 - DNA, 22 bp, Artificial Sequence
  Synthetic Construct
actctgaactcgctgtgtcctt

SEQ ID NO: 8607 - DNA, 27 bp, Artificial Sequence
  Synthetic Construct
ccctctattgatcctgttggagtttgg

SEQ ID NO: 8608 - DNA, 20 bp, Artificial Sequence
  Synthetic Construct
tgaccaggtctccagtgctt

SEQ ID NO: 8609 - DNA, 22 bp, Artificial Sequence
  Synthetic Construct
cctccctccatcctgtgagata

SEQ ID NO: 8610 - DNA, 22 bp, Artificial Sequence
  Synthetic Construct
catcagcaagggccatttctga

SEQ ID NO: 8611 - DNA, 22 bp, Artificial Sequence
  Synthetic Construct
cacaacaatcctgggactgaga

SEQ ID NO: 8612 - DNA, 22 bp, Artificial Sequence
  Synthetic Construct
atgcccagtataccaggagtca

SEQ ID NO: 8613 - DNA, 27 bp, Artificial Sequence
  Synthetic Construct
gccaaaaaggattattcccaggtcttg

SEQ ID NO: 8614 - DNA, 20 bp, Artificial Sequence
  Synthetic Construct
aggctccccatggactgtca

SEQ ID NO: 8615 - DNA, 25 bp, Artificial Sequence
  Synthetic Construct
tgatttcctctgtgctttctacctt

SEQ ID NO: 8616 - DNA, 22 bp, Artificial Sequence
  Synthetic Construct
ctgatgaccacactgtctgcat

SEQ ID NO: 8617 - DNA, 24 bp, Artificial Sequence
  Synthetic Construct
cactcccttaccaagaagcagtct

SEQ ID NO: 8618 - DNA, 22 bp, Artificial Sequence
  Synthetic Construct
aaggtccgtgcaggttacaagt

SEQ ID NO: 8619 - DNA, 24 bp, Artificial Sequence
  Synthetic Construct
gggcatcatacagtgaaggacttg

SEQ ID NO: 8620 - DNA, 25 bp, Artificial Sequence
  Synthetic Construct
aattgagggcaattagctaggatca

SEQ ID NO: 8621 - DNA, 26 bp, Artificial Sequence
  Synthetic Construct
agtaagaaaaagaatgggctctcagt

SEQ ID NO: 8622 - DNA, 24 bp, Artificial Sequence
  Synthetic Construct
tcctagtgccagtatccgtttctg

SEQ ID NO: 8623 - DNA, 23 bp, Artificial Sequence
  Synthetic Construct
gtgccctcaaaaaccacttaagg

SEQ ID NO: 8624 - DNA, 26 bp, Artificial Sequence
  Synthetic Construct
cactttagagcagggtataacatgga

SEQ ID NO: 8625 - DNA, 22 bp, Artificial Sequence
  Synthetic Construct
cccagttgttgtgctgaaatgg

SEQ ID NO: 8626 - DNA, 22 bp, Artificial Sequence
  Synthetic Construct
tgggggttttttggctcatggt

SEQ ID NO: 8627 - DNA, 22 bp, Artificial Sequence
  Synthetic Construct
actttacagtggggaggctaga

SEQ ID NO: 8628 - DNA, 22 bp, Artificial Sequence
  Synthetic Construct
gccctttcccatcttgtacctt

SEQ ID NO: 8629 - DNA, 30 bp, Artificial Sequence
  Synthetic Construct
aaattagttccattttagtgatcgccttaa

SEQ ID NO: 8630 - DNA, 25 bp, Artificial Sequence
  Synthetic Construct
gcacagcactggatatcttaattgc

SEQ ID NO: 8631 - DNA, 26 bp, Artificial Sequence
  Synthetic Construct
ctggaaattacaaagctcacttgact

SEQ ID NO: 8632 - DNA, 22 bp, Artificial Sequence
  Synthetic Construct
ggtcttaccatggcgaaactct

SEQ ID NO: 8633 - DNA, 22 bp, Artificial Sequence
  Synthetic Construct
aagagggactgtggtgaaagtg

SEQ ID NO: 8634 - DNA, 22 bp, Artificial Sequence
  Synthetic Construct
acaactgcaagaacaggaccaa

SEQ ID NO: 8635 - DNA, 20 bp, Artificial Sequence
  Synthetic Construct
cagccccaagactcccaaag

SEQ ID NO: 8636 - DNA, 26 bp, Artificial Sequence
  Synthetic Construct
agccagaaggtgtatattaggattgg

SEQ ID NO: 8637 - DNA, 27 bp, Artificial Sequence
  Synthetic Construct
ggtggggagtgttttacaggaatagat

SEQ ID NO: 8638 - DNA, 23 bp, Artificial Sequence
  Synthetic Construct
gcttgcattgcttcacactatgt

SEQ ID NO: 8639 - DNA, 29 bp, Artificial Sequence
  Synthetic Construct
ggcagagttaaagttctttagatcaacca

SEQ ID NO: 8640 - DNA, 25 bp, Artificial Sequence
  Synthetic Construct
cgacgccactttatccctcttaaac

SEQ ID NO: 8641 - DNA, 21 bp, Artificial Sequence
  Synthetic Construct
acatcctcccagtcagtgcta

SEQ ID NO: 8642 - DNA, 24 bp, Artificial Sequence
  Synthetic Construct
ggtactgtccttccatccacaact

SEQ ID NO: 8643 - DNA, 22 bp, Artificial Sequence
  Synthetic Construct
ctggcacaaccttgcttagttc

SEQ ID NO: 8644 - DNA, 25 bp, Artificial Sequence
  Synthetic Construct
accaactggtcattcaggaacatag

SEQ ID NO: 8645 - DNA, 22 bp, Artificial Sequence
  Synthetic Construct
gctcaagcatcctccactcctt

SEQ ID NO: 8646 - DNA, 23 bp, Artificial Sequence
  Synthetic Construct
gctcacttgagtgccacttacag

SEQ ID NO: 8647 - DNA, 25 bp, Artificial Sequence
  Synthetic Construct
cctcccatttacagcacaattcact

SEQ ID NO: 8648 - DNA, 20 bp, Artificial Sequence
  Synthetic Construct
gccctccatgacttcgctta

SEQ ID NO: 8649 - DNA, 21 bp, Artificial Sequence
  Synthetic Construct
ccttgccactcctctccctat

SEQ ID NO: 8650 - DNA, 24 bp, Artificial Sequence
  Synthetic Construct
gtcctatggctgttctttcccata

SEQ ID NO: 8651 - DNA, 26 bp, Artificial Sequence
  Synthetic Construct
cttctcctatatcctccacagatcct

SEQ ID NO: 8652 - DNA, 22 bp, Artificial Sequence
  Synthetic Construct
ctgctgccatttgaccatatgc

SEQ ID NO: 8653 - DNA, 23 bp, Artificial Sequence
  Synthetic Construct
ccacaaaggcaaggatacaatgg

SEQ ID NO: 8654 - DNA, 24 bp, Artificial Sequence
  Synthetic Construct
caccattcaaggtgctatggagat

SEQ ID NO: 8655 - DNA, 24 bp, Artificial Sequence
  Synthetic Construct
ggtttggagttaaggaaggtttgg

SEQ ID NO: 8656 - DNA, 21 bp, Artificial Sequence
  Synthetic Construct
gccatgcactcacttgctaca

SEQ ID NO: 8657 - DNA, 25 bp, Artificial Sequence
  Synthetic Construct
caaaatgtgccggaaaaggttatgt

SEQ ID NO: 8658 - DNA, 24 bp, Artificial Sequence
  Synthetic Construct
cggctcaggtaggagatcattcta

SEQ ID NO: 8659 - DNA, 21 bp, Artificial Sequence
  Synthetic Construct
tcctgttgcccagttctgctt

SEQ ID NO: 8660 - DNA, 22 bp, Artificial Sequence
  Synthetic Construct
cttcgctgcacttgagtcaaaa

SEQ ID NO: 8661 - DNA, 24 bp, Artificial Sequence
  Synthetic Construct
gcaccctatcatcagctttacaga

SEQ ID NO: 8662 - DNA, 24 bp, Artificial Sequence
  Synthetic Construct
tcctcaccccaatctaaggacaca

SEQ ID NO: 8663 - DNA, 22 bp, Artificial Sequence
  Synthetic Construct
tgtttgtggaccatgtgggaat

SEQ ID NO: 8664 - DNA, 28 bp, Artificial Sequence
  Synthetic Construct
acagaaatatcttgtccttcagagaact

SEQ ID NO: 8665 - DNA, 27 bp, Artificial Sequence
  Synthetic Construct
cacacatgcctcattaccattaacatc

SEQ ID NO: 8666 - DNA, 27 bp, Artificial Sequence
  Synthetic Construct
ccactgattcaaggacttttgcgtaga

SEQ ID NO: 8667 - DNA, 23 bp, Artificial Sequence
  Synthetic Construct
gggcaagtagtcaacgttactga

SEQ ID NO: 8668 - DNA, 25 bp, Artificial Sequence
  Synthetic Construct
ccaagcaagttctatgactgtgaac

SEQ ID NO: 8669 - DNA, 21 bp, Artificial Sequence
  Synthetic Construct
ttccccacgttggttcctttt

SEQ ID NO: 8670 - DNA, 23 bp, Artificial Sequence
  Synthetic Construct
gagggtaggggcattatcttcag

SEQ ID NO: 8671 - DNA, 24 bp, Artificial Sequence
  Synthetic Construct
tgggatccaggccagtattatacg

SEQ ID NO: 8672 - DNA, 23 bp, Artificial Sequence
  Synthetic Construct
ctgcagtttgaccctttctacca

SEQ ID NO: 8673 - DNA, 19 bp, Artificial Sequence
  Synthetic Construct
agctctgggctcaggaagt

SEQ ID NO: 8674 - DNA, 25 bp, Artificial Sequence
  Synthetic Construct
cctcctcacagttagtgtacacctt

SEQ ID NO: 8675 - DNA, 26 bp, Artificial Sequence
  Synthetic Construct
gactgagtgcaaactaatgttgactt

SEQ ID NO: 8676 - DNA, 20 bp, Artificial Sequence
  Synthetic Construct
cagcactgcttggcatgaac

SEQ ID NO: 8677 - DNA, 23 bp, Artificial Sequence
  Synthetic Construct
aggggaagggggagctatactta

SEQ ID NO: 8678 - DNA, 22 bp, Artificial Sequence
  Synthetic Construct
tgcttgccggcttaagtgtcat

SEQ ID NO: 8679 - DNA, 25 bp, Artificial Sequence
  Synthetic Construct
gagtaattcagccatcctgctctag

SEQ ID NO: 8680 - DNA, 22 bp, Artificial Sequence
  Synthetic Construct
caacttcttgcccttgtttcgt

SEQ ID NO: 8681 - DNA, 28 bp, Artificial Sequence
  Synthetic Construct
gagtctgtaaaatggctcagaaatttcc

SEQ ID NO: 8682 - DNA, 22 bp, Artificial Sequence
  Synthetic Construct
tgcacagacagaggccaaattc

SEQ ID NO: 8683 - DNA, 27 bp, Artificial Sequence
  Synthetic Construct
gtgattctcattgcacattctttctct

SEQ ID NO: 8684 - DNA, 26 bp, Artificial Sequence
  Synthetic Construct
cagacttccacttgctctaagtaagg

SEQ ID NO: 8685 - DNA, 22 bp, Artificial Sequence
  Synthetic Construct
tgggacatggttgtgacaagga

SEQ ID NO: 8686 - DNA, 22 bp, Artificial Sequence
  Synthetic Construct
tacttggctcccagacaacatc

SEQ ID NO: 8687 - DNA, 22 bp, Artificial Sequence
  Synthetic Construct
atggcaacccactcctcccttt

SEQ ID NO: 8688 - DNA, 24 bp, Artificial Sequence
  Synthetic Construct
tcggagacacactgtagtttctca

SEQ ID NO: 8689 - DNA, 23 bp, Artificial Sequence
  Synthetic Construct
cttttcctgagtgcgcgttcctt

SEQ ID NO: 8690 - DNA, 19 bp, Artificial Sequence
  Synthetic Construct
tgcctcctcagggaagcat

SEQ ID NO: 8691 - DNA, 19 bp, Artificial Sequence
  Synthetic Construct
ggggagccaatgtgcttct

SEQ ID NO: 8692 - DNA, 24 bp, Artificial Sequence
  Synthetic Construct
gtgctgcagagtgaggagatatga

SEQ ID NO: 8693 - DNA, 21 bp, Artificial Sequence
  Synthetic Construct
cgcagctgctgtacactaacg

SEQ ID NO: 8694 - DNA, 22 bp, Artificial Sequence
  Synthetic Construct
actgcaactccttgaggtcaag

SEQ ID NO: 8695 - DNA, 22 bp, Artificial Sequence
  Synthetic Construct
tccttgacctggggatgatgga

SEQ ID NO: 8696 - DNA, 21 bp, Artificial Sequence
  Synthetic Construct
aagagccaagcttgtcaacca

SEQ ID NO: 8697 - DNA, 24 bp, Artificial Sequence
  Synthetic Construct
catggacccaagacctaggattct

SEQ ID NO: 8698 - DNA, 22 bp, Artificial Sequence
  Synthetic Construct
gtgccatctagggacctaggaa

SEQ ID NO: 8699 - DNA, 24 bp, Artificial Sequence
  Synthetic Construct
agaagaggcagtgagaacctaact

SEQ ID NO: 8700 - DNA, 25 bp, Artificial Sequence
  Synthetic Construct
cctaggtcgctttaagtcacaaagc

SEQ ID NO: 8701 - DNA, 25 bp, Artificial Sequence
  Synthetic Construct
agtgaaggcacagttttatccagtt

SEQ ID NO: 8702 - DNA, 22 bp, Artificial Sequence
  Synthetic Construct
tctctgggcttaaagggaaagc

SEQ ID NO: 8703 - DNA, 22 bp, Artificial Sequence
  Synthetic Construct
gggaagtgggcataaccttgtt

SEQ ID NO: 8704 - DNA, 23 bp, Artificial Sequence
  Synthetic Construct
gcagcaaaaatggttctcatcct

SEQ ID NO: 8705 - DNA, 25 bp, Artificial Sequence
  Synthetic Construct
ccaacctccagtaaagcatcaactc

SEQ ID NO: 8706 - DNA, 22 bp, Artificial Sequence
  Synthetic Construct
acccagcactgaccttcctaat

SEQ ID NO: 8707 - DNA, 24 bp, Artificial Sequence
  Synthetic Construct
cctccttgtcttcccactgctttt

SEQ ID NO: 8708 - DNA, 22 bp, Artificial Sequence
  Synthetic Construct
gggaaaacagactctgccttga

SEQ ID NO: 8709 - DNA, 27 bp, Artificial Sequence
  Synthetic Construct
gtaaagcttcagtcaatcagtgtgatt

SEQ ID NO: 8710 - DNA, 21 bp, Artificial Sequence
  Synthetic Construct
tggaggatttggtgccagaga

SEQ ID NO: 8711 - DNA, 20 bp, Artificial Sequence
  Synthetic Construct
tgacaccctgctgctgtcta

SEQ ID NO: 8712 - DNA, 24 bp, Artificial Sequence
  Synthetic Construct
gtttctgaagggcatatggcttca

SEQ ID NO: 8713 - DNA, 23 bp, Artificial Sequence
  Synthetic Construct
cagcaacccccaaccatgataaa

SEQ ID NO: 8714 - DNA, 22 bp, Artificial Sequence
  Synthetic Construct
ggggccatgtgagaagaaatgt

SEQ ID NO: 8715 - DNA, 22 bp, Artificial Sequence
  Synthetic Construct
tccccaccatgaactctgtcta

SEQ ID NO: 8716 - DNA, 23 bp, Artificial Sequence
  Synthetic Construct
tcctgctacaagtctcagatggt

SEQ ID NO: 8717 - DNA, 24 bp, Artificial Sequence
  Synthetic Construct
gcacccttaatgtccagacataca

SEQ ID NO: 8718 - DNA, 22 bp, Artificial Sequence
  Synthetic Construct
ttcaacagcacggtgatcctaa

SEQ ID NO: 8719 - DNA, 20 bp, Artificial Sequence
  Synthetic Construct
atgtgctggtcttggcagtt

SEQ ID NO: 8720 - DNA, 20 bp, Artificial Sequence
  Synthetic Construct
accctcctcagcacaaagca

SEQ ID NO: 8721 - DNA, 24 bp, Artificial Sequence
  Synthetic Construct
gcccccttctttcttaggataggt

SEQ ID NO: 8722 - DNA, 19 bp, Artificial Sequence
  Synthetic Construct
ccaatggggcagcaagaca

SEQ ID NO: 8723 - DNA, 21 bp, Artificial Sequence
  Synthetic Construct
ctgctgacaccaaaccagttg

SEQ ID NO: 8724 - DNA, 22 bp, Artificial Sequence
  Synthetic Construct
tgagtccaggcctagactctct

SEQ ID NO: 8725 - DNA, 22 bp, Artificial Sequence
  Synthetic Construct
tcctccaaccctgtctttgaac

SEQ ID NO: 8726 - DNA, 23 bp, Artificial Sequence
  Synthetic Construct
cagagaaggcattgacagtggat

SEQ ID NO: 8727 - DNA, 22 bp, Artificial Sequence
  Synthetic Construct
gcccctgctgaaaattctggtt

SEQ ID NO: 8728 - DNA, 21 bp, Artificial Sequence
  Synthetic Construct
agccctgcttcctcctacata

SEQ ID NO: 8729 - DNA, 22 bp, Artificial Sequence
  Synthetic Construct
gagtgcaggtgtctggaagatc

SEQ ID NO: 8730 - DNA, 25 bp, Artificial Sequence
  Synthetic Construct
ctgagtcctatctgtctctggacat

SEQ ID NO: 8731 - DNA, 24 bp, Artificial Sequence
  Synthetic Construct
agccttgaggttaaaggtcatctc

SEQ ID NO: 8732 - DNA, 24 bp, Artificial Sequence
  Synthetic Construct
gggttgatgcacatgcccttaaac

SEQ ID NO: 8733 - DNA, 24 bp, Artificial Sequence
  Synthetic Construct
ttgcaaacatgctctcattgagtt

SEQ ID NO: 8734 - DNA, 22 bp, Artificial Sequence
  Synthetic Construct
gcaaggagaaacagtgcacaag

SEQ ID NO: 8735 - DNA, 24 bp, Artificial Sequence
  Synthetic Construct
gcacttgtgggagagagaacacaa

SEQ ID NO: 8736 - DNA, 24 bp, Artificial Sequence
  Synthetic Construct
ctctgaaccctgtaactacagcaa

SEQ ID NO: 8737 - DNA, 25 bp, Artificial Sequence
  Synthetic Construct
cctgttgtttccgagaaagacaaac

SEQ ID NO: 8738 - DNA, 23 bp, Artificial Sequence
  Synthetic Construct
gaaaacttcagccaaagccatct

SEQ ID NO: 8739 - DNA, 24 bp, Artificial Sequence
  Synthetic Construct
gcccagattcttgcagaaccagaa

SEQ ID NO: 8740 - DNA, 22 bp, Artificial Sequence
  Synthetic Construct
tggccttatactggctcctgtt

SEQ ID NO: 8741 - DNA, 25 bp, Artificial Sequence
  Synthetic Construct
agtcaaccttcttacttccaaagca

SEQ ID NO: 8742 - DNA, 25 bp, Artificial Sequence
  Synthetic Construct
agaggatttctctccccacttttct

SEQ ID NO: 8743 - DNA, 24 bp, Artificial Sequence
  Synthetic Construct
gcaaccagcctagaaatcaatcca

SEQ ID NO: 8744 - DNA, 28 bp, Artificial Sequence
  Synthetic Construct
gcttgcactataggtaaaggcaaaatct

SEQ ID NO: 8745 - DNA, 24 bp, Artificial Sequence
  Synthetic Construct
ctgggaacatgactgtctaggaaa

SEQ ID NO: 8746 - DNA, 21 bp, Artificial Sequence
  Synthetic Construct
acaccctgtggagatgttcga

SEQ ID NO: 8747 - DNA, 25 bp, Artificial Sequence
  Synthetic Construct
caagtgaaaccctaagctcttcttg

SEQ ID NO: 8748 - DNA, 26 bp, Artificial Sequence
  Synthetic Construct
atgcaaagccacacagtagtttatac

SEQ ID NO: 8749 - DNA, 22 bp, Artificial Sequence
  Synthetic Construct
ggaacagaagctggtttgcttt

SEQ ID NO: 8750 - DNA, 25 bp, Artificial Sequence
  Synthetic Construct
atgcagactcacagttctaattgga

SEQ ID NO: 8751 - DNA, 26 bp, Artificial Sequence
  Synthetic Construct
ccctggagctctaagtaaacttgaag

SEQ ID NO: 8752 - DNA, 24 bp, Artificial Sequence
  Synthetic Construct
gacttcaaagctggttccattcaa

SEQ ID NO: 8753 - DNA, 22 bp, Artificial Sequence
  Synthetic Construct
cttcacctttcacttgcttgca

SEQ ID NO: 8754 - DNA, 23 bp, Artificial Sequence
  Synthetic Construct
ggttctgcagagtcattggtctt

SEQ ID NO: 8755 - DNA, 22 bp, Artificial Sequence
  Synthetic Construct
tctcagttcgcaggctaagatc

SEQ ID NO: 8756 - DNA, 20 bp, Artificial Sequence
  Synthetic Construct
agacacacctgggaccagaa

SEQ ID NO: 8757 - DNA, 23 bp, Artificial Sequence
  Synthetic Construct
cagaatggctgactttgcatgag

SEQ ID NO: 8758 - DNA, 26 bp, Artificial Sequence
  Synthetic Construct
cagtatgactgatcacaagaccaagt

SEQ ID NO: 8759 - DNA, 24 bp, Artificial Sequence
  Synthetic Construct
cgatactgcaaggcaagtcctatg

SEQ ID NO: 8760 - DNA, 22 bp, Artificial Sequence
  Synthetic Construct
ttgttcctgtgggtgtgagcta

SEQ ID NO: 8761 - DNA, 21 bp, Artificial Sequence
  Synthetic Construct
tgtgccagtcctctcccttat

SEQ ID NO: 8762 - DNA, 25 bp, Artificial Sequence
  Synthetic Construct
agttcaaaacacacaagtgctaacc

SEQ ID NO: 8763 - DNA, 24 bp, Artificial Sequence
  Synthetic Construct
gttcgtgtttattcagcagagctt

SEQ ID NO: 8764 - DNA, 20 bp, Artificial Sequence
  Synthetic Construct
gctcctgtgcaacccaaaag

SEQ ID NO: 8765 - DNA, 21 bp, Artificial Sequence
  Synthetic Construct
gtgtttgtggccatgtgtcaa

SEQ ID NO: 8766 - DNA, 20 bp, Artificial Sequence
  Synthetic Construct
aagagcaccctccaggttca

SEQ ID NO: 8767 - DNA, 24 bp, Artificial Sequence
  Synthetic Construct
agctctagatgaggctgagactaa

SEQ ID NO: 8768 - DNA, 26 bp, Artificial Sequence
  Synthetic Construct
ccttcatctcttgtgccatcttacct

SEQ ID NO: 8769 - DNA, 24 bp, Artificial Sequence
  Synthetic Construct
acctccaggacagaagtacaatct

SEQ ID NO: 8770 - DNA, 20 bp, Artificial Sequence
  Synthetic Construct
gcccctttcccgtgattctt

SEQ ID NO: 8771 - DNA, 24 bp, Artificial Sequence
  Synthetic Construct
aggtggaggagtcagatggatgta

SEQ ID NO: 8772 - DNA, 25 bp, Artificial Sequence
  Synthetic Construct
ggttagagaaaaacccacccattgt

SEQ ID NO: 8773 - DNA, 24 bp, Artificial Sequence
  Synthetic Construct
cagtgttgacagccaactctttcc

SEQ ID NO: 8774 - DNA, 22 bp, Artificial Sequence
  Synthetic Construct
ccccaatccaatccctgaagac

SEQ ID NO: 8775 - DNA, 24 bp, Artificial Sequence
  Synthetic Construct
gggtgatgtcccttcaggaagaaa

SEQ ID NO: 8776 - DNA, 20 bp, Artificial Sequence
  Synthetic Construct
tggccgtgacatcaacaact

SEQ ID NO: 8777 - DNA, 20 bp, Artificial Sequence
  Synthetic Construct
aggcacccctcctccttatc

SEQ ID NO: 8778 - DNA, 24 bp, Artificial Sequence
  Synthetic Construct
gagcagaggagtggttttaagagt

SEQ ID NO: 8779 - DNA, 19 bp, Artificial Sequence
  Synthetic Construct
aaggtccacccacctttgc

SEQ ID NO: 8780 - DNA, 30 bp, Artificial Sequence
  Synthetic Construct
ctagctactaagtactttcaaggactctac

SEQ ID NO: 8781 - DNA, 26 bp, Artificial Sequence
  Synthetic Construct
gccttggaaggttttctgggacatag

SEQ ID NO: 8782 - DNA, 25 bp, Artificial Sequence
  Synthetic Construct
acacagaggtagaagtggacttaga

SEQ ID NO: 8783 - DNA, 20 bp, Artificial Sequence
  Synthetic Construct
acctggctccctggatacca

SEQ ID NO: 8784 - DNA, 22 bp, Artificial Sequence
  Synthetic Construct
tgtgtctgcacctttcctatcg

SEQ ID NO: 8785 - DNA, 23 bp, Artificial Sequence
  Synthetic Construct
gctgggattgaaaggagatgaca

SEQ ID NO: 8786 - DNA, 27 bp, Artificial Sequence
  Synthetic Construct
tgtttgcagccaataacttatgtagtg

SEQ ID NO: 8787 - DNA, 24 bp, Artificial Sequence
  Synthetic Construct
cagtagggtgagccaagataccat

SEQ ID NO: 8788 - DNA, 22 bp, Artificial Sequence
  Synthetic Construct
aaaaccagtggacacctgtgat

SEQ ID NO: 8789 - DNA, 22 bp, Artificial Sequence
  Synthetic Construct
tgggtagctcctaacagcagtt

SEQ ID NO: 8790 - DNA, 25 bp, Artificial Sequence
  Synthetic Construct
ggcatctagaatggatttggtcaca

SEQ ID NO: 8791 - DNA, 22 bp, Artificial Sequence
  Synthetic Construct
ccttggccagaactcaaccaaa

SEQ ID NO: 8792 - DNA, 24 bp, Artificial Sequence
  Synthetic Construct
ggcagctgaaactgtagctgtaag

SEQ ID NO: 8793 - DNA, 22 bp, Artificial Sequence
  Synthetic Construct
ctggcctggaaagattgacctt

SEQ ID NO: 8794 - DNA, 28 bp, Artificial Sequence
  Synthetic Construct
cataaagtacattccatggtggcatatt

SEQ ID NO: 8795 - DNA, 19 bp, Artificial Sequence
  Synthetic Construct
ccttgggctggcttttgga

SEQ ID NO: 8796 - DNA, 23 bp, Artificial Sequence
  Synthetic Construct
gggtggcagagtttcaagataga

SEQ ID NO: 8797 - DNA, 22 bp, Artificial Sequence
  Synthetic Construct
cacacatgccttccatccatct

SEQ ID NO: 8798 - DNA, 24 bp, Artificial Sequence
  Synthetic Construct
ggtcaccttggatactctgaaacc

SEQ ID NO: 8799 - DNA, 22 bp, Artificial Sequence
  Synthetic Construct
ccgtgatcacacagctggttta

SEQ ID NO: 8800 - DNA, 24 bp, Artificial Sequence
  Synthetic Construct
cctggcaaggaaagcttctttaca

SEQ ID NO: 8801 - DNA, 21 bp, Artificial Sequence
  Synthetic Construct
tgtagtgtcgggccaaatcag

SEQ ID NO: 8802 - DNA, 26 bp, Artificial Sequence
  Synthetic Construct
ctctatctctgtctcgcttcagattc

SEQ ID NO: 8803 - DNA, 23 bp, Artificial Sequence
  Synthetic Construct
accctttgtctctcactcccttt

SEQ ID NO: 8804 - DNA, 22 bp, Artificial Sequence
  Synthetic Construct
caactggcacaaatgaggcatt

SEQ ID NO: 8805 - DNA, 28 bp, Artificial Sequence
  Synthetic Construct
gaaaattacttggaactgtaagggcatt

SEQ ID NO: 8806 - DNA, 21 bp, Artificial Sequence
  Synthetic Construct
ccaaaccctcctcccttttgt

SEQ ID NO: 8807 - DNA, 24 bp, Artificial Sequence
  Synthetic Construct
tcatagctgtggaagttgtagcaa

SEQ ID NO: 8808 - DNA, 24 bp, Artificial Sequence
  Synthetic Construct
ggcactcaaaccacacggaaatac

SEQ ID NO: 8809 - DNA, 21 bp, Artificial Sequence
  Synthetic Construct
agttttgccccagggatacag

SEQ ID NO: 8810 - DNA, 24 bp, Artificial Sequence
  Synthetic Construct
gcaaagtaccctacctaaccaaca

SEQ ID NO: 8811 - DNA, 22 bp, Artificial Sequence
  Synthetic Construct
tcccttctggctcaggatatgt

SEQ ID NO: 8812 - DNA, 24 bp, Artificial Sequence
  Synthetic Construct
gtaagtttgccaaaccctgctaaa

SEQ ID NO: 8813 - DNA, 27 bp, Artificial Sequence
  Synthetic Construct
gccacaaggaaacaaatctgacaacag

SEQ ID NO: 8814 - DNA, 23 bp, Artificial Sequence
  Synthetic Construct
ccacaccaacatagtgcacttga

SEQ ID NO: 8815 - DNA, 22 bp, Artificial Sequence
  Synthetic Construct
tttgggagtctgccttctcctt

SEQ ID NO: 8816 - DNA, 26 bp, Artificial Sequence
  Synthetic Construct
cctcgtggagaaaatacctgtgttag

SEQ ID NO: 8817 - DNA, 25 bp, Artificial Sequence
  Synthetic Construct
gtcaactgctatgtgtcagagtttg

SEQ ID NO: 8818 - DNA, 29 bp, Artificial Sequence
  Synthetic Construct
ccctggaacatgttaacagacttaattag

SEQ ID NO: 8819 - DNA, 25 bp, Artificial Sequence
  Synthetic Construct
actgttccagctcagtttcctaaac

SEQ ID NO: 8820 - DNA, 27 bp, Artificial Sequence
  Synthetic Construct
atacttataaacccaagctctgtcact

SEQ ID NO: 8821 - DNA, 22 bp, Artificial Sequence
  Synthetic Construct
gttccttagcccacatgtggtt

SEQ ID NO: 8822 - DNA, 23 bp, Artificial Sequence
  Synthetic Construct
tgagcttgtgtggaagtgattca

SEQ ID NO: 8823 - DNA, 25 bp, Artificial Sequence
  Synthetic Construct
gggttcccaatgcatacagaaatcc

SEQ ID NO: 8824 - DNA, 26 bp, Artificial Sequence
  Synthetic Construct
gtcacctttgacctgtttcttagtgt

SEQ ID NO: 8825 - DNA, 22 bp, Artificial Sequence
  Synthetic Construct
aggtgtgaacaggtgaccaact

SEQ ID NO: 8826 - DNA, 21 bp, Artificial Sequence
  Synthetic Construct
accctaggagcaaggctgtgt

SEQ ID NO: 8827 - DNA, 27 bp, Artificial Sequence
  Synthetic Construct
acagccctgtaaataccctctgggttt

SEQ ID NO: 8828 - DNA, 27 bp, Artificial Sequence
  Synthetic Construct
agactccaaatatcaagctctcagaat

SEQ ID NO: 8829 - DNA, 27 bp, Artificial Sequence
  Synthetic Construct
ctagaaagatgaagatcctgaggttca

SEQ ID NO: 8830 - DNA, 25 bp, Artificial Sequence
  Synthetic Construct
ggtgagtccatcagacattccttca

SEQ ID NO: 8831 - DNA, 23 bp, Artificial Sequence
  Synthetic Construct
acacattcccatctgcttgagat

SEQ ID NO: 8832 - DNA, 21 bp, Artificial Sequence
  Synthetic Construct
aaagctgcagcagatgagaca

SEQ ID NO: 8833 - DNA, 29 bp, Artificial Sequence
  Synthetic Construct
gattccttatcaccacccttttattcttt

SEQ ID NO: 8834 - DNA, 26 bp, Artificial Sequence
  Synthetic Construct
gctgtacagtcaaggttatccttctc

SEQ ID NO: 8835 - DNA, 23 bp, Artificial Sequence
  Synthetic Construct
gcaccccattcaatgcacacaaa

SEQ ID NO: 8836 - DNA, 22 bp, Artificial Sequence
  Synthetic Construct
acttcttctggcatgccactct

SEQ ID NO: 8837 - DNA, 24 bp, Artificial Sequence
  Synthetic Construct
gtaggggcttcagactcattacac

SEQ ID NO: 8838 - DNA, 24 bp, Artificial Sequence
  Synthetic Construct
gggagatggaggttgtgggattaa

SEQ ID NO: 8839 - DNA, 25 bp, Artificial Sequence
  Synthetic Construct
ggcagagatgattgatacggactac

SEQ ID NO: 8840 - DNA, 24 bp, Artificial Sequence
  Synthetic Construct
gcctactaagaactgctctcaact

SEQ ID NO: 8841 - DNA, 27 bp, Artificial Sequence
  Synthetic Construct
gatagaggaagaaaagtcaaggaccat

SEQ ID NO: 8842 - DNA, 23 bp, Artificial Sequence
  Synthetic Construct
ccctctggaagatgcagttacag

SEQ ID NO: 8843 - DNA, 19 bp, Artificial Sequence
  Synthetic Construct
cgactgcatcgtgcctgta

SEQ ID NO: 8844 - DNA, 27 bp, Artificial Sequence
  Synthetic Construct
ggagaggctgtgtctctagtaattgag

SEQ ID NO: 8845 - DNA, 26 bp, Artificial Sequence
  Synthetic Construct
gcaggtattgaatcacagttgtggtt

SEQ ID NO: 8846 - DNA, 26 bp, Artificial Sequence
  Synthetic Construct
gaaaacaatcaggctctttgtttcct

SEQ ID NO: 8847 - DNA, 21 bp, Artificial Sequence
  Synthetic Construct
caggagaacttgaggcaggtt

SEQ ID NO: 8848 - DNA, 23 bp, Artificial Sequence
  Synthetic Construct
gcagcctagaccataaggactac

SEQ ID NO: 8849 - DNA, 26 bp, Artificial Sequence
  Synthetic Construct
acatatgctgcttcattctgactgaa

SEQ ID NO: 8850 - DNA, 21 bp, Artificial Sequence
  Synthetic Construct
gtcatcagggttgtgcttcct

SEQ ID NO: 8851 - DNA, 25 bp, Artificial Sequence
  Synthetic Construct
cctgagggtcagattccttcacatt

SEQ ID NO: 8852 - DNA, 22 bp, Artificial Sequence
  Synthetic Construct
acaccctagctgcttctagtca

SEQ ID NO: 8853 - DNA, 25 bp, Artificial Sequence
  Synthetic Construct
ccaagctacttgaagacaccatacc

SEQ ID NO: 8854 - DNA, 24 bp, Artificial Sequence
  Synthetic Construct
cccaccccacaatgagatataagg

SEQ ID NO: 8855 - DNA, 21 bp, Artificial Sequence
  Synthetic Construct
gcagcttgctccatcaggtat

SEQ ID NO: 8856 - DNA, 24 bp, Artificial Sequence
  Synthetic Construct
gacctctgagaaacgacacttaca

SEQ ID NO: 8857 - DNA, 24 bp, Artificial Sequence
  Synthetic Construct
agcatgttttcaaggggatttgac

SEQ ID NO: 8858 - DNA, 24 bp, Artificial Sequence
  Synthetic Construct
cctgaacctggagttaaggtacca

SEQ ID NO: 8859 - DNA, 24 bp, Artificial Sequence
  Synthetic Construct
gggaatctggtgaagacaatgaga

SEQ ID NO: 8860 - DNA, 24 bp, Artificial Sequence
  Synthetic Construct
gttttgtcagcattgcatttggtt

SEQ ID NO: 8861 - DNA, 24 bp, Artificial Sequence
  Synthetic Construct
gactcaactcaaagcaaccaagga

SEQ ID NO: 8862 - DNA, 26 bp, Artificial Sequence
  Synthetic Construct
gagccaggattttagattgagcaatc

SEQ ID NO: 8863 - DNA, 27 bp, Artificial Sequence
  Synthetic Construct
ccaagtacctgatattgctccctcttt

SEQ ID NO: 8864 - DNA, 23 bp, Artificial Sequence
  Synthetic Construct
tttggtgctgaaaccaggtatga

SEQ ID NO: 8865 - DNA, 27 bp, Artificial Sequence
  Synthetic Construct
gagtgtaaacatactgggactaagtca

SEQ ID NO: 8866 - DNA, 25 bp, Artificial Sequence
  Synthetic Construct
ctgattcagtctgtgcaaaccatag

SEQ ID NO: 8867 - DNA, 23 bp, Artificial Sequence
  Synthetic Construct
cagttcaaactgtgttggctgaa

SEQ ID NO: 8868 - DNA, 22 bp, Artificial Sequence
  Synthetic Construct
tgctgcagggtggtagagtgta

SEQ ID NO: 8869 - DNA, 25 bp, Artificial Sequence
  Synthetic Construct
tgtcaagactgtttgttgggaaaag

SEQ ID NO: 8870 - DNA, 22 bp, Artificial Sequence
  Synthetic Construct
gagacaccagcagtgatacaca

SEQ ID NO: 8871 - DNA, 23 bp, Artificial Sequence
  Synthetic Construct
tgctgatcttccagtctgttcag

SEQ ID NO: 8872 - DNA, 25 bp, Artificial Sequence
  Synthetic Construct
ccctgatcaagtcctgactattctg

SEQ ID NO: 8873 - DNA, 24 bp, Artificial Sequence
  Synthetic Construct
agtggtccccagaaggtaatactc

SEQ ID NO: 8874 - DNA, 30 bp, Artificial Sequence
  Synthetic Construct
gacaggaaaggttctaagaagagaaagaag

SEQ ID NO: 8875 - DNA, 22 bp, Artificial Sequence
  Synthetic Construct
aagagaccaggaggaccactag

SEQ ID NO: 8876 - DNA, 19 bp, Artificial Sequence
  Synthetic Construct
aggtcccaaggtgctctga

SEQ ID NO: 8877 - DNA, 26 bp, Artificial Sequence
  Synthetic Construct
cctaccgactgtgctatgaggataag

SEQ ID NO: 8878 - DNA, 27 bp, Artificial Sequence
  Synthetic Construct
ccaaaaaaaggggcacaatatctagtg

SEQ ID NO: 8879 - DNA, 26 bp, Artificial Sequence
  Synthetic Construct
cctcacagcattctgaacaactatgg

SEQ ID NO: 8880 - DNA, 24 bp, Artificial Sequence
  Synthetic Construct
tgtgtttttgtggtagtgggtgtt

SEQ ID NO: 8881 - DNA, 22 bp, Artificial Sequence
  Synthetic Construct
gccctgcagttggatgtcatat

SEQ ID NO: 8882 - DNA, 25 bp, Artificial Sequence
  Synthetic Construct
aaataggcagagaatgaagctacca

SEQ ID NO: 8883 - DNA, 26 bp, Artificial Sequence
  Synthetic Construct
gggaagtggtaatcctatgccttatt

SEQ ID NO: 8884 - DNA, 27 bp, Artificial Sequence
  Synthetic Construct
acgcaccttaattagttcgtagttttg

SEQ ID NO: 8885 - DNA, 24 bp, Artificial Sequence
  Synthetic Construct
cagcaaaaggtgtttccagaaaga

SEQ ID NO: 8886 - DNA, 26 bp, Artificial Sequence
  Synthetic Construct
ggtaagaaaccagatttgggaaaagg

SEQ ID NO: 8887 - DNA, 22 bp, Artificial Sequence
  Synthetic Construct
tggaagttttgtcccagcaagt

SEQ ID NO: 8888 - DNA, 24 bp, Artificial Sequence
  Synthetic Construct
gccctttcaaatacctggaaagca

SEQ ID NO: 8889 - DNA, 24 bp, Artificial Sequence
  Synthetic Construct
ggaaggggcatggtcatactcata

SEQ ID NO: 8890 - DNA, 30 bp, Artificial Sequence
  Synthetic Construct
gcttacaagagccagataatttagtttgag

SEQ ID NO: 8891 - DNA, 22 bp, Artificial Sequence
  Synthetic Construct
gggagaatcctctgggtttgtg

SEQ ID NO: 8892 - DNA, 23 bp, Artificial Sequence
  Synthetic Construct
acggtgatcccagtctctttaac

SEQ ID NO: 8893 - DNA, 29 bp, Artificial Sequence
  Synthetic Construct
ttcgacatatgttaaaaaggggtttcttt

SEQ ID NO: 8894 - DNA, 28 bp, Artificial Sequence
  Synthetic Construct
gtcagagcttattggagaagaaactcat

SEQ ID NO: 8895 - DNA, 25 bp, Artificial Sequence
  Synthetic Construct
gagaatctgtgcactttgggaagaa

SEQ ID NO: 8896 - DNA, 20 bp, Artificial Sequence
  Synthetic Construct
aacaacaggcctgcccagaa

SEQ ID NO: 8897 - DNA, 25 bp, Artificial Sequence
  Synthetic Construct
caggtatttgatggcaccaattcat

SEQ ID NO: 8898 - DNA, 23 bp, Artificial Sequence
  Synthetic Construct
acatgctttcaagagcctcagat

SEQ ID NO: 8899 - DNA, 24 bp, Artificial Sequence
  Synthetic Construct
cagtcctccttctaactgcattcc

SEQ ID NO: 8900 - DNA, 27 bp, Artificial Sequence
  Synthetic Construct
gcaagccaaaaatgaaagagtgaatcc

SEQ ID NO: 8901 - DNA, 25 bp, Artificial Sequence
  Synthetic Construct
tgcactctttttcccagttgaaaaa

SEQ ID NO: 8902 - DNA, 24 bp, Artificial Sequence
  Synthetic Construct
gcccagacactgatgaatgtccat

SEQ ID NO: 8903 - DNA, 26 bp, Artificial Sequence
  Synthetic Construct
tcctaccaatgtcatctcatctccta

SEQ ID NO: 8904 - DNA, 29 bp, Artificial Sequence
  Synthetic Construct
tgatgttatcaagtcattcattccaagtg

SEQ ID NO: 8905 - DNA, 23 bp, Artificial Sequence
  Synthetic Construct
attcctcttggttgagggacaag

SEQ ID NO: 8906 - DNA, 30 bp, Artificial Sequence
  Synthetic Construct
cccagagacatattctatagaggagatgag

SEQ ID NO: 8907 - DNA, 24 bp, Artificial Sequence
  Synthetic Construct
ggctggagtgagggtttttagagt

SEQ ID NO: 8908 - DNA, 26 bp, Artificial Sequence
  Synthetic Construct
agtactctgcatgatcattgaaaggt

SEQ ID NO: 8909 - DNA, 30 bp, Artificial Sequence
  Synthetic Construct
ctgattagtggtgcagttttagaatacatc

SEQ ID NO: 8910 - DNA, 28 bp, Artificial Sequence
  Synthetic Construct
agggattcaacaattaatcaaacatggt

SEQ ID NO: 8911 - DNA, 23 bp, Artificial Sequence
  Synthetic Construct
ctgaaacctcagtgcaaactgtt

SEQ ID NO: 8912 - DNA, 24 bp, Artificial Sequence
  Synthetic Construct
gcagggacacatgacctattgaga

SEQ ID NO: 8913 - DNA, 29 bp, Artificial Sequence
  Synthetic Construct
ggtctggatatgtcgatagtaagaaagca

SEQ ID NO: 8914 - DNA, 22 bp, Artificial Sequence
  Synthetic Construct
gcagaaagagcaaagccatagc

SEQ ID NO: 8915 - DNA, 25 bp, Artificial Sequence
  Synthetic Construct
ggtgactcctaaattgccagacatg

SEQ ID NO: 8916 - DNA, 27 bp, Artificial Sequence
  Synthetic Construct
ccctgggttaaattttctggcttacac

SEQ ID NO: 8917 - DNA, 22 bp, Artificial Sequence
  Synthetic Construct
acctcaaccccttgtgagacaa

SEQ ID NO: 8918 - DNA, 27 bp, Artificial Sequence
  Synthetic Construct
gcctcatgctcgctgaaagtatttttg

SEQ ID NO: 8919 - DNA, 24 bp, Artificial Sequence
  Synthetic Construct
tggttggatggtcagagatttgaa

SEQ ID NO: 8920 - DNA, 20 bp, Artificial Sequence
  Synthetic Construct
tgtgcctaagcctggaactg

SEQ ID NO: 8921 - DNA, 25 bp, Artificial Sequence
  Synthetic Construct
ggctctggtttctatgaaccacctt

SEQ ID NO: 8922 - DNA, 21 bp, Artificial Sequence
  Synthetic Construct
tgacagcagcatgggaaatcc

SEQ ID NO: 8923 - DNA, 23 bp, Artificial Sequence
  Synthetic Construct
gtggcctagacagctcttaaagt

SEQ ID NO: 8924 - DNA, 22 bp, Artificial Sequence
  Synthetic Construct
tggcggaaagtgtttagctgaa

SEQ ID NO: 8925 - DNA, 26 bp, Artificial Sequence
  Synthetic Construct
tgcaatcatgtcttcatttgtttcca

SEQ ID NO: 8926 - DNA, 24 bp, Artificial Sequence
  Synthetic Construct
gtgatgccctttatcagcaagaca

SEQ ID NO: 8927 - DNA, 21 bp, Artificial Sequence
  Synthetic Construct
aggggcggagagacacaatga

SEQ ID NO: 8928 - DNA, 30 bp, Artificial Sequence
  Synthetic Construct
caagtattattttacctcccagacatcaga

SEQ ID NO: 8929 - DNA, 25 bp, Artificial Sequence
  Synthetic Construct
ggcagagattctgagccttatttgt

SEQ ID NO: 8930 - DNA, 27 bp, Artificial Sequence
  Synthetic Construct
agctcttttcacatgcaatagtgtatc

SEQ ID NO: 8931 - DNA, 29 bp, Artificial Sequence
  Synthetic Construct
tgaacatatgaaaaccatctgagtcaaga

SEQ ID NO: 8932 - DNA, 22 bp, Artificial Sequence
  Synthetic Construct
tgctctcacagctgaggaaatc

SEQ ID NO: 8933 - DNA, 26 bp, Artificial Sequence
  Synthetic Construct
aattatatggaggctgcactattcca

SEQ ID NO: 8934 - DNA, 23 bp, Artificial Sequence
  Synthetic Construct
accaggaaaaaagacaccccaaa

SEQ ID NO: 8935 - DNA, 25 bp, Artificial Sequence
  Synthetic Construct
ggtctttggtctctcctagtcattt

SEQ ID NO: 8936 - DNA, 30 bp, Artificial Sequence
  Synthetic Construct
aatctatttcacaacttgagagttttccaa

SEQ ID NO: 8937 - DNA, 24 bp, Artificial Sequence
  Synthetic Construct
tgcctctaccactgctatgattca

SEQ ID NO: 8938 - DNA, 28 bp, Artificial Sequence
  Synthetic Construct
tcagcagtttgataaaaatcaggtccta

SEQ ID NO: 8939 - DNA, 28 bp, Artificial Sequence
  Synthetic Construct
cctgatcaattccacctgctttaaatag

SEQ ID NO: 8940 - DNA, 22 bp, Artificial Sequence
  Synthetic Construct
agtctgacctccctgcttaacc

SEQ ID NO: 8941 - DNA, 21 bp, Artificial Sequence
  Synthetic Construct
aggaggcccctttctgtgtta

SEQ ID NO: 8942 - DNA, 29 bp, Artificial Sequence
  Synthetic Construct
cccttaatatcttcacttaacccctacat

SEQ ID NO: 8943 - DNA, 22 bp, Artificial Sequence
  Synthetic Construct
agcttctgcaaaaccccattcc

SEQ ID NO: 8944 - DNA, 23 bp, Artificial Sequence
  Synthetic Construct
agggaaggctaccagctctatga

SEQ ID NO: 8945 - DNA, 25 bp, Artificial Sequence
  Synthetic Construct
gacataatctgaaccagcaggtagt

SEQ ID NO: 8946 - DNA, 25 bp, Artificial Sequence
  Synthetic Construct
gcagttacaactcaggtgtctacca

SEQ ID NO: 8947 - DNA, 25 bp, Artificial Sequence
  Synthetic Construct
tcctttgacacaagaagatgaggtt

SEQ ID NO: 8948 - DNA, 25 bp, Artificial Sequence
  Synthetic Construct
tgttctttcttgccttgttccttga

SEQ ID NO: 8949 - DNA, 25 bp, Artificial Sequence
  Synthetic Construct
gtccagtctgccatcaaaaagaact

SEQ ID NO: 8950 - DNA, 22 bp, Artificial Sequence
  Synthetic Construct
gacaggcaatgtgatgcttcca

SEQ ID NO: 8951 - DNA, 26 bp, Artificial Sequence
  Synthetic Construct
tggtgtcttttgagtccattttcttg

SEQ ID NO: 8952 - DNA, 19 bp, Artificial Sequence
  Synthetic Construct
tggcccactgtgacagctt

SEQ ID NO: 8953 - DNA, 26 bp, Artificial Sequence
  Synthetic Construct
ctgttgcctaaatccctttctacatc

SEQ ID NO: 8954 - DNA, 26 bp, Artificial Sequence
  Synthetic Construct
acatttgccttcaggaagatccttag

SEQ ID NO: 8955 - DNA, 28 bp, Artificial Sequence
  Synthetic Construct
acaagtggatttctatgtgactctatca

SEQ ID NO: 8956 - DNA, 20 bp, Artificial Sequence
  Synthetic Construct
tggcctcaaacgcacactgt

SEQ ID NO: 8957 - DNA, 24 bp, Artificial Sequence
  Synthetic Construct
cggtgatcctgtacatggctaatc

SEQ ID NO: 8958 - DNA, 20 bp, Artificial Sequence
  Synthetic Construct
gccccatggagaggcctata

SEQ ID NO: 8959 - DNA, 26 bp, Artificial Sequence
  Synthetic Construct
caagtaaggtttaagccagtgatcag

SEQ ID NO: 8960 - DNA, 23 bp, Artificial Sequence
  Synthetic Construct
gcaggaatgttcaatcgcttcct

SEQ ID NO: 8961 - DNA, 26 bp, Artificial Sequence
  Synthetic Construct
gctttgttacccatatggtctagttg

SEQ ID NO: 8962 - DNA, 29 bp, Artificial Sequence
  Synthetic Construct
cagtatttcaagtgactgcagttatacag

SEQ ID NO: 8963 - DNA, 22 bp, Artificial Sequence
  Synthetic Construct
tgtagccatgactgaggcctat

SEQ ID NO: 8964 - DNA, 28 bp, Artificial Sequence
  Synthetic Construct
actgattactgaatactggccttaatct

SEQ ID NO: 8965 - DNA, 26 bp, Artificial Sequence
  Synthetic Construct
aggaagggatatgaaacatggcttaa

SEQ ID NO: 8966 - DNA, 22 bp, Artificial Sequence
  Synthetic Construct
cagggttccaatatggccaaca

SEQ ID NO: 8967 - DNA, 26 bp, Artificial Sequence
  Synthetic Construct
ccaacatatggtttcagaagcacaaa

SEQ ID NO: 8968 - DNA, 20 bp, Artificial Sequence
  Synthetic Construct
acatgttggtgggcacagaa

SEQ ID NO: 8969 - DNA, 20 bp, Artificial Sequence
  Synthetic Construct
ccctggccatcaaggagcta

SEQ ID NO: 8970 - DNA, 28 bp, Artificial Sequence
  Synthetic Construct
ggatattggcctgtagttttctctcctt

SEQ ID NO: 8971 - DNA, 28 bp, Artificial Sequence
  Synthetic Construct
gcaattgctggaccatataatgagacaa

SEQ ID NO: 8972 - DNA, 27 bp, Artificial Sequence
  Synthetic Construct
ggcagagtgatcattgattgataacca

SEQ ID NO: 8973 - DNA, 20 bp, Artificial Sequence
  Synthetic Construct
cctctgctgagctcctgtgt

SEQ ID NO: 8974 - DNA, 20 bp, Artificial Sequence
  Synthetic Construct
gcctccaccaccactacaca

SEQ ID NO: 8975 - DNA, 27 bp, Artificial Sequence
  Synthetic Construct
gtggaggaaattagatgtctgcttctg

SEQ ID NO: 8976 - DNA, 26 bp, Artificial Sequence
  Synthetic Construct
gacacacacaaaaggaactgtcagat

SEQ ID NO: 8977 - DNA, 20 bp, Artificial Sequence
  Synthetic Construct
agggcctgctgactcgttct

SEQ ID NO: 8978 - DNA, 22 bp, Artificial Sequence
  Synthetic Construct
agttctgtcccaatcccacaca

SEQ ID NO: 8979 - DNA, 23 bp, Artificial Sequence
  Synthetic Construct
gcttgaaagaagggcaaggaaac

SEQ ID NO: 8980 - DNA, 19 bp, Artificial Sequence
  Synthetic Construct
tccccactcctggcccttt

SEQ ID NO: 8981 - DNA, 24 bp, Artificial Sequence
  Synthetic Construct
actgggatttgactctggaacttg

SEQ ID NO: 8982 - DNA, 22 bp, Artificial Sequence
  Synthetic Construct
cagctagagcaaccacgatgaa

SEQ ID NO: 8983 - DNA, 23 bp, Artificial Sequence
  Synthetic Construct
gcctgaaaggtaggttgcaaacc

SEQ ID NO: 8984 - DNA, 24 bp, Artificial Sequence
  Synthetic Construct
agagtgataaaccaagcaccaaca

SEQ ID NO: 8985 - DNA, 22 bp, Artificial Sequence
  Synthetic Construct
acagcccttgtgtgcataaagg

SEQ ID NO: 8986 - DNA, 22 bp, Artificial Sequence
  Synthetic Construct
tctgcaccagtctcaggtcttc

SEQ ID NO: 8987 - DNA, 21 bp, Artificial Sequence
  Synthetic Construct
tttgcagaaagggctcaaacg

SEQ ID NO: 8988 - DNA, 18 bp, Artificial Sequence
  Synthetic Construct
gccaggcagcctcatggt

SEQ ID NO: 8989 - DNA, 19 bp, Artificial Sequence
  Synthetic Construct
tgcctccaagccacagaac

SEQ ID NO: 8990 - DNA, 19 bp, Artificial Sequence
  Synthetic Construct
ggtaccaggggcagaaggt

SEQ ID NO: 8991 - DNA, 22 bp, Artificial Sequence
  Synthetic Construct
aaagcccaagctcctcaacaag

SEQ ID NO: 8992 - DNA, 26 bp, Artificial Sequence
  Synthetic Construct
tgaaaacctaaacccttcatcaacct

SEQ ID NO: 8993 - DNA, 21 bp, Artificial Sequence
  Synthetic Construct
aagcccagagtagtgcatgca

SEQ ID NO: 8994 - DNA, 29 bp, Artificial Sequence
  Synthetic Construct
gttgacaaagtctagataacaaggagtca

SEQ ID NO: 8995 - DNA, 23 bp, Artificial Sequence
  Synthetic Construct
tcagtggcttctgcagaataaca

SEQ ID NO: 8996 - DNA, 28 bp, Artificial Sequence
  Synthetic Construct
ggagtcagacacaaataaatgggttcag

SEQ ID NO: 8997 - DNA, 21 bp, Artificial Sequence
  Synthetic Construct
ggctgggaaactgctatgcat

SEQ ID NO: 8998 - DNA, 26 bp, Artificial Sequence
  Synthetic Construct
cagatacatggaggtgaaagttgtgt

SEQ ID NO: 8999 - DNA, 24 bp, Artificial Sequence
  Synthetic Construct
cactgtgtatgactccccttaagg

SEQ ID NO: 9000 - DNA, 26 bp, Artificial Sequence
  Synthetic Construct
gctccaaaataactagcagcatgatg

SEQ ID NO: 9001 - DNA, 26 bp, Artificial Sequence
  Synthetic Construct
acaagactacaaagaggcattgaact

SEQ ID NO: 9002 - DNA, 22 bp, Artificial Sequence
  Synthetic Construct
aatgtgaggatggcaggcattg

SEQ ID NO: 9003 - DNA, 25 bp, Artificial Sequence
  Synthetic Construct
ggctgaaactaaaaatggcccagtt

SEQ ID NO: 9004 - DNA, 22 bp, Artificial Sequence
  Synthetic Construct
aggtcagggatgacaacaatcc

SEQ ID NO: 9005 - DNA, 19 bp, Artificial Sequence
  Synthetic Construct
tgcctggcacacatgatgt

SEQ ID NO: 9006 - DNA, 22 bp, Artificial Sequence
  Synthetic Construct
tgttcccatctcttgccatctc

SEQ ID NO: 9007 - DNA, 19 bp, Artificial Sequence
  Synthetic Construct
tgccagggtgggacagaca

SEQ ID NO: 9008 - DNA, 28 bp, Artificial Sequence
  Synthetic Construct
ctggtgaaccacaaacaattaaatgttt

SEQ ID NO: 9009 - DNA, 27 bp, Artificial Sequence
  Synthetic Construct
ggttgcctgagagctatacagaattgt

SEQ ID NO: 9010 - DNA, 19 bp, Artificial Sequence
  Synthetic Construct
aggcacccgcagtgattcc

SEQ ID NO: 9011 - DNA, 21 bp, Artificial Sequence
  Synthetic Construct
actggcagcaaaactcaacct

SEQ ID NO: 9012 - DNA, 23 bp, Artificial Sequence
  Synthetic Construct
tcctctaccctggaggcagtaaa

SEQ ID NO: 9013 - DNA, 18 bp, Artificial Sequence
  Synthetic Construct
gctgcaaggcccaactgt

SEQ ID NO: 9014 - DNA, 27 bp, Artificial Sequence
  Synthetic Construct
gaggactgacaggagatgttagtaaga

SEQ ID NO: 9015 - DNA, 25 bp, Artificial Sequence
  Synthetic Construct
agtacgtattcaacaggctaccatt

SEQ ID NO: 9016 - DNA, 22 bp, Artificial Sequence
  Synthetic Construct
actggaggcattttcacacctt

SEQ ID NO: 9017 - DNA, 20 bp, Artificial Sequence
  Synthetic Construct
tgtgctagcgtacccaatgg

SEQ ID NO: 9018 - DNA, 24 bp, Artificial Sequence
  Synthetic Construct
ggagaggaccacacaaagaaatgt

SEQ ID NO: 9019 - DNA, 21 bp, Artificial Sequence
  Synthetic Construct
cctaaagtgggtgggctactg

SEQ ID NO: 9020 - DNA, 27 bp, Artificial Sequence
  Synthetic Construct
tgtctcagataatgtcacggttaagtt

SEQ ID NO: 9021 - DNA, 23 bp, Artificial Sequence
  Synthetic Construct
agacccctggtttcatagagctt

SEQ ID NO: 9022 - DNA, 19 bp, Artificial Sequence
  Synthetic Construct
agcacacaggcaggaaggt

SEQ ID NO: 9023 - DNA, 21 bp, Artificial Sequence
  Synthetic Construct
aaccaccctgggagtaggaat

SEQ ID NO: 9024 - DNA, 20 bp, Artificial Sequence
  Synthetic Construct
catgagtccgaggccaccta

SEQ ID NO: 9025 - DNA, 18 bp, Artificial Sequence
  Synthetic Construct
aggggttgggtgccagtt

SEQ ID NO: 9026 - DNA, 18 bp, Artificial Sequence
  Synthetic Construct
tgatggccccagctgtct

SEQ ID NO: 9027 - DNA, 18 bp, Artificial Sequence
  Synthetic Construct
gccccaggtgtgctcagt

SEQ ID NO: 9028 - DNA, 18 bp, Artificial Sequence
  Synthetic Construct
gtggaggcctcgggagat

SEQ ID NO: 9029 - DNA, 24 bp, Artificial Sequence
  Synthetic Construct
actcgagatggaaccacttatcca

SEQ ID NO: 9030 - DNA, 20 bp, Artificial Sequence
  Synthetic Construct
ttggtgtgactgccgctttt

SEQ ID NO: 9031 - DNA, 30 bp, Artificial Sequence
  Synthetic Construct
cagactttaagaatggaaagctacattcaa

SEQ ID NO: 9032 - DNA, 21 bp, Artificial Sequence
  Synthetic Construct
aaccggggtgtccttggaatt

SEQ ID NO: 9033 - DNA, 24 bp, Artificial Sequence
  Synthetic Construct
ccacacttgccccaacttgataag

SEQ ID NO: 9034 - DNA, 25 bp, Artificial Sequence
  Synthetic Construct
gcagttgtagataccgagtgggttt

SEQ ID NO: 9035 - DNA, 23 bp, Artificial Sequence
  Synthetic Construct
ccaagatgtttccccatccatca

SEQ ID NO: 9036 - DNA, 21 bp, Artificial Sequence
  Synthetic Construct
tcacctgctcccttcctttct

SEQ ID NO: 9037 - DNA, 19 bp, Artificial Sequence
  Synthetic Construct
ggctgcaggctatgaacca

SEQ ID NO: 9038 - DNA, 26 bp, Artificial Sequence
  Synthetic Construct
agtcctgaaagacaaactaccaacat

SEQ ID NO: 9039 - DNA, 29 bp, Artificial Sequence
  Synthetic Construct
caagtgttcagtgtgaatttaaggaaatc

SEQ ID NO: 9040 - DNA, 25 bp, Artificial Sequence
  Synthetic Construct
gcacattcaagatcagagcaaagat

SEQ ID NO: 9041 - DNA, 24 bp, Artificial Sequence
  Synthetic Construct
ttgtcctcagaccactctcttttg

SEQ ID NO: 9042 - DNA, 22 bp, Artificial Sequence
  Synthetic Construct
gcccagcccatatctcattgaa

SEQ ID NO: 9043 - DNA, 24 bp, Artificial Sequence
  Synthetic Construct
tgtcacccaccattctaggttagg

SEQ ID NO: 9044 - DNA, 20 bp, Artificial Sequence
  Synthetic Construct
aaggatcccagcacctacca

SEQ ID NO: 9045 - DNA, 27 bp, Artificial Sequence
  Synthetic Construct
cctgatacttccttctagcaacacctt

SEQ ID NO: 9046 - DNA, 27 bp, Artificial Sequence
  Synthetic Construct
gctttttgattcaaactgttcccaagt

SEQ ID NO: 9047 - DNA, 19 bp, Artificial Sequence
  Synthetic Construct
atgcagctcagggcactgt

SEQ ID NO: 9048 - DNA, 22 bp, Artificial Sequence
  Synthetic Construct
ttgctgcccagacttcttagtc

SEQ ID NO: 9049 - DNA, 22 bp, Artificial Sequence
  Synthetic Construct
tgctctgccagagaaagcacaa

SEQ ID NO: 9050 - DNA, 21 bp, Artificial Sequence
  Synthetic Construct
atgtgcctcaacgccctatgg

SEQ ID NO: 9051 - DNA, 19 bp, Artificial Sequence
  Synthetic Construct
aggccctctgtccctagct

SEQ ID NO: 9052 - DNA, 21 bp, Artificial Sequence
  Synthetic Construct
caatctgtcagccaccatgct

SEQ ID NO: 9053 - DNA, 27 bp, Artificial Sequence
  Synthetic Construct
cccctttagcctcatcttatgctactg

SEQ ID NO: 9054 - DNA, 24 bp, Artificial Sequence
  Synthetic Construct
aggtgaggtctgttgggatttcag

SEQ ID NO: 9055 - DNA, 19 bp, Artificial Sequence
  Synthetic Construct
agggagcggaggccacact

SEQ ID NO: 9056 - DNA, 22 bp, Artificial Sequence
  Synthetic Construct
ccacactccccttccattatgg

SEQ ID NO: 9057 - DNA, 23 bp, Artificial Sequence
  Synthetic Construct
tgataaggcagctgagacacaaa

SEQ ID NO: 9058 - DNA, 25 bp, Artificial Sequence
  Synthetic Construct
ccatcccctcaaatcccatttctct

SEQ ID NO: 9059 - DNA, 21 bp, Artificial Sequence
  Synthetic Construct
agctccatgaggccagaaggt

SEQ ID NO: 9060 - DNA, 19 bp, Artificial Sequence
  Synthetic Construct
tgagggccagttgctgttc

SEQ ID NO: 9061 - DNA, 23 bp, Artificial Sequence
  Synthetic Construct
agctgtcctccaatccagactct

SEQ ID NO: 9062 - DNA, 20 bp, Artificial Sequence
  Synthetic Construct
tgcagcagctgaaacaacac

SEQ ID NO: 9063 - DNA, 26 bp, Artificial Sequence
  Synthetic Construct
tgagtgtactgaagcagaagttaact

SEQ ID NO: 9064 - DNA, 26 bp, Artificial Sequence
  Synthetic Construct
ctcaaatggttcagtggttcctttct

SEQ ID NO: 9065 - DNA, 19 bp, Artificial Sequence
  Synthetic Construct
acagccctgcaccaggtaa

SEQ ID NO: 9066 - DNA, 24 bp, Artificial Sequence
  Synthetic Construct
gtgtgtagtaggggtctgtagagt

SEQ ID NO: 9067 - DNA, 20 bp, Artificial Sequence
  Synthetic Construct
agagcagcgaagaggagaga

SEQ ID NO: 9068 - DNA, 23 bp, Artificial Sequence
  Synthetic Construct
cctgactccaaaaccttcactct

SEQ ID NO: 9069 - DNA, 22 bp, Artificial Sequence
  Synthetic Construct
aggctggagtaatgcccaacta

SEQ ID NO: 9070 - DNA, 30 bp, Artificial Sequence
  Synthetic Construct
cagaatacctggctatatttgtaccttgac

SEQ ID NO: 9071 - DNA, 20 bp, Artificial Sequence
  Synthetic Construct
ggcatccaccaggctaggat

SEQ ID NO: 9072 - DNA, 21 bp, Artificial Sequence
  Synthetic Construct
gttgagtttccagcccatcct

SEQ ID NO: 9073 - DNA, 23 bp, Artificial Sequence
  Synthetic Construct
ggggatagaggtttcggctttag

SEQ ID NO: 9074 - DNA, 24 bp, Artificial Sequence
  Synthetic Construct
ggcaccagcaaagagacatctaac

SEQ ID NO: 9075 - DNA, 22 bp, Artificial Sequence
  Synthetic Construct
ccatgaaggaggcttgtgttct

SEQ ID NO: 9076 - DNA, 25 bp, Artificial Sequence
  Synthetic Construct
agttctaaaaactggatgcctgttg

SEQ ID NO: 9077 - DNA, 22 bp, Artificial Sequence
  Synthetic Construct
tgtggtagccctgattcacaga

SEQ ID NO: 9078 - DNA, 30 bp, Artificial Sequence
  Synthetic Construct
cagctattctctctagaccttcctattaca

SEQ ID NO: 9079 - DNA, 24 bp, Artificial Sequence
  Synthetic Construct
caaaattctttggcactccttcca

SEQ ID NO: 9080 - DNA, 27 bp, Artificial Sequence
  Synthetic Construct
ggctgtaatgatagcctttgtgtttac

SEQ ID NO: 9081 - DNA, 28 bp, Artificial Sequence
  Synthetic Construct
gccctagcaatagtctgactatatttcc

SEQ ID NO: 9082 - DNA, 30 bp, Artificial Sequence
  Synthetic Construct
gcctttttcttcttaggaggagatttctca

SEQ ID NO: 9083 - DNA, 22 bp, Artificial Sequence
  Synthetic Construct
ccttccaacctggcagaaatgt

SEQ ID NO: 9084 - DNA, 25 bp, Artificial Sequence
  Synthetic Construct
cccacatcaacctagcaaggattct

SEQ ID NO: 9085 - DNA, 25 bp, Artificial Sequence
  Synthetic Construct
ctcactcacaccactatagcttcac

SEQ ID NO: 9086 - DNA, 22 bp, Artificial Sequence
  Synthetic Construct
aaggtgtcgtgggagaaatgag

SEQ ID NO: 9087 - DNA, 20 bp, Artificial Sequence
  Synthetic Construct
ggtcctggccagtttgactt

SEQ ID NO: 9088 - DNA, 25 bp, Artificial Sequence
  Synthetic Construct
gggtaaacagaacaaggtgattggt

SEQ ID NO: 9089 - DNA, 23 bp, Artificial Sequence
  Synthetic Construct
gtcctccatgaagaccacattgt

SEQ ID NO: 9090 - DNA, 19 bp, Artificial Sequence
  Synthetic Construct
agtgcgtgggtcctgatct

SEQ ID NO: 9091 - DNA, 20 bp, Artificial Sequence
  Synthetic Construct
aagcccaggatccctttgga

SEQ ID NO: 9092 - DNA, 28 bp, Artificial Sequence
  Synthetic Construct
ggtgttttgttattcagcaatccagact

SEQ ID NO: 9093 - DNA, 22 bp, Artificial Sequence
  Synthetic Construct
ttgtgccaacctttccattgtc

SEQ ID NO: 9094 - DNA, 21 bp, Artificial Sequence
  Synthetic Construct
tgggctgagttatgcctctca

SEQ ID NO: 9095 - DNA, 22 bp, Artificial Sequence
  Synthetic Construct
gcctacagcttgtctgcaaagt

SEQ ID NO: 9096 - DNA, 30 bp, Artificial Sequence
  Synthetic Construct
gagcagcatatttagcttttagagttagtg

SEQ ID NO: 9097 - DNA, 29 bp, Artificial Sequence
  Synthetic Construct
tccaggaaaaaaagagaggatacattttg

SEQ ID NO: 9098 - DNA, 26 bp, Artificial Sequence
  Synthetic Construct
gaaatgtagatgctgcttctgaagtt

SEQ ID NO: 9099 - DNA, 18 bp, Artificial Sequence
  Synthetic Construct
cagccctgggaccaacac

SEQ ID NO: 9100 - DNA, 22 bp, Artificial Sequence
  Synthetic Construct
ggcctcagagagtctttttcca

SEQ ID NO: 9101 - DNA, 26 bp, Artificial Sequence
  Synthetic Construct
gcagaaccccatttaagacaagttga

SEQ ID NO: 9102 - DNA, 20 bp, Artificial Sequence
  Synthetic Construct
ttggcagcaaccacaaagca

SEQ ID NO: 9103 - DNA, 27 bp, Artificial Sequence
  Synthetic Construct
ggaggttctactatctctagcctgtag

SEQ ID NO: 9104 - DNA, 27 bp, Artificial Sequence
  Synthetic Construct
ccacaaggaggaggttcagtattctct

SEQ ID NO: 9105 - DNA, 22 bp, Artificial Sequence
  Synthetic Construct
aagttggttcccacagtcttgt

SEQ ID NO: 9106 - DNA, 21 bp, Artificial Sequence
  Synthetic Construct
tggaacacagcccctttacac

SEQ ID NO: 9107 - DNA, 26 bp, Artificial Sequence
  Synthetic Construct
cctatgctttgtttcaggcttagtac

SEQ ID NO: 9108 - DNA, 30 bp, Artificial Sequence
  Synthetic Construct
gtatgcatatattgaaggagtgtggattag

SEQ ID NO: 9109 - DNA, 29 bp, Artificial Sequence
  Synthetic Construct
ggctttgctaagatattccaaatggaaca

SEQ ID NO: 9110 - DNA, 25 bp, Artificial Sequence
  Synthetic Construct
attaaaatctgaggccgatgtgttg

SEQ ID NO: 9111 - DNA, 22 bp, Artificial Sequence
  Synthetic Construct
aagagaaaccaggccacacctt

SEQ ID NO: 9112 - DNA, 26 bp, Artificial Sequence
  Synthetic Construct
ggaaaacttaaatgcaacgggagtaa

SEQ ID NO: 9113 - DNA, 27 bp, Artificial Sequence
  Synthetic Construct
acttctatatggaaagaggcagattgc

SEQ ID NO: 9114 - DNA, 22 bp, Artificial Sequence
  Synthetic Construct
aggccaactgctcctctaccta

SEQ ID NO: 9115 - DNA, 30 bp, Artificial Sequence
  Synthetic Construct
tgataacactctctcagaagtattacaaca

SEQ ID NO: 9116 - DNA, 21 bp, Artificial Sequence
  Synthetic Construct
tccagccgatgtccacctaca

SEQ ID NO: 9117 - DNA, 26 bp, Artificial Sequence
  Synthetic Construct
ccaaacgttaaggtaggaaggtgatc

SEQ ID NO: 9118 - DNA, 21 bp, Artificial Sequence
  Synthetic Construct
gggagagtccttgaggtgact

SEQ ID NO: 9119 - DNA, 21 bp, Artificial Sequence
  Synthetic Construct
agcaaggctgtgatcccagat

SEQ ID NO: 9120 - DNA, 22 bp, Artificial Sequence
  Synthetic Construct
agctcaagtccttgggttcaaa

SEQ ID NO: 9121 - DNA, 22 bp, Artificial Sequence
  Synthetic Construct
tggggaaaatgaggctccagtt

SEQ ID NO: 9122 - DNA, 24 bp, Artificial Sequence
  Synthetic Construct
acccccaccatcttgcatatacac

SEQ ID NO: 9123 - DNA, 25 bp, Artificial Sequence
  Synthetic Construct
ggaggtgcacagctacatttactct

SEQ ID NO: 9124 - DNA, 19 bp, Artificial Sequence
  Synthetic Construct
actgggcatgggtgaagca

SEQ ID NO: 9125 - DNA, 24 bp, Artificial Sequence
  Synthetic Construct
gcagagaatagctgaaccttgaga

SEQ ID NO: 9126 - DNA, 20 bp, Artificial Sequence
  Synthetic Construct
agaggctccagcacatacca

SEQ ID NO: 9127 - DNA, 21 bp, Artificial Sequence
  Synthetic Construct
agaagaaggtgagcccaatgg

SEQ ID NO: 9128 - DNA, 26 bp, Artificial Sequence
  Synthetic Construct
ggatgagaagggagtggttactatgc

SEQ ID NO: 9129 - DNA, 22 bp, Artificial Sequence
  Synthetic Construct
agggagcggagtctccaaaact

SEQ ID NO: 9130 - DNA, 29 bp, Artificial Sequence
  Synthetic Construct
gaatagaatgggttagggttagctaagta

SEQ ID NO: 9131 - DNA, 28 bp, Artificial Sequence
  Synthetic Construct
gctacagagattagtctgtgaatatcct

SEQ ID NO: 9132 - DNA, 21 bp, Artificial Sequence
  Synthetic Construct
aaggaggagggtgaggacaga

SEQ ID NO: 9133 - DNA, 23 bp, Artificial Sequence
  Synthetic Construct
tgacctgtccctcctgattctct

SEQ ID NO: 9134 - DNA, 20 bp, Artificial Sequence
  Synthetic Construct
actggggcttccatgaacac

SEQ ID NO: 9135 - DNA, 26 bp, Artificial Sequence
  Synthetic Construct
ggtttctgttctgtgggggttaagag

SEQ ID NO: 9136 - DNA, 24 bp, Artificial Sequence
  Synthetic Construct
tctttcacttgaggagaggagaga

SEQ ID NO: 9137 - DNA, 30 bp, Artificial Sequence
  Synthetic Construct
tgaaatgttttgtactcagcagctataatc

SEQ ID NO: 9138 - DNA, 30 bp, Artificial Sequence
  Synthetic Construct
gacacagtgctattattctgatgaacacta

SEQ ID NO: 9139 - DNA, 30 bp, Artificial Sequence
  Synthetic Construct
cactccagagtaagttatattgcatttgac

SEQ ID NO: 9140 - DNA, 29 bp, Artificial Sequence
  Synthetic Construct
tgtacttgagactcaatacattcctttca

SEQ ID NO: 9141 - DNA, 19 bp, Artificial Sequence
  Synthetic Construct
gccgtctcccaggttccat

SEQ ID NO: 9142 - DNA, 26 bp, Artificial Sequence
  Synthetic Construct
ctgggtagaaaaaaacaggtgatgag

SEQ ID NO: 9143 - DNA, 22 bp, Artificial Sequence
  Synthetic Construct
aaggcttccacagtcgatttgc

SEQ ID NO: 9144 - DNA, 24 bp, Artificial Sequence
  Synthetic Construct
tgcactacgtcttcagagagtttg

SEQ ID NO: 9145 - DNA, 24 bp, Artificial Sequence
  Synthetic Construct
cccttagggatgcagcagaagtaa

SEQ ID NO: 9146 - DNA, 19 bp, Artificial Sequence
  Synthetic Construct
tgtgcggccttgaacaagt

SEQ ID NO: 9147 - DNA, 23 bp, Artificial Sequence
  Synthetic Construct
agttgacttctgtgggttgatgt

SEQ ID NO: 9148 - DNA, 21 bp, Artificial Sequence
  Synthetic Construct
tgcctcagaccctcagaccaa

SEQ ID NO: 9149 - DNA, 23 bp, Artificial Sequence
  Synthetic Construct
caggtgccactaatcaacagtga

SEQ ID NO: 9150 - DNA, 19 bp, Artificial Sequence
  Synthetic Construct
cgaggcagcaaggagttca

SEQ ID NO: 9151 - DNA, 30 bp, Artificial Sequence
  Synthetic Construct
gcattggtattgtattacatcacccctctt

SEQ ID NO: 9152 - DNA, 27 bp, Artificial Sequence
  Synthetic Construct
ctcattgtagtctttgtgacgctattg

SEQ ID NO: 9153 - DNA, 27 bp, Artificial Sequence
  Synthetic Construct
cagtatctttctatctacagccacctt

SEQ ID NO: 9154 - DNA, 22 bp, Artificial Sequence
  Synthetic Construct
acctctctgctgattggacact

SEQ ID NO: 9155 - DNA, 29 bp, Artificial Sequence
  Synthetic Construct
ggcttgtgattgtcccttaatactatttg

SEQ ID NO: 9156 - DNA, 28 bp, Artificial Sequence
  Synthetic Construct
cctacatttcctcacatactgaccatac

SEQ ID NO: 9157 - DNA, 25 bp, Artificial Sequence
  Synthetic Construct
gccctgatttccttacagtgagctt

SEQ ID NO: 9158 - DNA, 22 bp, Artificial Sequence
  Synthetic Construct
ggctgcttcatcattccagttg

SEQ ID NO: 9159 - DNA, 26 bp, Artificial Sequence
  Synthetic Construct
cgagccaaaggaaacgattctaacag

SEQ ID NO: 9160 - DNA, 27 bp, Artificial Sequence
  Synthetic Construct
ggaagaagggagttaaaggataaaggt

SEQ ID NO: 9161 - DNA, 21 bp, Artificial Sequence
  Synthetic Construct
ttgctcatccctctgcaactc

SEQ ID NO: 9162 - DNA, 23 bp, Artificial Sequence
  Synthetic Construct
gccaaggaggttgagctaatttg

SEQ ID NO: 9163 - DNA, 22 bp, Artificial Sequence
  Synthetic Construct
acacttcttctccacccttggt

SEQ ID NO: 9164 - DNA, 22 bp, Artificial Sequence
  Synthetic Construct
tggtgttcccagagacccatct

SEQ ID NO: 9165 - DNA, 21 bp, Artificial Sequence
  Synthetic Construct
atggatggcagacaggctaca

SEQ ID NO: 9166 - DNA, 22 bp, Artificial Sequence
  Synthetic Construct
tccttggcatgggctctagaga

SEQ ID NO: 9167 - DNA, 24 bp, Artificial Sequence
  Synthetic Construct
ccactgaatctccagcatctagag

SEQ ID NO: 9168 - DNA, 22 bp, Artificial Sequence
  Synthetic Construct
acccaagacaagttgcggagta

SEQ ID NO: 9169 - DNA, 28 bp, Artificial Sequence
  Synthetic Construct
aatatatctatctccagagcccgttttt

SEQ ID NO: 9170 - DNA, 23 bp, Artificial Sequence
  Synthetic Construct
gtggagaggaaaaagtgctctca

SEQ ID NO: 9171 - DNA, 22 bp, Artificial Sequence
  Synthetic Construct
tgtgatcgggctgtctacatgt

SEQ ID NO: 9172 - DNA, 22 bp, Artificial Sequence
  Synthetic Construct
aggagaagactctgcagctgaa

SEQ ID NO: 9173 - DNA, 25 bp, Artificial Sequence
  Synthetic Construct
gatattcactgagatgggacacaca

SEQ ID NO: 9174 - DNA, 18 bp, Artificial Sequence
  Synthetic Construct
agggacccccgacctact

SEQ ID NO: 9175 - DNA, 22 bp, Artificial Sequence
  Synthetic Construct
tggtcccactctcacaattggt

SEQ ID NO: 9176 - DNA, 24 bp, Artificial Sequence
  Synthetic Construct
ccacgcctgaaataattccaacat

SEQ ID NO: 9177 - DNA, 21 bp, Artificial Sequence
  Synthetic Construct
gccccagctgatgatttgact

SEQ ID NO: 9178 - DNA, 29 bp, Artificial Sequence
  Synthetic Construct
cagacaatcttctgaaattctgcttctat

SEQ ID NO: 9179 - DNA, 22 bp, Artificial Sequence
  Synthetic Construct
gtgattgcgatggggagacaat

SEQ ID NO: 9180 - DNA, 25 bp, Artificial Sequence
  Synthetic Construct
tgtttagggaatgtgactggactag

SEQ ID NO: 9181 - DNA, 22 bp, Artificial Sequence
  Synthetic Construct
tgtggctgaggttgagaaatgg

SEQ ID NO: 9182 - DNA, 25 bp, Artificial Sequence
  Synthetic Construct
gggactgatgaagtagccttctgaa

SEQ ID NO: 9183 - DNA, 28 bp, Artificial Sequence
  Synthetic Construct
cgtgattttagcctccctaagtctacag

SEQ ID NO: 9184 - DNA, 22 bp, Artificial Sequence
  Synthetic Construct
tcactgtcactccaaggtctct

SEQ ID NO: 9185 - DNA, 22 bp, Artificial Sequence
  Synthetic Construct
aaagaatcccaggtcccgttct

SEQ ID NO: 9186 - DNA, 20 bp, Artificial Sequence
  Synthetic Construct
atccggggctgactcttagc

SEQ ID NO: 9187 - DNA, 24 bp, Artificial Sequence
  Synthetic Construct
gccaatgctctttcttacctctgt

SEQ ID NO: 9188 - DNA, 23 bp, Artificial Sequence
  Synthetic Construct
tctcttgcctttgggacatcttg

SEQ ID NO: 9189 - DNA, 26 bp, Artificial Sequence
  Synthetic Construct
gctttgtgagttcttccttgttgatg

SEQ ID NO: 9190 - DNA, 19 bp, Artificial Sequence
  Synthetic Construct
tggcagattgcacgtggat

SEQ ID NO: 9191 - DNA, 29 bp, Artificial Sequence
  Synthetic Construct
gccaagaactatctttccaattgtctttc

SEQ ID NO: 9192 - DNA, 22 bp, Artificial Sequence
  Synthetic Construct
gaaacaacggcgacagagttag

SEQ ID NO: 9193 - DNA, 24 bp, Artificial Sequence
  Synthetic Construct
gggtctcatggcaagtaactgaag

SEQ ID NO: 9194 - DNA, 22 bp, Artificial Sequence
  Synthetic Construct
gtgtaggtatgtggggcgattt

SEQ ID NO: 9195 - DNA, 26 bp, Artificial Sequence
  Synthetic Construct
cagtgactgctcagtgaatagttagc

SEQ ID NO: 9196 - DNA, 21 bp, Artificial Sequence
  Synthetic Construct
gccaggcttggtctcagatag

SEQ ID NO: 9197 - DNA, 24 bp, Artificial Sequence
  Synthetic Construct
ctctgtgccactatacctgtccta

SEQ ID NO: 9198 - DNA, 27 bp, Artificial Sequence
  Synthetic Construct
ggagtacagctttcccagaagtaaaat

SEQ ID NO: 9199 - DNA, 27 bp, Artificial Sequence
  Synthetic Construct
ggcaaaatagctaggcaaacaggttag

SEQ ID NO: 9200 - DNA, 25 bp, Artificial Sequence
  Synthetic Construct
ggagaagagatgaggggattactga

SEQ ID NO: 9201 - DNA, 27 bp, Artificial Sequence
  Synthetic Construct
aaataagctttggttttgtagggacaa

SEQ ID NO: 9202 - DNA, 25 bp, Artificial Sequence
  Synthetic Construct
ggaagcctcacaaaccacatgaaac

SEQ ID NO: 9203 - DNA, 20 bp, Artificial Sequence
  Synthetic Construct
gttcgacactgaggccagaa

SEQ ID NO: 9204 - DNA, 25 bp, Artificial Sequence
  Synthetic Construct
gagggtagaaaggctgctattatcc

SEQ ID NO: 9205 - DNA, 22 bp, Artificial Sequence
  Synthetic Construct
tggggttgctaaatggcacgtt

SEQ ID NO: 9206 - DNA, 22 bp, Artificial Sequence
  Synthetic Construct
tcaactgatgttgggccaaggt

SEQ ID NO: 9207 - DNA, 21 bp, Artificial Sequence
  Synthetic Construct
agggaagctgggtctggaaca

SEQ ID NO: 9208 - DNA, 22 bp, Artificial Sequence
  Synthetic Construct
tgcttgatttgtccgtgagctt

SEQ ID NO: 9209 - DNA, 30 bp, Artificial Sequence
  Synthetic Construct
ggaaagattcaaacacacatttgactgatg

SEQ ID NO: 9210 - DNA, 28 bp, Artificial Sequence
  Synthetic Construct
ggggtttggaccagatattctctaatgc

SEQ ID NO: 9211 - DNA, 26 bp, Artificial Sequence
  Synthetic Construct
gatatcactgccatgaaacagagaag

SEQ ID NO: 9212 - DNA, 25 bp, Artificial Sequence
  Synthetic Construct
ccatctatacaaggctcctctaagc

SEQ ID NO: 9213 - DNA, 21 bp, Artificial Sequence
  Synthetic Construct
tgcaatccgtgacctaatgct

SEQ ID NO: 9214 - DNA, 26 bp, Artificial Sequence
  Synthetic Construct
gggaatatggagaacagcaagatcca

SEQ ID NO: 9215 - DNA, 23 bp, Artificial Sequence
  Synthetic Construct
actttgccccttcctttaaacca

SEQ ID NO: 9216 - DNA, 21 bp, Artificial Sequence
  Synthetic Construct
atccagccactccgggtatgt

SEQ ID NO: 9217 - DNA, 22 bp, Artificial Sequence
  Synthetic Construct
gcccttgcaccagagacaaatt

SEQ ID NO: 9218 - DNA, 26 bp, Artificial Sequence
  Synthetic Construct
gggaactgtctcacaatcaaattgag

SEQ ID NO: 9219 - DNA, 20 bp, Artificial Sequence
  Synthetic Construct
atctggctctgggcatctct

SEQ ID NO: 9220 - DNA, 21 bp, Artificial Sequence
  Synthetic Construct
aggagttcgaggctgtagtgt

SEQ ID NO: 9221 - DNA, 27 bp, Artificial Sequence
  Synthetic Construct
caccaaaacagcagtcccataatattc

SEQ ID NO: 9222 - DNA, 18 bp, Artificial Sequence
  Synthetic Construct
cggcctggctccaatgtc

SEQ ID NO: 9223 - DNA, 27 bp, Artificial Sequence
  Synthetic Construct
cagccaaaccatagcaatatctctact

SEQ ID NO: 9224 - DNA, 27 bp, Artificial Sequence
  Synthetic Construct
cctaaccaaaaaagagaggccatgtac

SEQ ID NO: 9225 - DNA, 27 bp, Artificial Sequence
  Synthetic Construct
ccagataaagaggacaaaggcattagc

SEQ ID NO: 9226 - DNA, 22 bp, Artificial Sequence
  Synthetic Construct
agccggtaagtccttgcaaact

SEQ ID NO: 9227 - DNA, 21 bp, Artificial Sequence
  Synthetic Construct
ttccctgcatgccaagttcag

SEQ ID NO: 9228 - DNA, 22 bp, Artificial Sequence
  Synthetic Construct
ttggtactgcctccaaaaccat

SEQ ID NO: 9229 - DNA, 27 bp, Artificial Sequence
  Synthetic Construct
tgctgataagagaaatgacagatgtgt

SEQ ID NO: 9230 - DNA, 18 bp, Artificial Sequence
  Synthetic Construct
ccccggtgttccctctct

SEQ ID NO: 9231 - DNA, 26 bp, Artificial Sequence
  Synthetic Construct
aggaaaacaggctcagaaaagttaac

SEQ ID NO: 9232 - DNA, 22 bp, Artificial Sequence
  Synthetic Construct
ggaatggacttcactgcctctt

SEQ ID NO: 9233 - DNA, 28 bp, Artificial Sequence
  Synthetic Construct
ttgaccctgggatgagattaattcaata

SEQ ID NO: 9234 - DNA, 19 bp, Artificial Sequence
  Synthetic Construct
tggctcacggctggagtgt

SEQ ID NO: 9235 - DNA, 20 bp, Artificial Sequence
  Synthetic Construct
ccgcatctccaaggcctagt

SEQ ID NO: 9236 - DNA, 21 bp, Artificial Sequence
  Synthetic Construct
aaaggttgggcccctttcttc

SEQ ID NO: 9237 - DNA, 24 bp, Artificial Sequence
  Synthetic Construct
tcccatcctgaggagaaaggtact

SEQ ID NO: 9238 - DNA, 24 bp, Artificial Sequence
  Synthetic Construct
ctgacaggtgagatgaggagtttc

SEQ ID NO: 9239 - DNA, 21 bp, Artificial Sequence
  Synthetic Construct
tcaggctcagtggtgtgaaca

SEQ ID NO: 9240 - DNA, 23 bp, Artificial Sequence
  Synthetic Construct
cccaagaatgagactgtcaccaa

SEQ ID NO: 9241 - DNA, 22 bp, Artificial Sequence
  Synthetic Construct
tgtgtacggttcccaagccaaa

SEQ ID NO: 9242 - DNA, 21 bp, Artificial Sequence
  Synthetic Construct
cttgcaaccaccccagagatt

SEQ ID NO: 9243 - DNA, 26 bp, Artificial Sequence
  Synthetic Construct
tgatattcacaaagttgcaagtgctt

SEQ ID NO: 9244 - DNA, 24 bp, Artificial Sequence
  Synthetic Construct
tgaaggagatagacctcccagtct

SEQ ID NO: 9245 - DNA, 24 bp, Artificial Sequence
  Synthetic Construct
acggtggttattgaagtccttgtc

SEQ ID NO: 9246 - DNA, 28 bp, Artificial Sequence
  Synthetic Construct
gctgaaaagttgtacctctttactagga

SEQ ID NO: 9247 - DNA, 29 bp, Artificial Sequence
  Synthetic Construct
ctgtttatctcattgcttagaatgagcat

SEQ ID NO: 9248 - DNA, 21 bp, Artificial Sequence
  Synthetic Construct
aagcgaccacccacctgtttt

SEQ ID NO: 9249 - DNA, 20 bp, Artificial Sequence
  Synthetic Construct
tttccatggacggcctggaa

SEQ ID NO: 9250 - DNA, 19 bp, Artificial Sequence
  Synthetic Construct
agccagcatctgcaactgt

SEQ ID NO: 9251 - DNA, 28 bp, Artificial Sequence
  Synthetic Construct
cctgaactaaactacctccctgtaatgg

SEQ ID NO: 9252 - DNA, 22 bp, Artificial Sequence
  Synthetic Construct
tcccccttgctggcacatctat

SEQ ID NO: 9253 - DNA, 25 bp, Artificial Sequence
  Synthetic Construct
gtgaggtatcacttcccaaaaaggt

SEQ ID NO: 9254 - DNA, 23 bp, Artificial Sequence
  Synthetic Construct
gagagctttcatcccttctgctt

SEQ ID NO: 9255 - DNA, 21 bp, Artificial Sequence
  Synthetic Construct
tggtcacccggatggtctcta

SEQ ID NO: 9256 - DNA, 22 bp, Artificial Sequence
  Synthetic Construct
ttgggaaaaggcctgcttttcc

SEQ ID NO: 9257 - DNA, 25 bp, Artificial Sequence
  Synthetic Construct
actaaaccaagtgtccttccatgag

SEQ ID NO: 9258 - DNA, 28 bp, Artificial Sequence
  Synthetic Construct
gaagttccctaaggagagtaaaatctca

SEQ ID NO: 9259 - DNA, 21 bp, Artificial Sequence
  Synthetic Construct
ttggtctctccgttcctcagt

SEQ ID NO: 9260 - DNA, 20 bp, Artificial Sequence
  Synthetic Construct
tctgagtccaggcctgaaca

SEQ ID NO: 9261 - DNA, 24 bp, Artificial Sequence
  Synthetic Construct
ccaggcacaaaagagaccttagac

SEQ ID NO: 9262 - DNA, 27 bp, Artificial Sequence
  Synthetic Construct
caattgaaagggagttcaagacttctt

SEQ ID NO: 9263 - DNA, 23 bp, Artificial Sequence
  Synthetic Construct
gacttccagattggttgccaaag

SEQ ID NO: 9264 - DNA, 21 bp, Artificial Sequence
  Synthetic Construct
cacctacccctgtgtcttcct

SEQ ID NO: 9265 - DNA, 22 bp, Artificial Sequence
  Synthetic Construct
tccagcctcaatttccctgtgt

SEQ ID NO: 9266 - DNA, 20 bp, Artificial Sequence
  Synthetic Construct
aattggccagccaggaacag

SEQ ID NO: 9267 - DNA, 23 bp, Artificial Sequence
  Synthetic Construct
ctaatgcaactggtccactgact

SEQ ID NO: 9268 - DNA, 24 bp, Artificial Sequence
  Synthetic Construct
ccttcaggatgcttgatgaacaag

SEQ ID NO: 9269 - DNA, 21 bp, Artificial Sequence
  Synthetic Construct
aggtcactccccaagaccttt

SEQ ID NO: 9270 - DNA, 21 bp, Artificial Sequence
  Synthetic Construct
agcgcatgaacagcacagtct

SEQ ID NO: 9271 - DNA, 24 bp, Artificial Sequence
  Synthetic Construct
ccaacaccagaactctctgtttca

SEQ ID NO: 9272 - DNA, 25 bp, Artificial Sequence
  Synthetic Construct
gaagaacctctgattcatgcatgag

SEQ ID NO: 9273 - DNA, 22 bp, Artificial Sequence
  Synthetic Construct
tctcttagcaggtccagcactt

SEQ ID NO: 9274 - DNA, 30 bp, Artificial Sequence
  Synthetic Construct
ctgctgaaagatgaatcactatgaatttgg

SEQ ID NO: 9275 - DNA, 25 bp, Artificial Sequence
  Synthetic Construct
ggcctttaaaggatttctggcacaa

SEQ ID NO: 9276 - DNA, 25 bp, Artificial Sequence
  Synthetic Construct
tcgtagcacaaggagaaaatcatgt

SEQ ID NO: 9277 - DNA, 23 bp, Artificial Sequence
  Synthetic Construct
gggccctacctatgctgctttat

SEQ ID NO: 9278 - DNA, 23 bp, Artificial Sequence
  Synthetic Construct
agaataaggcaggagaggtggtt

SEQ ID NO: 9279 - DNA, 28 bp, Artificial Sequence
  Synthetic Construct
gcataaattatatcacctgctgctcttg

SEQ ID NO: 9280 - DNA, 24 bp, Artificial Sequence
  Synthetic Construct
cccactgctaggctagatggaatt

SEQ ID NO: 9281 - DNA, 20 bp, Artificial Sequence
  Synthetic Construct
ttgccaaggtgacgcaaggt

SEQ ID NO: 9282 - DNA, 26 bp, Artificial Sequence
  Synthetic Construct
aagaccttccccacaaatcattaaga

SEQ ID NO: 9283 - DNA, 27 bp, Artificial Sequence
  Synthetic Construct
aatacaaccctgatgcactttattagc

SEQ ID NO: 9284 - DNA, 26 bp, Artificial Sequence
  Synthetic Construct
gctttaaggaggagacagttcttcct

SEQ ID NO: 9285 - DNA, 29 bp, Artificial Sequence
  Synthetic Construct
gccaacccagttgttaaagtattgaaatg

SEQ ID NO: 9286 - DNA, 24 bp, Artificial Sequence
  Synthetic Construct
agattggacagggacagtctgaag

SEQ ID NO: 9287 - DNA, 25 bp, Artificial Sequence
  Synthetic Construct
cccctcttccagctttgtaaaacag

SEQ ID NO: 9288 - DNA, 24 bp, Artificial Sequence
  Synthetic Construct
ccttcataagcccagtctttcaga

SEQ ID NO: 9289 - DNA, 20 bp, Artificial Sequence
  Synthetic Construct
atggccgtccctgcctctca

SEQ ID NO: 9290 - DNA, 24 bp, Artificial Sequence
  Synthetic Construct
ccttgaacttcacaggcagaagag

SEQ ID NO: 9291 - DNA, 24 bp, Artificial Sequence
  Synthetic Construct
ggcaaagaactgtaggtggtttgt

SEQ ID NO: 9292 - DNA, 23 bp, Artificial Sequence
  Synthetic Construct
tctacacctgtaccccagcctat

SEQ ID NO: 9293 - DNA, 23 bp, Artificial Sequence
  Synthetic Construct
tgcaattagcccattcacactgt

SEQ ID NO: 9294 - DNA, 24 bp, Artificial Sequence
  Synthetic Construct
ccttcaggccttcaatgacctttg

SEQ ID NO: 9295 - DNA, 21 bp, Artificial Sequence
  Synthetic Construct
tgctgtccaccctcacatggt

SEQ ID NO: 9296 - DNA, 24 bp, Artificial Sequence
  Synthetic Construct
ggtctcctttttcttgtgctgctt

SEQ ID NO: 9297 - DNA, 21 bp, Artificial Sequence
  Synthetic Construct
tggaatggggagggaaagtct

SEQ ID NO: 9298 - DNA, 22 bp, Artificial Sequence
  Synthetic Construct
tggttgcaggtagatggcttct

SEQ ID NO: 9299 - DNA, 26 bp, Artificial Sequence
  Synthetic Construct
gcattaatggtcattgtcatcgtcat

SEQ ID NO: 9300 - DNA, 24 bp, Artificial Sequence
  Synthetic Construct
gggggtttgctttggaaagttctc

SEQ ID NO: 9301 - DNA, 21 bp, Artificial Sequence
  Synthetic Construct
tggggcttgtctgagaccttt

SEQ ID NO: 9302 - DNA, 22 bp, Artificial Sequence
  Synthetic Construct
gtccctgcagaggtcaaacata

SEQ ID NO: 9303 - DNA, 24 bp, Artificial Sequence
  Synthetic Construct
cagatacctgctccagtagttgtg

SEQ ID NO: 9304 - DNA, 20 bp, Artificial Sequence
  Synthetic Construct
aagcccctcccctgctagac

SEQ ID NO: 9305 - DNA, 24 bp, Artificial Sequence
  Synthetic Construct
ccctgtgattatgacttgctttgg

SEQ ID NO: 9306 - DNA, 26 bp, Artificial Sequence
  Synthetic Construct
ggctttctaaacaaacagcacagctt

SEQ ID NO: 9307 - DNA, 27 bp, Artificial Sequence
  Synthetic Construct
ccacgtagatatcaatacatggtggtt

SEQ ID NO: 9308 - DNA, 20 bp, Artificial Sequence
  Synthetic Construct
cgccgctctaaagcccacta

SEQ ID NO: 9309 - DNA, 22 bp, Artificial Sequence
  Synthetic Construct
gatgcagtacccgctaatgtga

SEQ ID NO: 9310 - DNA, 30 bp, Artificial Sequence
  Synthetic Construct
ccaggaatcatctacttaaactatcttcct

SEQ ID NO: 9311 - DNA, 27 bp, Artificial Sequence
  Synthetic Construct
gcaacatcattctgctgataacttttg

SEQ ID NO: 9312 - DNA, 26 bp, Artificial Sequence
  Synthetic Construct
gctctctttaccactgcacttactac

SEQ ID NO: 9313 - DNA, 23 bp, Artificial Sequence
  Synthetic Construct
tggtatcctccccagacaaaggt

SEQ ID NO: 9314 - DNA, 22 bp, Artificial Sequence
  Synthetic Construct
cctcctctgaatccacgtctgt

SEQ ID NO: 9315 - DNA, 22 bp, Artificial Sequence
  Synthetic Construct
cccttcacctgtttcctgacaa

SEQ ID NO: 9316 - DNA, 25 bp, Artificial Sequence
  Synthetic Construct
acagagaaagaccacctttgttagc

SEQ ID NO: 9317 - DNA, 23 bp, Artificial Sequence
  Synthetic Construct
cccaatactgtctcactggcaat

SEQ ID NO: 9318 - DNA, 20 bp, Artificial Sequence
  Synthetic Construct
tgtgtgtctgccagcaccat

SEQ ID NO: 9319 - DNA, 29 bp, Artificial Sequence
  Synthetic Construct
gtgtatttgagatttacttgttgctgaag

SEQ ID NO: 9320 - DNA, 30 bp, Artificial Sequence
  Synthetic Construct
gtgcatactatatccttcattacctctgaa

SEQ ID NO: 9321 - DNA, 29 bp, Artificial Sequence
  Synthetic Construct
gtgtcttatcaggtgaagtgaatttcttg

SEQ ID NO: 9322 - DNA, 20 bp, Artificial Sequence
  Synthetic Construct
tgggaccccagcatttgcat

SEQ ID NO: 9323 - DNA, 30 bp, Artificial Sequence
  Synthetic Construct
ccaaacacatatgttaagtttagcatttgg

SEQ ID NO: 9324 - DNA, 29 bp, Artificial Sequence
  Synthetic Construct
ggttcacaaaacaatcatggaatggtatc

SEQ ID NO: 9325 - DNA, 28 bp, Artificial Sequence
  Synthetic Construct
gctgtacaactgaataggaaacaacagt

SEQ ID NO: 9326 - DNA, 19 bp, Artificial Sequence
  Synthetic Construct
aggctggctgaggattggt

SEQ ID NO: 9327 - DNA, 20 bp, Artificial Sequence
  Synthetic Construct
gagggccctctttgccatct

SEQ ID NO: 9328 - DNA, 23 bp, Artificial Sequence
  Synthetic Construct
tgtgtttccctttggcttttcag

SEQ ID NO: 9329 - DNA, 28 bp, Artificial Sequence
  Synthetic Construct
ccatgtatcacctataaactgcagtttg

SEQ ID NO: 9330 - DNA, 23 bp, Artificial Sequence
  Synthetic Construct
ggcaagtggcagcaatatttacc

SEQ ID NO: 9331 - DNA, 19 bp, Artificial Sequence
  Synthetic Construct
cggtccccagctgtgttct

SEQ ID NO: 9332 - DNA, 30 bp, Artificial Sequence
  Synthetic Construct
gacaattcacagattagtagttgacttcca

SEQ ID NO: 9333 - DNA, 26 bp, Artificial Sequence
  Synthetic Construct
ccgtttttctctgtcagtcctatctc

SEQ ID NO: 9334 - DNA, 21 bp, Artificial Sequence
  Synthetic Construct
tgggcagggaaagggtacaca

SEQ ID NO: 9335 - DNA, 24 bp, Artificial Sequence
  Synthetic Construct
gggggccatttcaagtttttttgc

SEQ ID NO: 9336 - DNA, 18 bp, Artificial Sequence
  Synthetic Construct
cagggaaggcggcctaga

SEQ ID NO: 9337 - DNA, 21 bp, Artificial Sequence
  Synthetic Construct
cgcatgcactcccagaggtat

SEQ ID NO: 9338 - DNA, 28 bp, Artificial Sequence
  Synthetic Construct
gcacctcataaaaagatgctctgagcta

SEQ ID NO: 9339 - DNA, 21 bp, Artificial Sequence
  Synthetic Construct
agaaggggacaggacagtgat

SEQ ID NO: 9340 - DNA, 22 bp, Artificial Sequence
  Synthetic Construct
gagactgaagggtgtggaggta

SEQ ID NO: 9341 - DNA, 20 bp, Artificial Sequence
  Synthetic Construct
cctccacagagccctaggaa

SEQ ID NO: 9342 - DNA, 28 bp, Artificial Sequence
  Synthetic Construct
cagctacatccttgtagattagcatgag

SEQ ID NO: 9343 - DNA, 23 bp, Artificial Sequence
  Synthetic Construct
ccagcttgagagaggactggatt

SEQ ID NO: 9344 - DNA, 24 bp, Artificial Sequence
  Synthetic Construct
gtttttgggagttcagtcaaagct

SEQ ID NO: 9345 - DNA, 26 bp, Artificial Sequence
  Synthetic Construct
ggaaactgataacccctagccttctg

SEQ ID NO: 9346 - DNA, 18 bp, Artificial Sequence
  Synthetic Construct
gctggcggagacctctct

SEQ ID NO: 9347 - DNA, 26 bp, Artificial Sequence
  Synthetic Construct
ccctagagaaagtagtgcctcccaaa

SEQ ID NO: 9348 - DNA, 24 bp, Artificial Sequence
  Synthetic Construct
ggagaaactgacttgccccaaatc

SEQ ID NO: 9349 - DNA, 23 bp, Artificial Sequence
  Synthetic Construct
gctcagaatgctcttcccagtca

SEQ ID NO: 9350 - DNA, 22 bp, Artificial Sequence
  Synthetic Construct
ggttgaggagctgagcagtttc

SEQ ID NO: 9351 - DNA, 21 bp, Artificial Sequence
  Synthetic Construct
cgcaggacacagaatgggaaa

SEQ ID NO: 9352 - DNA, 27 bp, Artificial Sequence
  Synthetic Construct
tcttctcatcgaatcttcatggaatcc

SEQ ID NO: 9353 - DNA, 23 bp, Artificial Sequence
  Synthetic Construct
caaccaaacccattttgcagtga

SEQ ID NO: 9354 - DNA, 22 bp, Artificial Sequence
  Synthetic Construct
acggacactctggcctttttat

SEQ ID NO: 9355 - DNA, 26 bp, Artificial Sequence
  Synthetic Construct
ccacagctcctgacttcataaaacct

SEQ ID NO: 9356 - DNA, 29 bp, Artificial Sequence
  Synthetic Construct
gtgggtagattattgctgagggatatttg

SEQ ID NO: 9357 - DNA, 27 bp, Artificial Sequence
  Synthetic Construct
ggtctatttccctaacccttgaatctg

SEQ ID NO: 9358 - DNA, 21 bp, Artificial Sequence
  Synthetic Construct
ccaaccctcttccaccccata

SEQ ID NO: 9359 - DNA, 20 bp, Artificial Sequence
  Synthetic Construct
tgggggcttcctaggaggta

SEQ ID NO: 9360 - DNA, 21 bp, Artificial Sequence
  Synthetic Construct
agagcccccctctttaaacgt

SEQ ID NO: 9361 - DNA, 22 bp, Artificial Sequence
  Synthetic Construct
acagcttggatgaaggcagatc

SEQ ID NO: 9362 - DNA, 21 bp, Artificial Sequence
  Synthetic Construct
agggcagtggtggtgagatct

SEQ ID NO: 9363 - DNA, 21 bp, Artificial Sequence
  Synthetic Construct
ttccaggcagagggcaatgaa

SEQ ID NO: 9364 - DNA, 21 bp, Artificial Sequence
  Synthetic Construct
tgaaagacatccggcccacat

SEQ ID NO: 9365 - DNA, 24 bp, Artificial Sequence
  Synthetic Construct
aggagtgagaagggagactcaatc

SEQ ID NO: 9366 - DNA, 24 bp, Artificial Sequence
  Synthetic Construct
ctgagagaatcaggtgacattgga

SEQ ID NO: 9367 - DNA, 24 bp, Artificial Sequence
  Synthetic Construct
aggtaggcctgactgagaagttga

SEQ ID NO: 9368 - DNA, 27 bp, Artificial Sequence
  Synthetic Construct
gggggttggagaaatgatggaaatacc

SEQ ID NO: 9369 - DNA, 26 bp, Artificial Sequence
  Synthetic Construct
gctcagacccagcaacaaatattcac

SEQ ID NO: 9370 - DNA, 28 bp, Artificial Sequence
  Synthetic Construct
ggaatgtaggaggataacttggtatcat

SEQ ID NO: 9371 - DNA, 21 bp, Artificial Sequence
  Synthetic Construct
tcccaaagcccctgattctga

SEQ ID NO: 9372 - DNA, 26 bp, Artificial Sequence
  Synthetic Construct
cctctaagcagtgacttagagatcct

SEQ ID NO: 9373 - DNA, 22 bp, Artificial Sequence
  Synthetic Construct
tgctcctggatgacacaacttc

SEQ ID NO: 9374 - DNA, 21 bp, Artificial Sequence
  Synthetic Construct
tcccagtgcagcacttcttgt

SEQ ID NO: 9375 - DNA, 26 bp, Artificial Sequence
  Synthetic Construct
ctcacagcatggaagttctactcaag

SEQ ID NO: 9376 - DNA, 24 bp, Artificial Sequence
  Synthetic Construct
ccattccccattggcccatattag

SEQ ID NO: 9377 - DNA, 24 bp, Artificial Sequence
  Synthetic Construct
tgatagggaggtgaaggctttctc

SEQ ID NO: 9378 - DNA, 22 bp, Artificial Sequence
  Synthetic Construct
ctcaagaacagtgggcaaaagc

SEQ ID NO: 9379 - DNA, 20 bp, Artificial Sequence
  Synthetic Construct
tggttcctgctgagggtttg

SEQ ID NO: 9380 - DNA, 25 bp, Artificial Sequence
  Synthetic Construct
cgatccaactgcatactgctagatg

SEQ ID NO: 9381 - DNA, 23 bp, Artificial Sequence
  Synthetic Construct
gcccggcctgctcaattttttta

SEQ ID NO: 9382 - DNA, 26 bp, Artificial Sequence
  Synthetic Construct
ctccacataagactatgctcctcttc

SEQ ID NO: 9383 - DNA, 22 bp, Artificial Sequence
  Synthetic Construct
ggccaacaaaatgtgccattcc

SEQ ID NO: 9384 - DNA, 19 bp, Artificial Sequence
  Synthetic Construct
tccctgacccagcccgaat

SEQ ID NO: 9385 - DNA, 24 bp, Artificial Sequence
  Synthetic Construct
tcagcacccaggtttttactacag

SEQ ID NO: 9386 - DNA, 22 bp, Artificial Sequence
  Synthetic Construct
agatgccttgtctaccgcaaag

SEQ ID NO: 9387 - DNA, 26 bp, Artificial Sequence
  Synthetic Construct
tgcccaacatagactggaatattctg

SEQ ID NO: 9388 - DNA, 21 bp, Artificial Sequence
  Synthetic Construct
atgtctgccagggtcacaaaa

SEQ ID NO: 9389 - DNA, 22 bp, Artificial Sequence
  Synthetic Construct
tccccagggcagatcaaaggaa

SEQ ID NO: 9390 - DNA, 22 bp, Artificial Sequence
  Synthetic Construct
ctgtgtccatcctctgtgcttt

SEQ ID NO: 9391 - DNA, 28 bp, Artificial Sequence
  Synthetic Construct
tcaggccaattattacatactgactcaa

SEQ ID NO: 9392 - DNA, 21 bp, Artificial Sequence
  Synthetic Construct
agagccatcacttgccatcct

SEQ ID NO: 9393 - DNA, 28 bp, Artificial Sequence
  Synthetic Construct
tctcggatccagggattatatacagtag

SEQ ID NO: 9394 - DNA, 27 bp, Artificial Sequence
  Synthetic Construct
ccttgggagtaatacatctttctttgc

SEQ ID NO: 9395 - DNA, 23 bp, Artificial Sequence
  Synthetic Construct
ccaaaacaaaccatgggctcttt

SEQ ID NO: 9396 - DNA, 26 bp, Artificial Sequence
  Synthetic Construct
gctcatgctcccatctagcctttatc

SEQ ID NO: 9397 - DNA, 24 bp, Artificial Sequence
  Synthetic Construct
ccctgcctcacaattcaattagga

SEQ ID NO: 9398 - DNA, 27 bp, Artificial Sequence
  Synthetic Construct
gggatcttaaacctctctgagatagac

SEQ ID NO: 9399 - DNA, 26 bp, Artificial Sequence
  Synthetic Construct
gcaaaagagttaggtgctgactcaca

SEQ ID NO: 9400 - DNA, 21 bp, Artificial Sequence
  Synthetic Construct
tgccttgtccaagagcttcag

SEQ ID NO: 9401 - DNA, 29 bp, Artificial Sequence
  Synthetic Construct
ccaaacacatttcatatcagagcacaagt

SEQ ID NO: 9402 - DNA, 24 bp, Artificial Sequence
  Synthetic Construct
gcaaccaagcaagattctgtctca

SEQ ID NO: 9403 - DNA, 19 bp, Artificial Sequence
  Synthetic Construct
cagaggtggccacacaaca

SEQ ID NO: 9404 - DNA, 20 bp, Artificial Sequence
  Synthetic Construct
tcctcgctctgccagttagt

SEQ ID NO: 9405 - DNA, 20 bp, Artificial Sequence
  Synthetic Construct
gccagaggtgccctttacag

SEQ ID NO: 9406 - DNA, 23 bp, Artificial Sequence
  Synthetic Construct
gacagtaattctggcgctttctc

SEQ ID NO: 9407 - DNA, 30 bp, Artificial Sequence
  Synthetic Construct
gggtcttctaaaagtcttctagaaaagtct

SEQ ID NO: 9408 - DNA, 25 bp, Artificial Sequence
  Synthetic Construct
accctgagatcttaaggtgtcattg

SEQ ID NO: 9409 - DNA, 25 bp, Artificial Sequence
  Synthetic Construct
ctgcatgacagaaggggtagaaaac

SEQ ID NO: 9410 - DNA, 26 bp, Artificial Sequence
  Synthetic Construct
ctctatccctgagacacacttagtca

SEQ ID NO: 9411 - DNA, 19 bp, Artificial Sequence
  Synthetic Construct
agggggccctcctgtcaaa

SEQ ID NO: 9412 - DNA, 18 bp, Artificial Sequence
  Synthetic Construct
cgccagccccttcttcag

SEQ ID NO: 9413 - DNA, 23 bp, Artificial Sequence
  Synthetic Construct
tgtgaaggactgatggctacaga

SEQ ID NO: 9414 - DNA, 27 bp, Artificial Sequence
  Synthetic Construct
ccaagctatttttggcttcaggtacag

SEQ ID NO: 9415 - DNA, 19 bp, Artificial Sequence
  Synthetic Construct
gctgttggggctgccaaaa

SEQ ID NO: 9416 - DNA, 22 bp, Artificial Sequence
  Synthetic Construct
tcccctgccaactgttctttga

SEQ ID NO: 9417 - DNA, 20 bp, Artificial Sequence
  Synthetic Construct
tggcttttgagcagcaagca

SEQ ID NO: 9418 - DNA, 20 bp, Artificial Sequence
  Synthetic Construct
tgtggtgagcagggatcaca

SEQ ID NO: 9419 - DNA, 20 bp, Artificial Sequence
  Synthetic Construct
tggctgagaccctggcatct

SEQ ID NO: 9420 - DNA, 29 bp, Artificial Sequence
  Synthetic Construct
ggtgacaacacatgattactaatgctctt

SEQ ID NO: 9421 - DNA, 23 bp, Artificial Sequence
  Synthetic Construct
ctctgagagccttcatctttggt

SEQ ID NO: 9422 - DNA, 24 bp, Artificial Sequence
  Synthetic Construct
gcttgaatccttgttgtggagtga

SEQ ID NO: 9423 - DNA, 25 bp, Artificial Sequence
  Synthetic Construct
ccaaatgacagaaacactggtctct

SEQ ID NO: 9424 - DNA, 22 bp, Artificial Sequence
  Synthetic Construct
tgatgaggtgaggctctgtgat

SEQ ID NO: 9425 - DNA, 19 bp, Artificial Sequence
  Synthetic Construct
tggccacgacagtgcagaa

SEQ ID NO: 9426 - DNA, 22 bp, Artificial Sequence
  Synthetic Construct
tgctgtgtcctgtcgttcatct

SEQ ID NO: 9427 - DNA, 25 bp, Artificial Sequence
  Synthetic Construct
gctgacaaagagcctgacatacatc

SEQ ID NO: 9428 - DNA, 20 bp, Artificial Sequence
  Synthetic Construct
ggtccaaggagggaggaaga

SEQ ID NO: 9429 - DNA, 27 bp, Artificial Sequence
  Synthetic Construct
cgaatggtacttttagcaggctacact

SEQ ID NO: 9430 - DNA, 28 bp, Artificial Sequence
  Synthetic Construct
ccataagccaattcagcctctttataaa

SEQ ID NO: 9431 - DNA, 21 bp, Artificial Sequence
  Synthetic Construct
tgctgtcaccttgcctggtat

SEQ ID NO: 9432 - DNA, 21 bp, Artificial Sequence
  Synthetic Construct
aggtacagggcagaggatcag

SEQ ID NO: 9433 - DNA, 24 bp, Artificial Sequence
  Synthetic Construct
accaggtttcctcttccctttcct

SEQ ID NO: 9434 - DNA, 23 bp, Artificial Sequence
  Synthetic Construct
acgctttgcctctattcatagct

SEQ ID NO: 9435 - DNA, 25 bp, Artificial Sequence
  Synthetic Construct
ttctgtctccatttcccttttctca

SEQ ID NO: 9436 - DNA, 21 bp, Artificial Sequence
  Synthetic Construct
ccccattcgtgaaggctctac

SEQ ID NO: 9437 - DNA, 19 bp, Artificial Sequence
  Synthetic Construct
gaggtgaggctgggtctca

SEQ ID NO: 9438 - DNA, 26 bp, Artificial Sequence
  Synthetic Construct
gctctccaaagagaatgtggacttta

SEQ ID NO: 9439 - DNA, 26 bp, Artificial Sequence
  Synthetic Construct
cattgtccagccttttctcttaatgg

SEQ ID NO: 9440 - DNA, 19 bp, Artificial Sequence
  Synthetic Construct
gccaccagagccctccatt

SEQ ID NO: 9441 - DNA, 22 bp, Artificial Sequence
  Synthetic Construct
gactgcacgaatgtgtgaaagc

SEQ ID NO: 9442 - DNA, 30 bp, Artificial Sequence
  Synthetic Construct
aacaaaggcttgtcctagaaaaatcatatt

SEQ ID NO: 9443 - DNA, 20 bp, Artificial Sequence
  Synthetic Construct
acaaccatggagggctgcaa

SEQ ID NO: 9444 - DNA, 24 bp, Artificial Sequence
  Synthetic Construct
gcacttttcgtgtgtaaggaacag

SEQ ID NO: 9445 - DNA, 25 bp, Artificial Sequence
  Synthetic Construct
gagagggtcatatatgggggaatga

SEQ ID NO: 9446 - DNA, 23 bp, Artificial Sequence
  Synthetic Construct
ccaaaggcaaagactaccctttg

SEQ ID NO: 9447 - DNA, 22 bp, Artificial Sequence
  Synthetic Construct
tgttggctagtcttgcaacaga

SEQ ID NO: 9448 - DNA, 26 bp, Artificial Sequence
  Synthetic Construct
gaaattttcttggaaacgcaaaacca

SEQ ID NO: 9449 - DNA, 25 bp, Artificial Sequence
  Synthetic Construct
cctggacactgcatgaagtattctg

SEQ ID NO: 9450 - DNA, 25 bp, Artificial Sequence
  Synthetic Construct
cctctgaatttcaaactccctttgg

SEQ ID NO: 9451 - DNA, 28 bp, Artificial Sequence
  Synthetic Construct
ggcataagattacacactgggttagatc

SEQ ID NO: 9452 - DNA, 24 bp, Artificial Sequence
  Synthetic Construct
tgaacactctttcctggtgatgtg

SEQ ID NO: 9453 - DNA, 20 bp, Artificial Sequence
  Synthetic Construct
ctggcctggctaggattcct

SEQ ID NO: 9454 - DNA, 24 bp, Artificial Sequence
  Synthetic Construct
ccaaacctattctgggagccgaaa

SEQ ID NO: 9455 - DNA, 27 bp, Artificial Sequence
  Synthetic Construct
cgctggtaaagttgagtcttatttcac

SEQ ID NO: 9456 - DNA, 22 bp, Artificial Sequence
  Synthetic Construct
cctatcctggacccaagatgct

SEQ ID NO: 9457 - DNA, 19 bp, Artificial Sequence
  Synthetic Construct
atgcccggccatcctgaat

SEQ ID NO: 9458 - DNA, 19 bp, Artificial Sequence
  Synthetic Construct
aggtggaggaggccttgag

SEQ ID NO: 9459 - DNA, 19 bp, Artificial Sequence
  Synthetic Construct
ggagcggaagtgagcatgt

SEQ ID NO: 9460 - DNA, 28 bp, Artificial Sequence
  Synthetic Construct
gattttggagggacaggaaattaaagag

SEQ ID NO: 9461 - DNA, 19 bp, Artificial Sequence
  Synthetic Construct
cctgctgtgctcagttcca

SEQ ID NO: 9462 - DNA, 22 bp, Artificial Sequence
  Synthetic Construct
gggtgtgggaaggctatatgag

SEQ ID NO: 9463 - DNA, 21 bp, Artificial Sequence
  Synthetic Construct
ggtacccgcatgttgctatgg

SEQ ID NO: 9464 - DNA, 19 bp, Artificial Sequence
  Synthetic Construct
atccctcccagccacaact

SEQ ID NO: 9465 - DNA, 26 bp, Artificial Sequence
  Synthetic Construct
ctatctacatcccattggccataact

SEQ ID NO: 9466 - DNA, 21 bp, Artificial Sequence
  Synthetic Construct
agggaaggggccataacttct

SEQ ID NO: 9467 - DNA, 27 bp, Artificial Sequence
  Synthetic Construct
cagttaggaagccgatgaaattagttt

SEQ ID NO: 9468 - DNA, 25 bp, Artificial Sequence
  Synthetic Construct
caaccctactaactgcacagagaag

SEQ ID NO: 9469 - DNA, 20 bp, Artificial Sequence
  Synthetic Construct
ctctgagcgctgttcctgaa

SEQ ID NO: 9470 - DNA, 19 bp, Artificial Sequence
  Synthetic Construct
ggagccactgcagctttct

SEQ ID NO: 9471 - DNA, 19 bp, Artificial Sequence
  Synthetic Construct
aggcatggcaaggctacct

SEQ ID NO: 9472 - DNA, 29 bp, Artificial Sequence
  Synthetic Construct
ctctgattctgttttacagcaaaatgaga

SEQ ID NO: 9473 - DNA, 22 bp, Artificial Sequence
  Synthetic Construct
ctcccctgcctcccaaatttaa

SEQ ID NO: 9474 - DNA, 21 bp, Artificial Sequence
  Synthetic Construct
agaccacactcaacccagaga

SEQ ID NO: 9475 - DNA, 27 bp, Artificial Sequence
  Synthetic Construct
tccatgataagcaggtctatacaatcc

SEQ ID NO: 9476 - DNA, 18 bp, Artificial Sequence
  Synthetic Construct
agcggcatccctgtcctt

SEQ ID NO: 9477 - DNA, 20 bp, Artificial Sequence
  Synthetic Construct
gctgcctagctgggtaacct

SEQ ID NO: 9478 - DNA, 24 bp, Artificial Sequence
  Synthetic Construct
gacaatcggatgaggagcagatac

SEQ ID NO: 9479 - DNA, 22 bp, Artificial Sequence
  Synthetic Construct
ggaaactgaggaggcattctca

SEQ ID NO: 9480 - DNA, 24 bp, Artificial Sequence
  Synthetic Construct
cacagaattgacccctcacttcca

SEQ ID NO: 9481 - DNA, 21 bp, Artificial Sequence
  Synthetic Construct
actttctggtggcatgagcaa

SEQ ID NO: 9482 - DNA, 23 bp, Artificial Sequence
  Synthetic Construct
aacccaccaaaatctgacttcct

SEQ ID NO: 9483 - DNA, 18 bp, Artificial Sequence
  Synthetic Construct
gggggagggaggaaacgt

SEQ ID NO: 9484 - DNA, 25 bp, Artificial Sequence
  Synthetic Construct
gtgctatgtggggagtagattggaa

SEQ ID NO: 9485 - DNA, 20 bp, Artificial Sequence
  Synthetic Construct
ctctgcgctgcaaagttgtc

SEQ ID NO: 9486 - DNA, 30 bp, Artificial Sequence
  Synthetic Construct
cccactcctcataataggtatttgaggaaa

SEQ ID NO: 9487 - DNA, 27 bp, Artificial Sequence
  Synthetic Construct
caggtattacgcttaagtgttcattgc

SEQ ID NO: 9488 - DNA, 26 bp, Artificial Sequence
  Synthetic Construct
ccaaggattttctcctctcctcagat

SEQ ID NO: 9489 - DNA, 23 bp, Artificial Sequence
  Synthetic Construct
tccctcagctctgaagacctact

SEQ ID NO: 9490 - DNA, 25 bp, Artificial Sequence
  Synthetic Construct
gcttgtgaatcaaactgtgaaagct

SEQ ID NO: 9491 - DNA, 22 bp, Artificial Sequence
  Synthetic Construct
gtggtccaacaacggtaagtgt

SEQ ID NO: 9492 - DNA, 24 bp, Artificial Sequence
  Synthetic Construct
ggaatggggtctatgttggaaaga

SEQ ID NO: 9493 - DNA, 20 bp, Artificial Sequence
  Synthetic Construct
ccccagtttcttggcactgt

SEQ ID NO: 9494 - DNA, 26 bp, Artificial Sequence
  Synthetic Construct
gaatttcattcatgcctacgacttca

SEQ ID NO: 9495 - DNA, 24 bp, Artificial Sequence
  Synthetic Construct
ccttgctagattgcaggcttcttg

SEQ ID NO: 9496 - DNA, 20 bp, Artificial Sequence
  Synthetic Construct
aggtgggggtgatggtgact

SEQ ID NO: 9497 - DNA, 22 bp, Artificial Sequence
  Synthetic Construct
ggagggtctagagctggatcct

SEQ ID NO: 9498 - DNA, 19 bp, Artificial Sequence
  Synthetic Construct
caggaggccgtccaattgg

SEQ ID NO: 9499 - DNA, 27 bp, Artificial Sequence
  Synthetic Construct
gttttaaaggttcaactgcctttacct

SEQ ID NO: 9500 - DNA, 23 bp, Artificial Sequence
  Synthetic Construct
ggagatcttcccatgaaccactt

SEQ ID NO: 9501 - DNA, 22 bp, Artificial Sequence
  Synthetic Construct
aaagtggtggctcctgtagaga

SEQ ID NO: 9502 - DNA, 25 bp, Artificial Sequence
  Synthetic Construct
gaaagtctttgttccctgcagatac

SEQ ID NO: 9503 - DNA, 23 bp, Artificial Sequence
  Synthetic Construct
cccacaagtggcagagaagaaaa

SEQ ID NO: 9504 - DNA, 26 bp, Artificial Sequence
  Synthetic Construct
gcaaagagaagcatttgttcctttcc

SEQ ID NO: 9505 - DNA, 23 bp, Artificial Sequence
  Synthetic Construct
gctatgggggaggctttattcaa

SEQ ID NO: 9506 - DNA, 23 bp, Artificial Sequence
  Synthetic Construct
acaagctggcagatagggaagag

SEQ ID NO: 9507 - DNA, 22 bp, Artificial Sequence
  Synthetic Construct
cagacatgtcatggctcctgaa

SEQ ID NO: 9508 - DNA, 24 bp, Artificial Sequence
  Synthetic Construct
gtggcagttctagtggcttctagt

SEQ ID NO: 9509 - DNA, 23 bp, Artificial Sequence
  Synthetic Construct
agactcagcactggaagaaacac

SEQ ID NO: 9510 - DNA, 24 bp, Artificial Sequence
  Synthetic Construct
ctgccatgacaaatccttctacac

SEQ ID NO: 9511 - DNA, 30 bp, Artificial Sequence
  Synthetic Construct
gggacttacgatgccataataaagaatttg

SEQ ID NO: 9512 - DNA, 24 bp, Artificial Sequence
  Synthetic Construct
cctagagaaccggtaaagcagtac

SEQ ID NO: 9513 - DNA, 22 bp, Artificial Sequence
  Synthetic Construct
aggcaattgctacctcgatcca

SEQ ID NO: 9514 - DNA, 24 bp, Artificial Sequence
  Synthetic Construct
gtgactacaggagcagcatatctg

SEQ ID NO: 9515 - DNA, 19 bp, Artificial Sequence
  Synthetic Construct
caggcagggacagctgaaa

SEQ ID NO: 9516 - DNA, 29 bp, Artificial Sequence
  Synthetic Construct
tcttaccataattccagagaacagtacat

SEQ ID NO: 9517 - DNA, 25 bp, Artificial Sequence
  Synthetic Construct
acttctgaaagaaagaaggccaaga

SEQ ID NO: 9518 - DNA, 22 bp, Artificial Sequence
  Synthetic Construct
tggtacagtgagggtagaacca

SEQ ID NO: 9519 - DNA, 26 bp, Artificial Sequence
  Synthetic Construct
gccgtgattatgactggcattacatc

SEQ ID NO: 9520 - DNA, 29 bp, Artificial Sequence
  Synthetic Construct
cctgcattacaaatggttttcttcctgtt

SEQ ID NO: 9521 - DNA, 22 bp, Artificial Sequence
  Synthetic Construct
gccttcttcctcctgctttgtt

SEQ ID NO: 9522 - DNA, 29 bp, Artificial Sequence
  Synthetic Construct
caaggagtgactagtctgactttaaatct

SEQ ID NO: 9523 - DNA, 21 bp, Artificial Sequence
  Synthetic Construct
ccccctcatcaatgcctcctt

SEQ ID NO: 9524 - DNA, 23 bp, Artificial Sequence
  Synthetic Construct
gtgactcccaccaaatacaggat

SEQ ID NO: 9525 - DNA, 21 bp, Artificial Sequence
  Synthetic Construct
tccctgtcctatgcacccaaa

SEQ ID NO: 9526 - DNA, 20 bp, Artificial Sequence
  Synthetic Construct
ccaccctaccccacctgtac

SEQ ID NO: 9527 - DNA, 22 bp, Artificial Sequence
  Synthetic Construct
tctgcgattttcccccatgtct

SEQ ID NO: 9528 - DNA, 22 bp, Artificial Sequence
  Synthetic Construct
cgcacccggcccattattataa

SEQ ID NO: 9529 - DNA, 21 bp, Artificial Sequence
  Synthetic Construct
ttcgtcctagtccctgtgtga

SEQ ID NO: 9530 - DNA, 27 bp, Artificial Sequence
  Synthetic Construct
aacacatacatgttaacacacctatgc

SEQ ID NO: 9531 - DNA, 26 bp, Artificial Sequence
  Synthetic Construct
cctggtaagtttgccttctatgtttc

SEQ ID NO: 9532 - DNA, 25 bp, Artificial Sequence
  Synthetic Construct
gggaaagctttctacatgctttgag

SEQ ID NO: 9533 - DNA, 22 bp, Artificial Sequence
  Synthetic Construct
actgtacactggctgttttgca

SEQ ID NO: 9534 - DNA, 21 bp, Artificial Sequence
  Synthetic Construct
tcttggcattgcaacctccat

SEQ ID NO: 9535 - DNA, 24 bp, Artificial Sequence
  Synthetic Construct
gtggacgaggagaaatgagagctt

SEQ ID NO: 9536 - DNA, 20 bp, Artificial Sequence
  Synthetic Construct
agtgccgcatccctatgtca

SEQ ID NO: 9537 - DNA, 25 bp, Artificial Sequence
  Synthetic Construct
cctaaccttaggggatgctcatctt

SEQ ID NO: 9538 - DNA, 19 bp, Artificial Sequence
  Synthetic Construct
agggcacagggctcagctt

SEQ ID NO: 9539 - DNA, 22 bp, Artificial Sequence
  Synthetic Construct
tggactagaggatcccccagtt

SEQ ID NO: 9540 - DNA, 21 bp, Artificial Sequence
  Synthetic Construct
tgctggggagattccttgaac

SEQ ID NO: 9541 - DNA, 24 bp, Artificial Sequence
  Synthetic Construct
gtggtggagcaaagttcctctaga

SEQ ID NO: 9542 - DNA, 26 bp, Artificial Sequence
  Synthetic Construct
gctccacagaattactcccagtgatc

SEQ ID NO: 9543 - DNA, 20 bp, Artificial Sequence
  Synthetic Construct
tctgcacctctgcacttgct

SEQ ID NO: 9544 - DNA, 24 bp, Artificial Sequence
  Synthetic Construct
catcaccctcaattcttgcagatg

SEQ ID NO: 9545 - DNA, 26 bp, Artificial Sequence
  Synthetic Construct
gctgcatcgagaaaataagaatcact

SEQ ID NO: 9546 - DNA, 25 bp, Artificial Sequence
  Synthetic Construct
gggagaactgaaggtgtctgactat

SEQ ID NO: 9547 - DNA, 19 bp, Artificial Sequence
  Synthetic Construct
gccaacacctgcccagttg

SEQ ID NO: 9548 - DNA, 24 bp, Artificial Sequence
  Synthetic Construct
gcaacatagcaactgaggctcaga

SEQ ID NO: 9549 - DNA, 19 bp, Artificial Sequence
  Synthetic Construct
agggactctgcccctagct

SEQ ID NO: 9550 - DNA, 24 bp, Artificial Sequence
  Synthetic Construct
gccccttgaaatactgtgaaatcc

SEQ ID NO: 9551 - DNA, 21 bp, Artificial Sequence
  Synthetic Construct
atggaccccactccctatgtt

SEQ ID NO: 9552 - DNA, 26 bp, Artificial Sequence
  Synthetic Construct
ggcacagctgagatgttgaattactc

SEQ ID NO: 9553 - DNA, 19 bp, Artificial Sequence
  Synthetic Construct
tttgggccgaggcatcaca

SEQ ID NO: 9554 - DNA, 22 bp, Artificial Sequence
  Synthetic Construct
acccactggattctcccttagt

SEQ ID NO: 9555 - DNA, 29 bp, Artificial Sequence
  Synthetic Construct
ccacttccaagaagatagttcattcatca

SEQ ID NO: 9556 - DNA, 20 bp, Artificial Sequence
  Synthetic Construct
cctttgctgcttccggatgt

SEQ ID NO: 9557 - DNA, 24 bp, Artificial Sequence
  Synthetic Construct
tgaagttcgacctgaaagaacact

SEQ ID NO: 9558 - DNA, 24 bp, Artificial Sequence
  Synthetic Construct
agcaatcccgtcctacctctaaac

SEQ ID NO: 9559 - DNA, 21 bp, Artificial Sequence
  Synthetic Construct
cccaggcatgagaaggaacct

SEQ ID NO: 9560 - DNA, 18 bp, Artificial Sequence
  Synthetic Construct
tggctgacgctgcactgt

SEQ ID NO: 9561 - DNA, 19 bp, Artificial Sequence
  Synthetic Construct
cctgtgtggcatgcagtct

SEQ ID NO: 9562 - DNA, 20 bp, Artificial Sequence
  Synthetic Construct
gggttacctcagctgttgca

SEQ ID NO: 9563 - DNA, 24 bp, Artificial Sequence
  Synthetic Construct
gcattacagtccccctgaaaagct

SEQ ID NO: 9564 - DNA, 27 bp, Artificial Sequence
  Synthetic Construct
ctgtcacaaaggctgtccttaataaat

SEQ ID NO: 9565 - DNA, 23 bp, Artificial Sequence
  Synthetic Construct
ccttgctggtgagacctaagact

SEQ ID NO: 9566 - DNA, 21 bp, Artificial Sequence
  Synthetic Construct
tcgtcctgccaactgacagtt

SEQ ID NO: 9567 - DNA, 22 bp, Artificial Sequence
  Synthetic Construct
ctgtcagggtctgcatgtgtat

SEQ ID NO: 9568 - DNA, 25 bp, Artificial Sequence
  Synthetic Construct
cacttttccactgaagatccaagca

SEQ ID NO: 9569 - DNA, 22 bp, Artificial Sequence
  Synthetic Construct
ctgggagctggaacttcaaagt

SEQ ID NO: 9570 - DNA, 28 bp, Artificial Sequence
  Synthetic Construct
cctttttcctctcctttaatcaaccaat

SEQ ID NO: 9571 - DNA, 26 bp, Artificial Sequence
  Synthetic Construct
cctgcttgttcataggcatgaaaatg

SEQ ID NO: 9572 - DNA, 23 bp, Artificial Sequence
  Synthetic Construct
tcagaggctgtaccttgacaatc

SEQ ID NO: 9573 - DNA, 24 bp, Artificial Sequence
  Synthetic Construct
tgacatccagcaactagacagaga

SEQ ID NO: 9574 - DNA, 26 bp, Artificial Sequence
  Synthetic Construct
ttcacttcaagttttcaagctgcata

SEQ ID NO: 9575 - DNA, 22 bp, Artificial Sequence
  Synthetic Construct
cacttcagggccacttactcaa

SEQ ID NO: 9576 - DNA, 22 bp, Artificial Sequence
  Synthetic Construct
tcagctcctttcaaagcaaggt

SEQ ID NO: 9577 - DNA, 24 bp, Artificial Sequence
  Synthetic Construct
ggtcacacacaagccatgtctaga

SEQ ID NO: 9578 - DNA, 28 bp, Artificial Sequence
  Synthetic Construct
gaaagagcattggatatttatggagcaa

SEQ ID NO: 9579 - DNA, 25 bp, Artificial Sequence
  Synthetic Construct
ccagaaagcaggtttcacctttagc

SEQ ID NO: 9580 - DNA, 22 bp, Artificial Sequence
  Synthetic Construct
gtcagactggctaagcaacaca

SEQ ID NO: 9581 - DNA, 23 bp, Artificial Sequence
  Synthetic Construct
gcttctgcttcttcctagcacat

SEQ ID NO: 9582 - DNA, 29 bp, Artificial Sequence
  Synthetic Construct
tcactttataaactgcaatggaattcagt

SEQ ID NO: 9583 - DNA, 21 bp, Artificial Sequence
  Synthetic Construct
cctgaagctcagagccaacct

SEQ ID NO: 9584 - DNA, 24 bp, Artificial Sequence
  Synthetic Construct
gtgaagcagagatgaagcaccaaa

SEQ ID NO: 9585 - DNA, 22 bp, Artificial Sequence
  Synthetic Construct
aggtcactgggaactgttcctt

SEQ ID NO: 9586 - DNA, 20 bp, Artificial Sequence
  Synthetic Construct
agactgaaggccctgaagga

SEQ ID NO: 9587 - DNA, 24 bp, Artificial Sequence
  Synthetic Construct
gcatagtagggaaaagggaccttt

SEQ ID NO: 9588 - DNA, 20 bp, Artificial Sequence
  Synthetic Construct
agtgatggcgtgttgggatt

SEQ ID NO: 9589 - DNA, 27 bp, Artificial Sequence
  Synthetic Construct
cagaaacagtgatctatcagttgcaat

SEQ ID NO: 9590 - DNA, 22 bp, Artificial Sequence
  Synthetic Construct
cactgctttgtggaccaggtta

SEQ ID NO: 9591 - DNA, 21 bp, Artificial Sequence
  Synthetic Construct
aaggcatctctcacacaagca

SEQ ID NO: 9592 - DNA, 26 bp, Artificial Sequence
  Synthetic Construct
cattaaccttacaagcagagggagaa

SEQ ID NO: 9593 - DNA, 25 bp, Artificial Sequence
  Synthetic Construct
gcacagttgttagagaaagtttgga

SEQ ID NO: 9594 - DNA, 26 bp, Artificial Sequence
  Synthetic Construct
ggagagcaccttctctcttacataag

SEQ ID NO: 9595 - DNA, 23 bp, Artificial Sequence
  Synthetic Construct
tgggcttcctcccacaattttac

SEQ ID NO: 9596 - DNA, 28 bp, Artificial Sequence
  Synthetic Construct
cagacagattttactctgagttgtgtca

SEQ ID NO: 9597 - DNA, 21 bp, Artificial Sequence
  Synthetic Construct
aagcacgtcccagtagtttcc

SEQ ID NO: 9598 - DNA, 22 bp, Artificial Sequence
  Synthetic Construct
caaactgtggcaatgcgaatga

SEQ ID NO: 9599 - DNA, 24 bp, Artificial Sequence
  Synthetic Construct
gccagcctcaagatttgtggtcaa

SEQ ID NO: 9600 - DNA, 25 bp, Artificial Sequence
  Synthetic Construct
gtgcttgtgagtttttgagcctaga

SEQ ID NO: 9601 - DNA, 22 bp, Artificial Sequence
  Synthetic Construct
ggaccttggccattatcattgc

SEQ ID NO: 9602 - DNA, 24 bp, Artificial Sequence
  Synthetic Construct
tctaccatggctccaggtttaaac

SEQ ID NO: 9603 - DNA, 22 bp, Artificial Sequence
  Synthetic Construct
agaggaccaaggacgttcgtaa

SEQ ID NO: 9604 - DNA, 21 bp, Artificial Sequence
  Synthetic Construct
tcacagaaatgcgaccacaga

SEQ ID NO: 9605 - DNA, 24 bp, Artificial Sequence
  Synthetic Construct
tgaatttggtagggaggacacaaa

SEQ ID NO: 9606 - DNA, 24 bp, Artificial Sequence
  Synthetic Construct
tggatggacgggggtactatttct

SEQ ID NO: 9607 - DNA, 24 bp, Artificial Sequence
  Synthetic Construct
attatggctcactgtagcctcaaa

SEQ ID NO: 9608 - DNA, 20 bp, Artificial Sequence
  Synthetic Construct
catggctggcagttggtact

SEQ ID NO: 9609 - DNA, 20 bp, Artificial Sequence
  Synthetic Construct
gcagtcaagcctcctttcca

SEQ ID NO: 9610 - DNA, 24 bp, Artificial Sequence
  Synthetic Construct
gccaacctaaagcaagctcaaacc

SEQ ID NO: 9611 - DNA, 29 bp, Artificial Sequence
  Synthetic Construct
ctgatttggggagagtaaaatgtcattag

SEQ ID NO: 9612 - DNA, 20 bp, Artificial Sequence
  Synthetic Construct
ttgggtggcatcctgcaatg

SEQ ID NO: 9613 - DNA, 29 bp, Artificial Sequence
  Synthetic Construct
ggctgagtaaactggcttatctctgaaat

SEQ ID NO: 9614 - DNA, 24 bp, Artificial Sequence
  Synthetic Construct
acccacagactcgtcttgataggt

SEQ ID NO: 9615 - DNA, 22 bp, Artificial Sequence
  Synthetic Construct
tgcccggtcttctgttcctaaa

SEQ ID NO: 9616 - DNA, 22 bp, Artificial Sequence
  Synthetic Construct
tgccccttcactctgttgatga

SEQ ID NO: 9617 - DNA, 22 bp, Artificial Sequence
  Synthetic Construct
acaagctgcagcctactaacac

SEQ ID NO: 9618 - DNA, 20 bp, Artificial Sequence
  Synthetic Construct
atggggctgagtgacaagga

SEQ ID NO: 9619 - DNA, 22 bp, Artificial Sequence
  Synthetic Construct
tcccacccgcatagaaaagatg

SEQ ID NO: 9620 - DNA, 25 bp, Artificial Sequence
  Synthetic Construct
gcaaacttttgactgacgttctcaa

SEQ ID NO: 9621 - DNA, 25 bp, Artificial Sequence
  Synthetic Construct
gacttgaaaagttctccccaaatgc

SEQ ID NO: 9622 - DNA, 28 bp, Artificial Sequence
  Synthetic Construct
ggtttaagaaagccttagaactccatct

SEQ ID NO: 9623 - DNA, 23 bp, Artificial Sequence
  Synthetic Construct
cactgctgtgccagaaaaacttg

SEQ ID NO: 9624 - DNA, 21 bp, Artificial Sequence
  Synthetic Construct
agggaacaggagcctgctact

SEQ ID NO: 9625 - DNA, 21 bp, Artificial Sequence
  Synthetic Construct
agtagcgtccagtgtgacaga

SEQ ID NO: 9626 - DNA, 24 bp, Artificial Sequence
  Synthetic Construct
gggggctacattaactctgttgga

SEQ ID NO: 9627 - DNA, 28 bp, Artificial Sequence
  Synthetic Construct
gtaggattcttgtcttagcatgtctttg

SEQ ID NO: 9628 - DNA, 21 bp, Artificial Sequence
  Synthetic Construct
tcctgacccaggtttgttcgt

SEQ ID NO: 9629 - DNA, 21 bp, Artificial Sequence
  Synthetic Construct
aaccccagtgcctgcaaatgt

SEQ ID NO: 9630 - DNA, 21 bp, Artificial Sequence
  Synthetic Construct
agcctagtgacagcacctgaa

SEQ ID NO: 9631 - DNA, 26 bp, Artificial Sequence
  Synthetic Construct
gcagtcacttccagagtcattacttc

SEQ ID NO: 9632 - DNA, 24 bp, Artificial Sequence
  Synthetic Construct
agttgcagtctaggttttgttggt

SEQ ID NO: 9633 - DNA, 20 bp, Artificial Sequence
  Synthetic Construct
aaagtgtggccagtgtttgc

SEQ ID NO: 9634 - DNA, 23 bp, Artificial Sequence
  Synthetic Construct
tgggaggagagagccatattcca

SEQ ID NO: 9635 - DNA, 27 bp, Artificial Sequence
  Synthetic Construct
acttggcatttaatgggaactatttcc

SEQ ID NO: 9636 - DNA, 28 bp, Artificial Sequence
  Synthetic Construct
ggagaaatgagatagacgtgttgtgttc

SEQ ID NO: 9637 - DNA, 26 bp, Artificial Sequence
  Synthetic Construct
ctcatcagagctcagtatggggacat

SEQ ID NO: 9638 - DNA, 21 bp, Artificial Sequence
  Synthetic Construct
aggaccttgaggtggcctgaa

SEQ ID NO: 9639 - DNA, 20 bp, Artificial Sequence
  Synthetic Construct
tttgcatcctgccacatcct

SEQ ID NO: 9640 - DNA, 23 bp, Artificial Sequence
  Synthetic Construct
acacactcatactcctcccatct

SEQ ID NO: 9641 - DNA, 19 bp, Artificial Sequence
  Synthetic Construct
gccagaccatcctgcatgt

SEQ ID NO: 9642 - DNA, 24 bp, Artificial Sequence
  Synthetic Construct
gtggaagtgacaatgtgtgatagc

SEQ ID NO: 9643 - DNA, 28 bp, Artificial Sequence
  Synthetic Construct
gagaaaagatccttgaagcatagtgttt

SEQ ID NO: 9644 - DNA, 30 bp, Artificial Sequence
  Synthetic Construct
gcctaatccataaccaagaattaccctcta

SEQ ID NO: 9645 - DNA, 19 bp, Artificial Sequence
  Synthetic Construct
tttcctgcaggccctttcg

SEQ ID NO: 9646 - DNA, 18 bp, Artificial Sequence
  Synthetic Construct
aagcctcgctcccttcct

SEQ ID NO: 9647 - DNA, 25 bp, Artificial Sequence
  Synthetic Construct
gcatggcacacaatgagaagatgag

SEQ ID NO: 9648 - DNA, 20 bp, Artificial Sequence
  Synthetic Construct
tcctgggctcaagggatcct

SEQ ID NO: 9649 - DNA, 25 bp, Artificial Sequence
  Synthetic Construct
atgacaagatgagtctggtttcagt

SEQ ID NO: 9650 - DNA, 28 bp, Artificial Sequence
  Synthetic Construct
gctgtccaaaaaatattctcctgtccat

SEQ ID NO: 9651 - DNA, 20 bp, Artificial Sequence
  Synthetic Construct
gtggagccacaacagcaaga

SEQ ID NO: 9652 - DNA, 26 bp, Artificial Sequence
  Synthetic Construct
ccccaaaatagtcgaaggttcaaagc

SEQ ID NO: 9653 - DNA, 30 bp, Artificial Sequence
  Synthetic Construct
tccttaggtacttattattgcacacaagta

SEQ ID NO: 9654 - DNA, 24 bp, Artificial Sequence
  Synthetic Construct
aggcaccctctctctagattcaac

SEQ ID NO: 9655 - DNA, 28 bp, Artificial Sequence
  Synthetic Construct
ctgagtgacttatgactcagtttttctg

SEQ ID NO: 9656 - DNA, 22 bp, Artificial Sequence
  Synthetic Construct
cacccctacgtgttcaatcagt

SEQ ID NO: 9657 - DNA, 22 bp, Artificial Sequence
  Synthetic Construct
gcaggtgcatagctgggacaga

SEQ ID NO: 9658 - DNA, 27 bp, Artificial Sequence
  Synthetic Construct
ggcattaccctaggaattcaggaagaa

SEQ ID NO: 9659 - DNA, 22 bp, Artificial Sequence
  Synthetic Construct
gacctggaaattaggcccttca

SEQ ID NO: 9660 - DNA, 30 bp, Artificial Sequence
  Synthetic Construct
gcagtcttcaaaaatttttaagggcagatt

SEQ ID NO: 9661 - DNA, 22 bp, Artificial Sequence
  Synthetic Construct
agttcaggctgcagtacagttg

SEQ ID NO: 9662 - DNA, 24 bp, Artificial Sequence
  Synthetic Construct
ggagatagagggcctatccttcct

SEQ ID NO: 9663 - DNA, 22 bp, Artificial Sequence
  Synthetic Construct
tctgctcacaacctagcaacct

SEQ ID NO: 9664 - DNA, 23 bp, Artificial Sequence
  Synthetic Construct
tcctcctttctcccccaactagt

SEQ ID NO: 9665 - DNA, 30 bp, Artificial Sequence
  Synthetic Construct
gtagagcagatgtttgtaatatgggtttta

SEQ ID NO: 9666 - DNA, 23 bp, Artificial Sequence
  Synthetic Construct
ggttcaacagagctgagatctga

SEQ ID NO: 9667 - DNA, 20 bp, Artificial Sequence
  Synthetic Construct
tccccaccacccatcttgat

SEQ ID NO: 9668 - DNA, 25 bp, Artificial Sequence
  Synthetic Construct
ctagactgagtcatgcattctcaca

SEQ ID NO: 9669 - DNA, 23 bp, Artificial Sequence
  Synthetic Construct
aatcctgactcccaaagcatcaa

SEQ ID NO: 9670 - DNA, 25 bp, Artificial Sequence
  Synthetic Construct
ttaagggaagggcataggaaaaagt

SEQ ID NO: 9671 - DNA, 24 bp, Artificial Sequence
  Synthetic Construct
gcacttcccacagattaggaacca

SEQ ID NO: 9672 - DNA, 19 bp, Artificial Sequence
  Synthetic Construct
tccaggtctgggcccacaa

SEQ ID NO: 9673 - DNA, 25 bp, Artificial Sequence
  Synthetic Construct
tccttgtctaatacccctgcaattt

SEQ ID NO: 9674 - DNA, 25 bp, Artificial Sequence
  Synthetic Construct
ggagttgctcaaattcttggagcaa

SEQ ID NO: 9675 - DNA, 26 bp, Artificial Sequence
  Synthetic Construct
ccactgacatcatttttcaggtcttg

SEQ ID NO: 9676 - DNA, 19 bp, Artificial Sequence
  Synthetic Construct
gcctctgcagtgggatcag

SEQ ID NO: 9677 - DNA, 22 bp, Artificial Sequence
  Synthetic Construct
tgagtaactgtggccactgaga

SEQ ID NO: 9678 - DNA, 22 bp, Artificial Sequence
  Synthetic Construct
tcctggggccaagactcctaaa

SEQ ID NO: 9679 - DNA, 29 bp, Artificial Sequence
  Synthetic Construct
gcttcagaaatgatatgtgttcaagagta

SEQ ID NO: 9680 - DNA, 22 bp, Artificial Sequence
  Synthetic Construct
ccgctctacaggtttcaacagt

SEQ ID NO: 9681 - DNA, 26 bp, Artificial Sequence
  Synthetic Construct
gctctctgtttacttccagtgttcca

SEQ ID NO: 9682 - DNA, 23 bp, Artificial Sequence
  Synthetic Construct
gcttttaccccaactgtctcact

SEQ ID NO: 9683 - DNA, 22 bp, Artificial Sequence
  Synthetic Construct
agccttcactggattgcctatc

SEQ ID NO: 9684 - DNA, 18 bp, Artificial Sequence
  Synthetic Construct
aggtgcctgccctaacct

SEQ ID NO: 9685 - DNA, 26 bp, Artificial Sequence
  Synthetic Construct
cttgcatttcctatgtaatggccaaa

SEQ ID NO: 9686 - DNA, 23 bp, Artificial Sequence
  Synthetic Construct
agattgtcacatgggcatgttgt

SEQ ID NO: 9687 - DNA, 24 bp, Artificial Sequence
  Synthetic Construct
gaaatcttgctggtgggattcagt

SEQ ID NO: 9688 - DNA, 28 bp, Artificial Sequence
  Synthetic Construct
caatacagatttgaggggatcagaattg

SEQ ID NO: 9689 - DNA, 27 bp, Artificial Sequence
  Synthetic Construct
gcaactgcattagtggtattcatgtca

SEQ ID NO: 9690 - DNA, 20 bp, Artificial Sequence
  Synthetic Construct
gcccaggatcctgcactagt

SEQ ID NO: 9691 - DNA, 19 bp, Artificial Sequence
  Synthetic Construct
agggaggcgcctggcatct

SEQ ID NO: 9692 - DNA, 22 bp, Artificial Sequence
  Synthetic Construct
accagactgaaagccagaagac

SEQ ID NO: 9693 - DNA, 25 bp, Artificial Sequence
  Synthetic Construct
ggtgtcagataacctgagagccatt

SEQ ID NO: 9694 - DNA, 24 bp, Artificial Sequence
  Synthetic Construct
ccagcctaaggactgtgtaagaag

SEQ ID NO: 9695 - DNA, 27 bp, Artificial Sequence
  Synthetic Construct
cacagttcaatctgtaatagcttgctt

SEQ ID NO: 9696 - DNA, 23 bp, Artificial Sequence
  Synthetic Construct
gctgcaaatccattctccttctc

SEQ ID NO: 9697 - DNA, 25 bp, Artificial Sequence
  Synthetic Construct
ctgattctgccacctatactgaact

SEQ ID NO: 9698 - DNA, 24 bp, Artificial Sequence
  Synthetic Construct
gctggagaagctggaaaggagttt

SEQ ID NO: 9699 - DNA, 22 bp, Artificial Sequence
  Synthetic Construct
ggccccaggaaaaacggaaaat

SEQ ID NO: 9700 - DNA, 21 bp, Artificial Sequence
  Synthetic Construct
ctggggttgagagtgggtaga

SEQ ID NO: 9701 - DNA, 22 bp, Artificial Sequence
  Synthetic Construct
cctaacccctgcctttctagca

SEQ ID NO: 9702 - DNA, 30 bp, Artificial Sequence
  Synthetic Construct
gcagatcacttaccttaggatagcatacac

SEQ ID NO: 9703 - DNA, 19 bp, Artificial Sequence
  Synthetic Construct
gccccagccgtcacattct

SEQ ID NO: 9704 - DNA, 30 bp, Artificial Sequence
  Synthetic Construct
gttttaaggcaaagacagagaattcattga

SEQ ID NO: 9705 - DNA, 22 bp, Artificial Sequence
  Synthetic Construct
gcctgaatcccatgcctaccaa

SEQ ID NO: 9706 - DNA, 19 bp, Artificial Sequence
  Synthetic Construct
atggcaggggcggggtaca

SEQ ID NO: 9707 - DNA, 26 bp, Artificial Sequence
  Synthetic Construct
ccaagccataaatgcactaggattgc

SEQ ID NO: 9708 - DNA, 23 bp, Artificial Sequence
  Synthetic Construct
ctctcaaaccggaactcatttgc

SEQ ID NO: 9709 - DNA, 22 bp, Artificial Sequence
  Synthetic Construct
aaggtcttctgagagggaaggt

SEQ ID NO: 9710 - DNA, 28 bp, Artificial Sequence
  Synthetic Construct
tgtggaacagagcaatttaaatggaaat

SEQ ID NO: 9711 - DNA, 23 bp, Artificial Sequence
  Synthetic Construct
gtccacagattgatcaccatgca

SEQ ID NO: 9712 - DNA, 30 bp, Artificial Sequence
  Synthetic Construct
ctgcttaatcatttgggttaagtggtatta

SEQ ID NO: 9713 - DNA, 27 bp, Artificial Sequence
  Synthetic Construct
acttcagacaagtatagctcccagctt

SEQ ID NO: 9714 - DNA, 22 bp, Artificial Sequence
  Synthetic Construct
ctggggtcatggtttcaaggaa

SEQ ID NO: 9715 - DNA, 22 bp, Artificial Sequence
  Synthetic Construct
gctgtgttgagaacaggctgaa

SEQ ID NO: 9716 - DNA, 22 bp, Artificial Sequence
  Synthetic Construct
aggcttagtctggcagcttgtt

SEQ ID NO: 9717 - DNA, 30 bp, Artificial Sequence
  Synthetic Construct
gcaaaagagctatatctccattctattcac

SEQ ID NO: 9718 - DNA, 25 bp, Artificial Sequence
  Synthetic Construct
ggaaaaggaggtacaggagagaaaa

SEQ ID NO: 9719 - DNA, 28 bp, Artificial Sequence
  Synthetic Construct
ggatgtatagggacagttttcctgaaag

SEQ ID NO: 9720 - DNA, 25 bp, Artificial Sequence
  Synthetic Construct
cctgatgcctgtctgatttgaactg

SEQ ID NO: 9721 - DNA, 22 bp, Artificial Sequence
  Synthetic Construct
actcctgggctcaagtaatcct

SEQ ID NO: 9722 - DNA, 20 bp, Artificial Sequence
  Synthetic Construct
actcccagcaccaagtcagt

SEQ ID NO: 9723 - DNA, 22 bp, Artificial Sequence
  Synthetic Construct
agcaatgtgaccagggtgaagt

SEQ ID NO: 9724 - DNA, 28 bp, Artificial Sequence
  Synthetic Construct
ctacagaatttagttgtggggaactaga

SEQ ID NO: 9725 - DNA, 24 bp, Artificial Sequence
  Synthetic Construct
aggaaactgagaactgtcctctct

SEQ ID NO: 9726 - DNA, 29 bp, Artificial Sequence
  Synthetic Construct
tggagtgttcatataccctttgaagataa

SEQ ID NO: 9727 - DNA, 20 bp, Artificial Sequence
  Synthetic Construct
gcgaaaaacacgcccttgat

SEQ ID NO: 9728 - DNA, 28 bp, Artificial Sequence
  Synthetic Construct
agcatttcagtccatagtaaacaagaag

SEQ ID NO: 9729 - DNA, 23 bp, Artificial Sequence
  Synthetic Construct
agccaggtcctttccttcaaagc

SEQ ID NO: 9730 - DNA, 30 bp, Artificial Sequence
  Synthetic Construct
gatttataatgtaaaggcttgctctgtttg

SEQ ID NO: 9731 - DNA, 24 bp, Artificial Sequence
  Synthetic Construct
gctacgaacacaagaaggctttcc

SEQ ID NO: 9732 - DNA, 24 bp, Artificial Sequence
  Synthetic Construct
cccaagtagctggaactataagca

SEQ ID NO: 9733 - DNA, 26 bp, Artificial Sequence
  Synthetic Construct
agtagttacagtcatccctccttacc

SEQ ID NO: 9734 - DNA, 22 bp, Artificial Sequence
  Synthetic Construct
tgtaggacacggggtaggaaat

SEQ ID NO: 9735 - DNA, 22 bp, Artificial Sequence
  Synthetic Construct
gccctaggagtgttaacagctt

SEQ ID NO: 9736 - DNA, 26 bp, Artificial Sequence
  Synthetic Construct
cacaaccagaagatgatatccaggtt

SEQ ID NO: 9737 - DNA, 29 bp, Artificial Sequence
  Synthetic Construct
gcactcaaatctaattaacggctacaaca

SEQ ID NO: 9738 - DNA, 19 bp, Artificial Sequence
  Synthetic Construct
gccaagggtggtgcagtgt

SEQ ID NO: 9739 - DNA, 18 bp, Artificial Sequence
  Synthetic Construct
gccagcctctgccaggta

SEQ ID NO: 9740 - DNA, 20 bp, Artificial Sequence
  Synthetic Construct
gcatgggaagcgaccattgg

SEQ ID NO: 9741 - DNA, 26 bp, Artificial Sequence
  Synthetic Construct
ttccagtaggagttgtgtgaatgtta

SEQ ID NO: 9742 - DNA, 30 bp, Artificial Sequence
  Synthetic Construct
gtcaatcttaacacttcatatgtggagaac

SEQ ID NO: 9743 - DNA, 22 bp, Artificial Sequence
  Synthetic Construct
gaacccaatcccttgcaatggt

SEQ ID NO: 9744 - DNA, 27 bp, Artificial Sequence
  Synthetic Construct
gaaaccctataagctagaagggatcag

SEQ ID NO: 9745 - DNA, 27 bp, Artificial Sequence
  Synthetic Construct
gtttcaggtaaagccctgttactatgt

SEQ ID NO: 9746 - DNA, 25 bp, Artificial Sequence
  Synthetic Construct
gtcttgccttgtttgggtaatacca

SEQ ID NO: 9747 - DNA, 20 bp, Artificial Sequence
  Synthetic Construct
tgctggtggtgggttgatga

SEQ ID NO: 9748 - DNA, 24 bp, Artificial Sequence
  Synthetic Construct
accctctcctgatcccactttacc

SEQ ID NO: 9749 - DNA, 29 bp, Artificial Sequence
  Synthetic Construct
gaagaaatcttaagtccttactgctttgt

SEQ ID NO: 9750 - DNA, 22 bp, Artificial Sequence
  Synthetic Construct
gagggaggtgtcctcatagtct

SEQ ID NO: 9751 - DNA, 20 bp, Artificial Sequence
  Synthetic Construct
ccacgcgatgctgtctcatc

SEQ ID NO: 9752 - DNA, 29 bp, Artificial Sequence
  Synthetic Construct
ggaatctaaaaggaaatactggtggttct

SEQ ID NO: 9753 - DNA, 22 bp, Artificial Sequence
  Synthetic Construct
aacagccctggataaggcaaga

SEQ ID NO: 9754 - DNA, 29 bp, Artificial Sequence
  Synthetic Construct
tgacttaaagtagctatggcagagatatt

SEQ ID NO: 9755 - DNA, 22 bp, Artificial Sequence
  Synthetic Construct
gctccccaaatcagctctagca

SEQ ID NO: 9756 - DNA, 21 bp, Artificial Sequence
  Synthetic Construct
cgtctggtgtggtttgctaga

SEQ ID NO: 9757 - DNA, 23 bp, Artificial Sequence
  Synthetic Construct
tgctaggacctgttgactgaaga

SEQ ID NO: 9758 - DNA, 22 bp, Artificial Sequence
  Synthetic Construct
aagacagcctgagaagcacaga

SEQ ID NO: 9759 - DNA, 26 bp, Artificial Sequence
  Synthetic Construct
caacactagctttttttctccttggt

SEQ ID NO: 9760 - DNA, 20 bp, Artificial Sequence
  Synthetic Construct
tctgtggctgggaggaaacc

SEQ ID NO: 9761 - DNA, 28 bp, Artificial Sequence
  Synthetic Construct
ggtttgaatttacatgcatcaggtgtac

SEQ ID NO: 9762 - DNA, 24 bp, Artificial Sequence
  Synthetic Construct
gacagagggtctcagtatcaagct

SEQ ID NO: 9763 - DNA, 22 bp, Artificial Sequence
  Synthetic Construct
cgtggccattttcctgaaccta

SEQ ID NO: 9764 - DNA, 21 bp, Artificial Sequence
  Synthetic Construct
ctccagctgctctgtcttcag

SEQ ID NO: 9765 - DNA, 30 bp, Artificial Sequence
  Synthetic Construct
agtagaaagctctaggaggtttatattgtg

SEQ ID NO: 9766 - DNA, 20 bp, Artificial Sequence
  Synthetic Construct
ctgccccaagttctgtggat

SEQ ID NO: 9767 - DNA, 27 bp, Artificial Sequence
  Synthetic Construct
gagctttgatgtttgtgagctctattt

SEQ ID NO: 9768 - DNA, 19 bp, Artificial Sequence
  Synthetic Construct
agttgcctggctggtttgg

SEQ ID NO: 9769 - DNA, 18 bp, Artificial Sequence
  Synthetic Construct
agcctctgtggggcatgt

SEQ ID NO: 9770 - DNA, 21 bp, Artificial Sequence
  Synthetic Construct
tgggacacacatctgctagga

SEQ ID NO: 9771 - DNA, 24 bp, Artificial Sequence
  Synthetic Construct
gatctccctgcttctacccttaac

SEQ ID NO: 9772 - DNA, 18 bp, Artificial Sequence
  Synthetic Construct
tacgggctgggacatggt

SEQ ID NO: 9773 - DNA, 19 bp, Artificial Sequence
  Synthetic Construct
tgggtgactgaggctgact

SEQ ID NO: 9774 - DNA, 18 bp, Artificial Sequence
  Synthetic Construct
cagtgcagcccccatgct

SEQ ID NO: 9775 - DNA, 30 bp, Artificial Sequence
  Synthetic Construct
cagactcctctgcttataagaattatacca

SEQ ID NO: 9776 - DNA, 24 bp, Artificial Sequence
  Synthetic Construct
gggtcttggagtagatggtttgga

SEQ ID NO: 9777 - DNA, 23 bp, Artificial Sequence
  Synthetic Construct
atcagcctctctcagaactcaga

SEQ ID NO: 9778 - DNA, 25 bp, Artificial Sequence
  Synthetic Construct
gtcgttggaaatacaaagccactaa

SEQ ID NO: 9779 - DNA, 26 bp, Artificial Sequence
  Synthetic Construct
ctgggcaatcataaagatctcaaggt

SEQ ID NO: 9780 - DNA, 23 bp, Artificial Sequence
  Synthetic Construct
tctcacacattgtttccccaagt

SEQ ID NO: 9781 - DNA, 25 bp, Artificial Sequence
  Synthetic Construct
ggctgggtcactttgatctccttat

SEQ ID NO: 9782 - DNA, 27 bp, Artificial Sequence
  Synthetic Construct
cccacctttcatcttttaccacaagct

SEQ ID NO: 9783 - DNA, 22 bp, Artificial Sequence
  Synthetic Construct
gaaagtggtgatttgccaacca

SEQ ID NO: 9784 - DNA, 30 bp, Artificial Sequence
  Synthetic Construct
ttgattaattaccacacagtgaatacacat

SEQ ID NO: 9785 - DNA, 25 bp, Artificial Sequence
  Synthetic Construct
aaggcaaattctctctctagagcaa

SEQ ID NO: 9786 - DNA, 20 bp, Artificial Sequence
  Synthetic Construct
tgcgatggctcatgcttctg

SEQ ID NO: 9787 - DNA, 22 bp, Artificial Sequence
  Synthetic Construct
gccgccctacagattcctaact

SEQ ID NO: 9788 - DNA, 19 bp, Artificial Sequence
  Synthetic Construct
aagggccagccacctgcaa

SEQ ID NO: 9789 - DNA, 20 bp, Artificial Sequence
  Synthetic Construct
gctcatcggtgcccaaagtc

SEQ ID NO: 9790 - DNA, 22 bp, Artificial Sequence
  Synthetic Construct
gggcaggacgagagaagaaaaa

SEQ ID NO: 9791 - DNA, 25 bp, Artificial Sequence
  Synthetic Construct
gagaaagtgaaatgcgcaaatgtga

SEQ ID NO: 9792 - DNA, 27 bp, Artificial Sequence
  Synthetic Construct
aaattgctgggtaaaacatcgaataca

SEQ ID NO: 9793 - DNA, 22 bp, Artificial Sequence
  Synthetic Construct
tgcccgagaatctcctggtgaa

SEQ ID NO: 9794 - DNA, 27 bp, Artificial Sequence
  Synthetic Construct
aggtcttcaatgtgttgtaatcactga

SEQ ID NO: 9795 - DNA, 26 bp, Artificial Sequence
  Synthetic Construct
gagaaggcccatttttacatcaggaa

SEQ ID NO: 9796 - DNA, 25 bp, Artificial Sequence
  Synthetic Construct
ccatcctgtctccattcatcatggt

SEQ ID NO: 9797 - DNA, 24 bp, Artificial Sequence
  Synthetic Construct
ggaaaaatggatcttgctcatgca

SEQ ID NO: 9798 - DNA, 19 bp, Artificial Sequence
  Synthetic Construct
tgcatgcccaggctgatct

SEQ ID NO: 9799 - DNA, 27 bp, Artificial Sequence
  Synthetic Construct
cccctttttaggtgtgtaatcctaggt

SEQ ID NO: 9800 - DNA, 29 bp, Artificial Sequence
  Synthetic Construct
acaatttaagggtaaaggaaatgcaattg

SEQ ID NO: 9801 - DNA, 25 bp, Artificial Sequence
  Synthetic Construct
cgtgagtaacccttcacttctgatg

SEQ ID NO: 9802 - DNA, 27 bp, Artificial Sequence
  Synthetic Construct
ggtcaatctttatttgcctacctttca

SEQ ID NO: 9803 - DNA, 22 bp, Artificial Sequence
  Synthetic Construct
agcacctgaagaacgcgattga

SEQ ID NO: 9804 - DNA, 29 bp, Artificial Sequence
  Synthetic Construct
ccaatgaaagaagggactatgtagctcat

SEQ ID NO: 9805 - DNA, 29 bp, Artificial Sequence
  Synthetic Construct
ggttgtttagttagcagagacaatgaaac

SEQ ID NO: 9806 - DNA, 25 bp, Artificial Sequence
  Synthetic Construct
gcacttactatcctggcactattct

SEQ ID NO: 9807 - DNA, 20 bp, Artificial Sequence
  Synthetic Construct
gccacaagccatgcaatgca

SEQ ID NO: 9808 - DNA, 22 bp, Artificial Sequence
  Synthetic Construct
tgccattgggagagtggttgat

SEQ ID NO: 9809 - DNA, 24 bp, Artificial Sequence
  Synthetic Construct
agttgaaatgatctctgcccacat

SEQ ID NO: 9810 - DNA, 19 bp, Artificial Sequence
  Synthetic Construct
agtgtgccgcgatcttcct

SEQ ID NO: 9811 - DNA, 21 bp, Artificial Sequence
  Synthetic Construct
gtcagaggccaccatcacttg

SEQ ID NO: 9812 - DNA, 30 bp, Artificial Sequence
  Synthetic Construct
gctttaaaaataagcactgcatttaattgc

SEQ ID NO: 9813 - DNA, 21 bp, Artificial Sequence
  Synthetic Construct
cccagcagagtgtctggaaca

SEQ ID NO: 9814 - DNA, 23 bp, Artificial Sequence
  Synthetic Construct
gtgatgcttccaacaaggctctt

SEQ ID NO: 9815 - DNA, 30 bp, Artificial Sequence
  Synthetic Construct
actcagaattagctaaattttgcattagga

SEQ ID NO: 9816 - DNA, 24 bp, Artificial Sequence
  Synthetic Construct
gtgaccacatgtgatttccttggt

SEQ ID NO: 9817 - DNA, 24 bp, Artificial Sequence
  Synthetic Construct
acgtctgacatctaccttcaggtt

SEQ ID NO: 9818 - DNA, 22 bp, Artificial Sequence
  Synthetic Construct
tgctgtgagcagacactcttag

SEQ ID NO: 9819 - DNA, 22 bp, Artificial Sequence
  Synthetic Construct
agctttcactgtgggccatatt

SEQ ID NO: 9820 - DNA, 26 bp, Artificial Sequence
  Synthetic Construct
gaaaatggtgaggggattaactcagt

SEQ ID NO: 9821 - DNA, 22 bp, Artificial Sequence
  Synthetic Construct
ctgtgtcggaaagggaaacgat

SEQ ID NO: 9822 - DNA, 20 bp, Artificial Sequence
  Synthetic Construct
aggcagagcacagaggactt

SEQ ID NO: 9823 - DNA, 18 bp, Artificial Sequence
  Synthetic Construct
gcccaggctggtcttgca

SEQ ID NO: 9824 - DNA, 24 bp, Artificial Sequence
  Synthetic Construct
acttgactgccctagctaaaaagg

SEQ ID NO: 9825 - DNA, 28 bp, Artificial Sequence
  Synthetic Construct
ggcatcagcatttgtgactaagtttacc

SEQ ID NO: 9826 - DNA, 24 bp, Artificial Sequence
  Synthetic Construct
tccagcttcctctccatcaaaatg

SEQ ID NO: 9827 - DNA, 19 bp, Artificial Sequence
  Synthetic Construct
tgcccatgggtcccaagat

SEQ ID NO: 9828 - DNA, 26 bp, Artificial Sequence
  Synthetic Construct
ccaagatactgtgctctgtactgaga

SEQ ID NO: 9829 - DNA, 21 bp, Artificial Sequence
  Synthetic Construct
atggccacccaagttctcttg

SEQ ID NO: 9830 - DNA, 20 bp, Artificial Sequence
  Synthetic Construct
gcattggtacaggccgttca

SEQ ID NO: 9831 - DNA, 18 bp, Artificial Sequence
  Synthetic Construct
tggcagctcccacacaca

SEQ ID NO: 9832 - DNA, 23 bp, Artificial Sequence
  Synthetic Construct
agtggacatccctgcttatcagt

SEQ ID NO: 9833 - DNA, 24 bp, Artificial Sequence
  Synthetic Construct
ggcagagaacagcaaatgcaaagg

SEQ ID NO: 9834 - DNA, 19 bp, Artificial Sequence
  Synthetic Construct
agggcaggtgtcagcagaa

SEQ ID NO: 9835 - DNA, 23 bp, Artificial Sequence
  Synthetic Construct
tgagtcctagaggagcagtgagt

SEQ ID NO: 9836 - DNA, 23 bp, Artificial Sequence
  Synthetic Construct
gcttgttgctgcaacacagtgat

SEQ ID NO: 9837 - DNA, 27 bp, Artificial Sequence
  Synthetic Construct
gctgagctgttttctcttaaagcaaca

SEQ ID NO: 9838 - DNA, 21 bp, Artificial Sequence
  Synthetic Construct
tttggcctgctccttctgtct

SEQ ID NO: 9839 - DNA, 28 bp, Artificial Sequence
  Synthetic Construct
cagccaaaataggaggattctattctgt

SEQ ID NO: 9840 - DNA, 27 bp, Artificial Sequence
  Synthetic Construct
cactcgacgaaagtgagacattatcag

SEQ ID NO: 9841 - DNA, 22 bp, Artificial Sequence
  Synthetic Construct
gctcccacctattcctgaaggt

SEQ ID NO: 9842 - DNA, 26 bp, Artificial Sequence
  Synthetic Construct
gagtagtgggaaatcattctgatcca

SEQ ID NO: 9843 - DNA, 22 bp, Artificial Sequence
  Synthetic Construct
agtagacggggatggcaataca

SEQ ID NO: 9844 - DNA, 24 bp, Artificial Sequence
  Synthetic Construct
ggatttacccgtgaaagtcaagct

SEQ ID NO: 9845 - DNA, 24 bp, Artificial Sequence
  Synthetic Construct
gttccattggcctatgtggaatct

SEQ ID NO: 9846 - DNA, 19 bp, Artificial Sequence
  Synthetic Construct
tggtgtgggcgcctaaact

SEQ ID NO: 9847 - DNA, 23 bp, Artificial Sequence
  Synthetic Construct
cttcatcccagaagtgacatgca

SEQ ID NO: 9848 - DNA, 19 bp, Artificial Sequence
  Synthetic Construct
gggtcacctcccccgaaac

SEQ ID NO: 9849 - DNA, 21 bp, Artificial Sequence
  Synthetic Construct
agcgtcccgatgagataagga

SEQ ID NO: 9850 - DNA, 25 bp, Artificial Sequence
  Synthetic Construct
gcaagagtacttcagaggtgataca

SEQ ID NO: 9851 - DNA, 18 bp, Artificial Sequence
  Synthetic Construct
agctgcctggcacaagct

SEQ ID NO: 9852 - DNA, 22 bp, Artificial Sequence
  Synthetic Construct
gtcaagaaggtgccttgtggta

SEQ ID NO: 9853 - DNA, 27 bp, Artificial Sequence
  Synthetic Construct
gcacaagttgatctaatgcctatttgg

SEQ ID NO: 9854 - DNA, 22 bp, Artificial Sequence
  Synthetic Construct
gcccatgggttctgctttattg

SEQ ID NO: 9855 - DNA, 25 bp, Artificial Sequence
  Synthetic Construct
cactggtcccctttctacatagttg

SEQ ID NO: 9856 - DNA, 30 bp, Artificial Sequence
  Synthetic Construct
aaatctcatagttcattagtatgcgttgtt

SEQ ID NO: 9857 - DNA, 24 bp, Artificial Sequence
  Synthetic Construct
caccacttccatcatggttcatca

SEQ ID NO: 9858 - DNA, 24 bp, Artificial Sequence
  Synthetic Construct
ggcctgaggaattttggctattca

SEQ ID NO: 9859 - DNA, 26 bp, Artificial Sequence
  Synthetic Construct
caactgttccttactccctcttaacc

SEQ ID NO: 9860 - DNA, 21 bp, Artificial Sequence
  Synthetic Construct
ttgtatgcagccctggttcat

SEQ ID NO: 9861 - DNA, 21 bp, Artificial Sequence
  Synthetic Construct
tcttggccacctgtgaaagac

SEQ ID NO: 9862 - DNA, 27 bp, Artificial Sequence
  Synthetic Construct
cctctactccatcttttcacatgtgaa

SEQ ID NO: 9863 - DNA, 22 bp, Artificial Sequence
  Synthetic Construct
aacaagagtggctggtcaacct

SEQ ID NO: 9864 - DNA, 20 bp, Artificial Sequence
  Synthetic Construct
aagccaccccctcctcttca

SEQ ID NO: 9865 - DNA, 27 bp, Artificial Sequence
  Synthetic Construct
gccaagggtcttttgcttatcttttgg

SEQ ID NO: 9866 - DNA, 26 bp, Artificial Sequence
  Synthetic Construct
gccaatatgaaaagctgctccacaaa

SEQ ID NO: 9867 - DNA, 22 bp, Artificial Sequence
  Synthetic Construct
ctgtgtgggtctcatggagaag

SEQ ID NO: 9868 - DNA, 22 bp, Artificial Sequence
  Synthetic Construct
cacaactcagggccagtcaaat

SEQ ID NO: 9869 - DNA, 25 bp, Artificial Sequence
  Synthetic Construct
ccaggtgccacttcaaatattgaaa

SEQ ID NO: 9870 - DNA, 26 bp, Artificial Sequence
  Synthetic Construct
gcagaaaatgccaaagaaacaatggt

SEQ ID NO: 9871 - DNA, 24 bp, Artificial Sequence
  Synthetic Construct
ccattagacagagattggcactct

SEQ ID NO: 9872 - DNA, 29 bp, Artificial Sequence
  Synthetic Construct
gcccactattaatcttgatgaaacaacac

SEQ ID NO: 9873 - DNA, 27 bp, Artificial Sequence
  Synthetic Construct
cactttttaacattaccctgcagttga

SEQ ID NO: 9874 - DNA, 26 bp, Artificial Sequence
  Synthetic Construct
gaatgtgtgtacatatgggagaggaa

SEQ ID NO: 9875 - DNA, 27 bp, Artificial Sequence
  Synthetic Construct
ggcagaatggaaatacagcaaacagtt

SEQ ID NO: 9876 - DNA, 26 bp, Artificial Sequence
  Synthetic Construct
gagtacgcagcaagtaaaagtaaact

SEQ ID NO: 9877 - DNA, 23 bp, Artificial Sequence
  Synthetic Construct
gtgtgtctgtcttccctctaacc

SEQ ID NO: 9878 - DNA, 27 bp, Artificial Sequence
  Synthetic Construct
caaggatttaccacctctagagatagc

SEQ ID NO: 9879 - DNA, 23 bp, Artificial Sequence
  Synthetic Construct
cagacactgtctgtgagtagcat

SEQ ID NO: 9880 - DNA, 23 bp, Artificial Sequence
  Synthetic Construct
caggacgtttcttcaccacacaa

SEQ ID NO: 9881 - DNA, 26 bp, Artificial Sequence
  Synthetic Construct
tgtatgtgctcaactctatgctgatc

SEQ ID NO: 9882 - DNA, 20 bp, Artificial Sequence
  Synthetic Construct
ggcctggggtcttacatgca

SEQ ID NO: 9883 - DNA, 28 bp, Artificial Sequence
  Synthetic Construct
gagttcgtgaacaaatagagtgtgtaat

SEQ ID NO: 9884 - DNA, 20 bp, Artificial Sequence
  Synthetic Construct
tggggctcaccgctttatgg

SEQ ID NO: 9885 - DNA, 23 bp, Artificial Sequence
  Synthetic Construct
tggaggtgaccgaggaactatac

SEQ ID NO: 9886 - DNA, 19 bp, Artificial Sequence
  Synthetic Construct
gccaagatgccgtctcact

SEQ ID NO: 9887 - DNA, 22 bp, Artificial Sequence
  Synthetic Construct
gactgaaagttgaggggaagca

SEQ ID NO: 9888 - DNA, 25 bp, Artificial Sequence
  Synthetic Construct
tggaatatgaatgtggaggggatga

SEQ ID NO: 9889 - DNA, 24 bp, Artificial Sequence
  Synthetic Construct
ttcctccccaggttaatgagtagt

SEQ ID NO: 9890 - DNA, 22 bp, Artificial Sequence
  Synthetic Construct
gctctgggcttcattcatcaca

SEQ ID NO: 9891 - DNA, 22 bp, Artificial Sequence
  Synthetic Construct
cccttcccttctcacagatgac

SEQ ID NO: 9892 - DNA, 25 bp, Artificial Sequence
  Synthetic Construct
gcaagtctcccatcaagagtttaga

SEQ ID NO: 9893 - DNA, 30 bp, Artificial Sequence
  Synthetic Construct
gaccatcaataggggattctttaattaagc

SEQ ID NO: 9894 - DNA, 25 bp, Artificial Sequence
  Synthetic Construct
gcagaattcacagggcgtttttgtc

SEQ ID NO: 9895 - DNA, 26 bp, Artificial Sequence
  Synthetic Construct
tcccataatgagtcaggtgttctatg

SEQ ID NO: 9896 - DNA, 25 bp, Artificial Sequence
  Synthetic Construct
tctgtagaattcctccaccatcttg

SEQ ID NO: 9897 - DNA, 24 bp, Artificial Sequence
  Synthetic Construct
gctcctgacttattgcctcaaacc

SEQ ID NO: 9898 - DNA, 21 bp, Artificial Sequence
  Synthetic Construct
tctcccttcgctggagattga

SEQ ID NO: 9899 - DNA, 25 bp, Artificial Sequence
  Synthetic Construct
ccttcaaatttcttgccatcaccat

SEQ ID NO: 9900 - DNA, 22 bp, Artificial Sequence
  Synthetic Construct
aggacacagaccatgggcttaa

SEQ ID NO: 9901 - DNA, 24 bp, Artificial Sequence
  Synthetic Construct
agcactacgtgactgtcagaatcc

SEQ ID NO: 9902 - DNA, 20 bp, Artificial Sequence
  Synthetic Construct
acacgccctctacctttcca

SEQ ID NO: 9903 - DNA, 22 bp, Artificial Sequence
  Synthetic Construct
gagcctggctacaacatagtgt

SEQ ID NO: 9904 - DNA, 20 bp, Artificial Sequence
  Synthetic Construct
agggctgaccggtgagttca

SEQ ID NO: 9905 - DNA, 28 bp, Artificial Sequence
  Synthetic Construct
cctggagttaaatctcatctcagactgt

SEQ ID NO: 9906 - DNA, 28 bp, Artificial Sequence
  Synthetic Construct
tcacattgaaatagtgacaacacaactt

SEQ ID NO: 9907 - DNA, 23 bp, Artificial Sequence
  Synthetic Construct
gcagtcgggcagtaagaaatttc

SEQ ID NO: 9908 - DNA, 19 bp, Artificial Sequence
  Synthetic Construct
aggccctgtgtccgaaaga

SEQ ID NO: 9909 - DNA, 19 bp, Artificial Sequence
  Synthetic Construct
aggaaaggaggcggaacca

SEQ ID NO: 9910 - DNA, 22 bp, Artificial Sequence
  Synthetic Construct
gcatgacgttggcacatcactt

SEQ ID NO: 9911 - DNA, 25 bp, Artificial Sequence
  Synthetic Construct
ctctcatcgcaccattgtcttatgg

SEQ ID NO: 9912 - DNA, 26 bp, Artificial Sequence
  Synthetic Construct
gctgctaacagaatcctttctaagca

SEQ ID NO: 9913 - DNA, 28 bp, Artificial Sequence
  Synthetic Construct
cacaagccctaatataacactcttcttg

SEQ ID NO: 9914 - DNA, 20 bp, Artificial Sequence
  Synthetic Construct
atgagccaggcatcctgctt

SEQ ID NO: 9915 - DNA, 18 bp, Artificial Sequence
  Synthetic Construct
tctgtggacccgctgcat

SEQ ID NO: 9916 - DNA, 25 bp, Artificial Sequence
  Synthetic Construct
ctcccaatgtcagttaagcaagtgt

SEQ ID NO: 9917 - DNA, 29 bp, Artificial Sequence
  Synthetic Construct
ctctctctctctgaattttgatgttacct

SEQ ID NO: 9918 - DNA, 23 bp, Artificial Sequence
  Synthetic Construct
gcattcagatgggacctgggtaa

SEQ ID NO: 9919 - DNA, 27 bp, Artificial Sequence
  Synthetic Construct
gttggcatccagatatacagacaaagt

SEQ ID NO: 9920 - DNA, 22 bp, Artificial Sequence
  Synthetic Construct
ggcaaagaacagagagcagtga

SEQ ID NO: 9921 - DNA, 25 bp, Artificial Sequence
  Synthetic Construct
cttctgccatcttagttgtgtgagt

SEQ ID NO: 9922 - DNA, 27 bp, Artificial Sequence
  Synthetic Construct
gcaacaaaacaagtctagatcctgact

SEQ ID NO: 9923 - DNA, 21 bp, Artificial Sequence
  Synthetic Construct
tgggcctctattgctccacaa

SEQ ID NO: 9924 - DNA, 27 bp, Artificial Sequence
  Synthetic Construct
ccacttttcctgaaatacctagatcct

SEQ ID NO: 9925 - DNA, 21 bp, Artificial Sequence
  Synthetic Construct
ccacaggatggctgagaggat

SEQ ID NO: 9926 - DNA, 24 bp, Artificial Sequence
  Synthetic Construct
gtcatccttcattgggtgaatggt

SEQ ID NO: 9927 - DNA, 22 bp, Artificial Sequence
  Synthetic Construct
ttccagcatcgtgggagcattt

SEQ ID NO: 9928 - DNA, 26 bp, Artificial Sequence
  Synthetic Construct
ccttacctctctgctatcacttatgc

SEQ ID NO: 9929 - DNA, 22 bp, Artificial Sequence
  Synthetic Construct
tctcaggacaccatgggaatga

SEQ ID NO: 9930 - DNA, 21 bp, Artificial Sequence
  Synthetic Construct
actgcaggggtttcacttgtg

SEQ ID NO: 9931 - DNA, 26 bp, Artificial Sequence
  Synthetic Construct
gcatgcctgcaatcctaagtattcag

SEQ ID NO: 9932 - DNA, 29 bp, Artificial Sequence
  Synthetic Construct
gcctcaggacttaggtatgatttttagca

SEQ ID NO: 9933 - DNA, 28 bp, Artificial Sequence
  Synthetic Construct
catcaagatgatctttgatgtggaaagt

SEQ ID NO: 9934 - DNA, 22 bp, Artificial Sequence
  Synthetic Construct
ccagctgttgagagtgttgact

SEQ ID NO: 9935 - DNA, 21 bp, Artificial Sequence
  Synthetic Construct
aggtgagctggggagacttag

SEQ ID NO: 9936 - DNA, 26 bp, Artificial Sequence
  Synthetic Construct
ggaaccatgatgagctgaagttcttg

SEQ ID NO: 9937 - DNA, 22 bp, Artificial Sequence
  Synthetic Construct
gcactggcaaaactcaggaaga

SEQ ID NO: 9938 - DNA, 25 bp, Artificial Sequence
  Synthetic Construct
gcagagcctaaaatatttgctgtct

SEQ ID NO: 9939 - DNA, 24 bp, Artificial Sequence
  Synthetic Construct
cagattcacaggcatggtcagaag

SEQ ID NO: 9940 - DNA, 23 bp, Artificial Sequence
  Synthetic Construct
gcttccagaggattccagatgtc

SEQ ID NO: 9941 - DNA, 20 bp, Artificial Sequence
  Synthetic Construct
aggggtgcttggctccatct

SEQ ID NO: 9942 - DNA, 25 bp, Artificial Sequence
  Synthetic Construct
acccagagttaaagccaaaataggt

SEQ ID NO: 9943 - DNA, 22 bp, Artificial Sequence
  Synthetic Construct
ctttgtgactccaagccttcca

SEQ ID NO: 9944 - DNA, 22 bp, Artificial Sequence
  Synthetic Construct
gtggaaggactcaacacccaat

SEQ ID NO: 9945 - DNA, 22 bp, Artificial Sequence
  Synthetic Construct
ctgcttccagtgctctaagtga

SEQ ID NO: 9946 - DNA, 25 bp, Artificial Sequence
  Synthetic Construct
gttgatgaacctgttaatgcacgta

SEQ ID NO: 9947 - DNA, 24 bp, Artificial Sequence
  Synthetic Construct
cagtctgttgcactacaaggtaga

SEQ ID NO: 9948 - DNA, 22 bp, Artificial Sequence
  Synthetic Construct
agtgttaggacaagggcttgag

SEQ ID NO: 9949 - DNA, 21 bp, Artificial Sequence
  Synthetic Construct
tgtgggacctcgtggatttgt

SEQ ID NO: 9950 - DNA, 27 bp, Artificial Sequence
  Synthetic Construct
gactttgaccagcactatactgtaaca

SEQ ID NO: 9951 - DNA, 25 bp, Artificial Sequence
  Synthetic Construct
gccatcacagttgtccttaatatgc

SEQ ID NO: 9952 - DNA, 22 bp, Artificial Sequence
  Synthetic Construct
gcagaatccagccctctcattt

SEQ ID NO: 9953 - DNA, 26 bp, Artificial Sequence
  Synthetic Construct
ctgggatttctgaacttatgctgaga

SEQ ID NO: 9954 - DNA, 24 bp, Artificial Sequence
  Synthetic Construct
gccctttggtttgcaaagaaaaca

SEQ ID NO: 9955 - DNA, 22 bp, Artificial Sequence
  Synthetic Construct
tgcccacaacctctgactaagt

SEQ ID NO: 9956 - DNA, 22 bp, Artificial Sequence
  Synthetic Construct
gtggggaagggataaggtagga

SEQ ID NO: 9957 - DNA, 30 bp, Artificial Sequence
  Synthetic Construct
gatgcatagaaatgtcccaaatatttctga

SEQ ID NO: 9958 - DNA, 24 bp, Artificial Sequence
  Synthetic Construct
agcccagatacttgtcccatcaac

SEQ ID NO: 9959 - DNA, 30 bp, Artificial Sequence
  Synthetic Construct
tgagcatcaaagagtagttttcaatatgac

SEQ ID NO: 9960 - DNA, 27 bp, Artificial Sequence
  Synthetic Construct
tgacaaaaatccaaggttcttttcact

SEQ ID NO: 9961 - DNA, 27 bp, Artificial Sequence
  Synthetic Construct
gcccagtattgaacttctcccttagga

SEQ ID NO: 9962 - DNA, 25 bp, Artificial Sequence
  Synthetic Construct
tctacccctgatgtaacttggctat

SEQ ID NO: 9963 - DNA, 21 bp, Artificial Sequence
  Synthetic Construct
agagcttccctacacctgctt

(The sequence listing continues in the following parts.)

What is claimed is:

1. A method of amplifying target loci in a nucleic acid sample, the method comprising:
    contacting the nucleic acid sample comprising at least 50 target loci with a library of at least 50 different primers to produce a reaction mixture;
    subjecting the reaction mixture to primer extension reaction conditions to produce amplified products comprising target amplicons; wherein the annealing temperature for the reaction conditions is greater than a melting temperature of the at least 50 primers, and wherein the at least 50 of the target loci are simultaneously amplified; and
    sequencing the amplified products.

2. The method of claim 1, wherein the target loci are SNP loci.

3. The method of claim 1, wherein the annealing temperature is at least 3° C. greater than the melting temperature of the primers.

4. The method of claim 1, wherein the annealing temperature is at least 3° C. greater than the highest melting temperature of the primers.

5. The method of claim 1, wherein the annealing temperature is at least 8° C. greater than the highest melting temperature of the primers.

6. The method of claim 1, wherein the annealing temperature is at least 3° C. greater than the average melting temperature of the primers.

7. The method of claim 1, wherein the annealing temperature is at least 8° C. greater than the average melting temperature of the primers.

8. The method of claim 1, wherein the range of melting temperatures of the primers is less than 5° C.

9. The method of claim 1, wherein the ΔG values for each possible combination of two primers in the library are all equal to or greater than −5 kcal/mol.

10. The method of claim 1, wherein at least 100 target loci are amplified in a single reaction mixture.

11. The method of claim 1, wherein at least 200 target loci are amplified in a single reaction mixture.

12. The method of claim 1, wherein at least 90% of the amplified products are target amplicons.

13. The method of claim 1, wherein at least 90% of the target loci are amplified.

14. The method of claim 1, wherein less than 20% of the amplified products are primer dimers.

15. The method of claim 1, wherein the concentration of each primer in the library is less than 20 nM.

16. The method of claim 1, wherein the primers have 2, 1, or 0 guanines or cytosines in the last 5 bases at the 3' end of the primers.

17. The method of claim 1, wherein the length of the annealing step of the reaction conditions is 3-60 minutes.

18. The method of claim 1, wherein the target loci are SNP loci, and wherein the nucleic acid sample comprises cell-free DNA of mixed origin.

19. The method of claim 18, wherein the nucleic acid sample comprises cell-free DNA from a transplant.

20. The method of claim 18, wherein the nucleic acid sample is from a transplant recipient.

* * * * *